United States Patent 7,560,542 (NUCLEIC ACID MOLECULE SEQ ID NO. 68811 AND OTHER MOLECULES ASSOCIATED WITH PLANTS) - sequence listing, part 12

SEQ ID NO: 71230 - DNA, 283 bp, Zea mays
  Clone ID: LIB3078-026-Q1-K1-B12
acgcaccactcgcaagtccccttgcggtgaaggaacaaacacatgggatcggtttgagttccgcattcagcaagagggtgattgacctaatcagctcccctgatgtggtgaagcagatcacctccatcacaattgagcccggtgttgaggttgaggtgaccattgccgacgtgtaaggacgtgaagttcagcaatgtcatcgacaatctttttctttgtgctccctgtgtgctcgcaagagagattttgagttattattagcatacaagacttcttcccccct

SEQ ID NO: 71231 - DNA, 245 bp, Zea mays
  Clone ID: LIB3078-026-Q1-K1-B2
attgctctctggcgactgtagattccgtataccatgatgaagcctgcttgctttgagaccatcggggagctgatctacaagcatgctgtgcctgtaccaaagtctgactgctacacgactacccagttggcgattaactgagctggtggttacattgcgaggagtattgtgagctattgattataacccgggtgacaacctcgggtatgtgatgaacaatgccgagggagctacagggtgagatg

SEQ ID NO: 71232 - DNA, 405 bp, Zea mays
  Clone ID: LIB3078-026-Q1-K1-B3
ggaagagttcgatgcaacacggtggcttgatagatctctcatacgtctttgctcaagatgtggggattatcggaaggatgacccctcttcatttagtttgcattcaaatttctcattgttccctcagttcatgtttaatctgcggcgttcacaatttgttcaggttttcaataacagtccagatgagacagcttatttcaggatgttactcaatcgcgagagtatcactaactcggttgccatgatccagccttccttgatatcattttcctttgattcacctccatctccggtgtttctagatgtggcatcattagcggcagatcgtatactgctacttgatgcgtactttagtgttgtcattttccatggcatgacaattgctcagtggagaaacatgggtta

SEQ ID NO: 71233 - DNA, 429 bp, Zea mays
  unsure at all n locations
  Clone ID: LIB3078-026-Q1-K1-B4
cccgcatcgaacctaacccccgacctgaccgaatcgaaggctgcggcggcaatggccggggaccatggcggtggccacgccggcggcgacttccgccagaaggtatggagcatgacgggcggcccctactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgtggtgcaaaaactttggtaagaaggaatactgaaggaccctncaactagcatgaagtgtgggcacctngcttttgcattctntttgtggaaacctgtgcctagccataatgctgggttaagtgttaggagcatctctggaattgctcgcgtagtatcttttg

SEQ ID NO: 71234 - DNA, 436 bp, Zea mays
  Clone ID: LIB3078-026-Q1-K1-A10
ggaggagccagctgccccggcggagaccgagccagctgccgccgctgagcccgaggcggcccccgtggcggcggaggaagagacgccaaaggaggaagagacggcaaaggaggcggagccggagccggcggcggctgaagaggtgaaggaggaagcggcagcgcccgctgccgagacagaagcagaaccggcagccgcggagcccgaggctgttactgccgaggagcccgcggcggctgagcccgaggctgctgctgccgaggagcccgagaaggccgagccggccgctgaggtggccgagaaggccagcgagtgaggccgtgcgccgtacgcgcactgcggcggcggacagcgggtcgggagatcgatgtctcagcgtgcgcgcgtggcgtgccagtcgcgtcgcgcgcgctggcgcctactgttcagtacaacc

SEQ ID NO: 71235 - DNA, 65 bp, Zea mays
  Clone ID: LIB3078-025-Q1-K1-F5
tgagaattgaaaatggaagaggcaccgagaacagtctggaagttctggaaggggtggggtttgaa

SEQ ID NO: 71236 - DNA, 230 bp, Zea mays
  Clone ID: LIB3078-025-Q1-K1-F7
cccactcgtcctcgaagcttgccttcttgtttacaccctaaaactaaaactagagtggtcggctgcaacaagcggtacgtacgtataggatgaagagcaggagcagcactctgttggtgatcctagttctccaggcccttctgctctcttcggctgtggccaaaggacctgcatggccgaaaaaacattgtcttgtcggcgagtgcaccatcttgtcaggcgtgtggacc

SEQ ID NO: 71237 - DNA, 309 bp, Zea mays
  Clone ID: LIB3078-025-Q1-K1-F8
gcgccgtgggccctcgcggtctggggctcgggctgttgccagcctcgcccgatcgggatggcaagtgccgccagcgacaggtgtcattcatcgcggccggtgatgctgtggcggccccgaaagcggaagaaggaggcgggctcatgaagacgctgtggctcggctcgctcttcggcctctggtacctgttcaacatctacttcaacatctataacaagcaggtactcaaggttttcccataccctataaacatcacagaagttcaatttgctgtcggaactgtagcaggctctgttccatgtgggatca

SEQ ID NO: 71238 - DNA, 54 bp, Zea mays
  Clone ID: LIB3078-025-Q1-K1-F9
ccgtgaatcaacctgtaggcagtttgaggagaccagctccaaccgtggtggcta

SEQ ID NO: 71239 - DNA, 419 bp, Zea mays
  Clone ID: LIB3078-025-Q1-K1-G1
cccacccgtccaattgggaacaggggattggaataacttgagggcattccaaaaaggcctgtgagggagggattcaagctggaacgaaaaccccttctttaaaaaacttctattgggctttaaaaacttgctacaagcgtaatggggtgcccgcattgattgctgaagtcaagaaagcatccccgagtaggggtgtgctcaaggagaactttaatcctgttgaaattgctcaagcttatgaaaagaatggagctgcatgtttgagcattttgacagatgagaagtactttcaaggaagctttgataatcttgaaaaggtgcgcagctcaagagtgaagtgccctcttctctgcaaggagtttgtcattgacaagtggcaaatctataatgctcgctctaagggtgctgatgcattttac

SEQ ID NO: 71240 - DNA, 356 bp, Zea mays
  Clone ID: LIB3078-025-Q1-K1-G10
gcgagtgcggcttctgcgcgtctggcgccggcaggctcctcccgggcgcgtgcctggtgtgcaacaacacggtgcgcgacgcgtgccacggcgagggccggctgtggtacacccgcgggtgcccgagccggtacggctggctggcgctgctgggcctggcgctctacatcttcttcttctcccccggcatgggcaccgtgccgtggatcgtcaactcggagatctacccgctgcggtaccgcggcgtgtgcggcggcgcggcggccaccgccaactgggtgtccaacctggccgtggcgcagtcgttcctgtcgctgacggaggccatcgggacgtcgtggacgttcctcatcttc

SEQ ID NO: 71241 - DNA, 306 bp, Zea mays
  unsure at all n locations
  Clone ID: LIB3078-025-Q1-K1-G11
gtaccggaacggaatggccgagccaaggcttccgaacaaataaattgtcgcctcctctggactggcagcattatgcgtctgaattgcctggggggtacttacggagcaaagccctaaacggctntttgttgtacgccagaaattctatgaattactcgagaatggtctcctacctgaaggtgttgtgaataactcgttggctgaattactgatgaagctagatgcggatctgaaacatgatatccggctctgggcccgacattatgaacacccgatgcgcgtgcgatcaaaaggtattcttcatct

SEQ ID NO: 71242 - DNA, 348 bp, Zea mays
  Clone ID: LIB3078-025-Q1-K1-G12
ttgttgtatcggtttggactgtccggccaggcgtccgccgctcactacaagggctgcaccttctaccgcgtcatccccgagttcatgtgccaggggcggggacttcacccgcggcaacggcaccggcggcgagtccatctacggcgagaagttccccgacgagaagttcgtgcgcaagcacaccgtccccggtgtgctctccatggccaacgccgggcccaacaccaacggcttccagttcttcatctgcaccgtcgcgaccccttggctcgacggcaagcacgtcgtcttccgccaagtcgtcgagggcatggacgtcgtcaaggccatcgagaaaggtgggcaccc

SEQ ID NO: 71243 - DNA, 64 bp, Zea mays
  Clone ID: LIB3078-025-Q1-K1-G2
gttcaacgataatggtctgggtccacgtacaatccgcttgctcaaggacaagttccccgatatt

SEQ ID NO: 71244 - DNA, 169 bp, Zea mays
  Clone ID: LIB3078-025-Q1-K1-G3
gacgaggttcgccgccatcacgagatccttaatgaggatgtcacgctcatcgaatccggcagagttccattccccaactacaacacgcagggaggctggaactaaggagtgaaagatgatgtgaagaaccaccagacaggaactactgctacgcatgaaatagatatct

SEQ ID NO: 71245 - DNA, 331 bp, Zea mays
  Clone ID: LIB3078-025-Q1-K1-G4
cccgggcgggcatcagggccggcggctcaagtcgcacgtcgtcgtgctaggcttggaggcaaagttgcttcaggtgtactcctaccgatcagatggctggcacgtcccgccgcgtgtgacgaggatgaagagtggaacagtctcgtcgtccagctgccagctcgcggcagctccgagtggctgtgttgtgttcatcgagaacaagaagccatggcccatgggcgtacgcgtgccgttccagcgtccatttcggttcagtgtacaaaattcgacaagtacagagtccaacaacttccacggtaccgaacaataaagcattcgataaaaagcc

SEQ ID NO: 71246 - DNA, 307 bp, Zea mays
  Clone ID: LIB3078-025-Q1-K1-G5
cccacgcgtccgtgtccttcaagataaccgttttcggtggcttactcgtgtggctggagatccacgtatagagaacacagattcaactgaaaatgattctgcagcattgggtgatactgcagcccaaacgactaccatgcttctgtatttcccatgcgggttgataagaggtgccttgaccaacttaagaatttcgtgttctgtctctgctgacatgtcaaaccttccagcatgttcgtttggggtgcgcataaagacatgaactgtgaggaatgatacaagtacagtacgaagattcgacagtatc

SEQ ID NO: 71247 - DNA, 174 bp, Zea mays
  Clone ID: LIB3078-025-Q1-K1-G6
cccacgcgtccggttgcacactgggcatgatatagaaacaacaagctgaagaactggagaaggctggacttacagcatataatcataacctagatacatcaagagagtattaccccaacattattaccacacgatcatatgatgattggctgcagactctttagcatgtgcgtg

SEQ ID NO: 71248 - DNA, 256 bp, Zea mays
  Clone ID: LIB3078-025-Q1-K1-G7
cggacgcgtgggtgcccgggatcatgttcctctccggcgggcagtcggaggtggaggcgacgcacaacctcaacgccatgaaccaggggcccaacccgtggcacgtgtccttctcctacgcgcgggcgctgcagaacacctgcctcaagacctggggcggccagccggacaaggtcaaggcggcgcatgacgcgctgctgctgcgcgccaaggccaactccctggcgcagctcggcaagtacacctccgacggcga

SEQ ID NO: 71249 - DNA, 418 bp, Zea mays
  Clone ID: LIB3078-025-Q1-K1-G8
gtgacattccattagataattcgctgcttaggcaagtctcaagcctcgtaagaaggcgtccagctatggagtcacagaaattccaagacgacttcttaatggaatacaacgacactctcctcatgacctaccttgcaatggtcactaaatgttcaagcacaatgaacgagttggtcgagaagataaacacgagctatgagagaacgactagcaggagaggaggtcgaggtgctttcatgtagctcaccggccgtgatcctgctgctgctttcatctgtggagattttttgaaagagctaatgttctcgaggcagttttttgcatacattctattatgtgcaacctgctatacgcatgagaggaggccgaggtgcctgccttcatgcatgctacccggaggcatttttttttcatgcaa

SEQ ID NO: 71250 - DNA, 145 bp, Zea mays
  Clone ID: LIB3078-025-Q1-K1-G9
ctgtcatccgaggaagaagataaaaagtttacagaaaaagagaaagaaaagccaagtgaggacagtatcaaaaaaattctttcaaatcagcgaaacttaaaaaagtattgtaaaataccctccggcaacaaccatgattaaaggc

SEQ ID NO: 71251 - DNA, 363 bp, Zea mays
  unsure at all n locations
  Clone ID: LIB3078-025-Q1-K1-F4
cccacgcgtccgcctcgatctcgcgctaggttttcgccacaccgctctcgtcgtccgcgaagatgccgaagaacaagggtaagggaggcaagaaccggaagcgtggaaagaacgaggctgacgacgacaagcgcgagctcgtcttcaaggaagacgggcaggagtatgcgcaagtgacccggatgctcggcaacgggcggtgcgaggccacctgcgtggacggcacgcgtcgcctcttgcatattcggggcaagatgcacaaaaaggtggggatcgcgggcggggacatcgtnctcgtcgggcctcgcgactaccaagacgacaaggccgacgtcatnctcaagtacatgaacgacgaggcgc

SEQ ID NO: 71252 - DNA, 279 bp, Zea mays
  Clone ID: LIB3078-025-Q1-K1-H1
tgggcccggtttacattccggcccaaattcccgggaacaaaggattccaacgatggtccctgcattttcaccatcaattttgggttctaggcatgcctctatgacatcgaaggggaaatataacattgattattacagccgtgtatctgttctgataggggaggggaactgacaacacacctggcttcaaatgatgatgggagtgcattcctgtgtacattctatacatctgatattacctctgatataaacgtttgacgttatgttaaacaatttgtt

SEQ ID NO: 71253 - DNA, 321 bp, Zea mays
  Clone ID: LIB3078-025-Q1-K1-H11
ctccagcatcggccaggagctggcccactttcccacgcccccgcccgtcacctcccagttctggctgtggctagtgacgtggcacctgggcctgttcatcgtgctcaccttcgggcagatcggattcaagggcaggaccgaggactacttcgagaagtgaagcgggtaagatcctattcatcattcctggtgctgcgctgcgttgcgttgcgtgcgtgctcgccgctatcgaacctttgctgataagggtccgatttcgtcgcatggaatgtatgatgccacttctgagcctcaatgtgaaatctatgccggcccggcccc

SEQ ID NO: 71254 - DNA, 54 bp, Zea mays
  Clone ID: LIB3078-025-Q1-K1-H3
ataataggcaaacataccatgacaattgaattaatgaataacacaaccatcgac

SEQ ID NO: 71255 - DNA, 349 bp, Zea mays
  Clone ID: LIB3078-025-Q1-K1-H7
gcaggctctcctgctccccgcgcgggccgcgccgccgacgccggcgatgcttcggcggcgtgcggtttctgcctccgcgtgtgcgtcgcatgtctgccgccccctattcggtgccgccagttgcatctcctgtggggtccacggaagcgttcgggggcacctcacagtggcggtggcgggggccccgccctcgccttcgtactcaccttcgtggggaccgctctatccgacgccttcaaccaccgagcaagaagtggagagggtcaagctcgagcaggttatgaagagactagaaaaaacagcaaggtatttcaagaatttgggtaccctggggttctggtcccaattg

SEQ ID NO: 71256 - DNA, 194 bp, Zea mays
  Clone ID: LIB3078-025-Q1-K1-H8
cccacgcgttctcccacgcgtccgcggacgcgtgggagaaactccaaaggaggcccggaagccaaaggtggttgaggtaccagcaaaagaagaagcaccaaagcctaatccaaagaattcttttgacttgctgccaccaatcaagatggtgcttgatgactggaagaagctatactcaaacacaaagaccaact

SEQ ID NO: 71257 - DNA, 324 bp, Zea mays
  Clone ID: LIB3078-025-Q1-K1-H9
cagccgccgtcatgtcgaagcgaggtaggggaggttcggctgggaacaagttccgggtgtcactgggtctaccggtggcggccacggtgaactgcgcggacaacacgggcgcgaagaacctctacatcatctccgtcaagggaatcaagggccgcctcaaccgccttccgtccggctgcgtcggcgacatggtcatggccaccgtcaagaagggaaagcccgacctcaggaagaaagtgatgcctgccgtcatcgtccgccagcgcaagccgtggcgtcgcaaggaccgtgtctacatgtacttcgaagataatgctggagtga

SEQ ID NO: 71258 - DNA, 423 bp, Zea mays
  Clone ID: LIB3078-026-Q1-K1-A1
ctgcaacaacaagccaaccgaacaacagcgaagctgctgccgtctccggtctgccaccaccaccgtctgtgttccacgatcctagcagagatcaagagaaaaggagagggagtacagagtctagagagacggagagaataatggacgacaagagcaagaaggggaggcggaggtccacgccggggagccctggctgccctgcggcggggctcaagggccgggggtcccggtccccgcccggccgctcggtgcctggccggctggcgagcctggtgaaggcgcagagggccaggctccacatcgtgcgccgctgcgtcaccatgctcctgggcttgaaggattaacacttactactagtactagcatttaagcaggccctggggtttttttttcttttctgaattggtctcttctggcctggcc

SEQ ID NO: 71259 - DNA, 163 bp, Zea mays
  unsure at all n locations
  Clone ID: LIB3078-025-Q1-K1-D12
cgtccgcccacgcttccgcgcagaattgcagcttaacgatcggatctagcagatttctctcagggtgatctgcggcggcgattagcgtgcggatcggagatggcnacaagcgcgtggaggaggatagcggcggcccggtcctcctggagccccgccacggtgt

SEQ ID NO: 71260 - DNA, 328 bp, Zea mays
  Clone ID: LIB3078-025-Q1-K1-D3
ccgggttttccaacgttacttaagccgttagtttggaactccgccagtccccaacagcaggggagcttgaactacggccgcggcccttggcgattttcttaagcggcaaacagggccaacaaaatccggcccttgcaatggagtccgtggggaacccgaaggcatacccgctggctgatgcgcagctgacgatggggtatctcgatatcattcagcaggccgccaactacaaacagcttaagaagggagcgaatgaagcgacgaagaccctgaataggggcatatcggagtttgtagtgatggcggcggacacagagcctctcgagat

SEQ ID NO: 71261 - DNA, 413 bp, Zea mays
  Clone ID: LIB3078-025-Q1-K1-D4
gcaaaagggcgtgtttgagactagcggaccgaccttgaagttgaagttgaaaaggtgggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcagggccaagggtatcaccgcggttggtgccgtctgccacgtctccgacgcacagcagcgcaagagcctcatcgagacggccgtcaagagctttgggcacatagatattcttgtctccaatgctgccgcaaatccttctgtagatagcatactttgaatgaaagagtctgttctcgataagc

SEQ ID NO: 71262 - DNA, 245 bp, Zea mays
  Clone ID: LIB3078-025-Q1-K1-D5
cctactcttcctttttctcactatctttccttccttcactccatatcccactgggggggcctataccccgacgcatctaatctgctcccccctcaaggcgaaagtgaccatattgacctcacgctcaccaagcttctcacccggcttttccccaagactgatatctcggatcctgatgcttgcactctccgcccccggaactaccacacttctatacatgcttaaactcgcctagatcctaccac

SEQ ID NO: 71263 - DNA, 253 bp, Zea mays
  Clone ID: LIB3078-025-Q1-K1-D6
gcggaggggcggcggtgggcggactacctgaggcccgggtgcgtggacatcgagcggcgcttcccgaaccgcaagaacccggtgcccgacgtggggtaccccggggggctgtggttcgactgggccaactggggccgcgggtccccggagcccgtgatggtgctgcgcaccaaggagatcaagaacgggcggctcgccatgctcgccttcgtcggcttctggttccaggccgtgtacacgggccagggcccca

SEQ ID NO: 71264 - DNA, 315 bp, Zea mays
  unsure at all n locations
  Clone ID: LIB3078-025-Q1-K1-D7
tcccactcctcctcccacgcgtccttcctctcgttcgcacacacacatanagagactggtggtttccaaagcacaagtgtgtactatcagtctatcaaccagctagcctcgacggcagcaagcagccatcatgtctgaggataagcaccaccactttttcatccaccacaactatgactaggagcaacccgccggcgagtacaggttctccgagaccgaagtggtcaccgacaccggcgagggcgaatgcaataagtacaagaatgatgaaaaagaacacaagcacaatcagcaccttggcgttgccggcgccat

SEQ ID NO: 71265 - DNA, 329 bp, Zea mays
  Clone ID: LIB3078-025-Q1-K1-D8
aacagattgacacggtgggaggaaaaagacaatggtcagcaacttactcggagcagagattttttaattgtggtacccgtggtgctgttcaataagagagcatcatagtgttgcataaataagtgtgcttatgattcatatttgctcattgcaaattggagttatttgtgttgtttctttgtatactcaacaaagagatgttaaccacttgtgtttatctcattgccacactcagttatgtcacgtaacttcattttcatgttttattttgttccagcaatgtagtttatctttggtttaatagctctttctttgtaaaacaacatttt

SEQ ID NO: 71266 - DNA, 267 bp, Zea mays
  Clone ID: LIB3078-025-Q1-K1-D9
tctccttcccggtctcctccgcccgttgccttcgtcccctccatctccggctgcgtggccggcgagcccgacaccgcgaatcggatccgccgacaaggcgagagggaagagatggggctcacgttcaccaagctgttcagccggctgttcgccaagaaggagatgcggatcctgatggtgggactcgacgccgccggaaagaccaccattctctacaagctgaagctcggcgagatcgtcaccaccattcccaccatcggattcaat

SEQ ID NO: 71267 - DNA, 129 bp, Zea mays
  Clone ID: LIB3078-025-Q1-K1-E1
ggggggagggatggaagcctcgggccgggatttccgggttggcccaaggcttccgggaagggaaattggcggtcctgggggcctgaccaaactttccgtggttgttccattcgggggcaatgggctggg

SEQ ID NO: 71268 - DNA, 398 bp, Zea mays
  Clone ID: LIB3078-025-Q1-K1-E10
ggcccccgcggcggcggccaagaccatcgcggtcggggatcggctccctgacgcgacgctctcctacttcgacacgtcctcccccgacggcgagctgaagacggtgacggtccgcgacctcaccgcggggaagaaggtggtgctcttcgccgtgcccggcgcgttcacgcccacctgcacccagaagcacctcccggggttcgtggccaaggccggggagctccgcgccaagggcgtcgataccgtggcctgcgtctccgtcaacgacgccttcgtgatgcgcgcgtggaaggagagtctggggatcggggacgaggtgctgctcctgtcggacggcaacggcgagctggcgcgcgccatgggcgtcgagctcgacctctccgacaagcccgtggggc

SEQ ID NO: 71269 - DNA, 404 bp, Zea mays
  Clone ID: LIB3078-025-Q1-K1-E11
gccggacaagccttccgttgcgttggacggcggcgcggtgctcatcactaagaatctcgacgctatcacggccgcgatccagcgtgccttcgccgctgtcgacaccaagctctccacctggctcgagcaaacggacaaggacgactctggtgctacggccactgtcatgtttctcaggagcgatgtgcttgttgtctcgcacattggggactcttgcttggtgatatcacgtggtggaagatctgaagctttgactggctctcatcgaccatatgggaacaacaaaacgtcccttgaagaggtcaagaggatcagagcagcacgtggatggattgttgatgggcgcatatgtggagacatatctgtatctcgcgcttttggtgacataagatttaagacacaaa

SEQ ID NO: 71270 - DNA, 413 bp, Zea mays
  unsure at all n locations
  Clone ID: LIB3078-025-Q1-K1-E12
cgtccgccactggaccaccctgacggaagacgacgagttcctaatcatcggctgcgatgggggatgggatgtgatgagcagccagcacgcggtgagcacggtccgcaagggcctccggaggcacgatgaccccgggcggagtgcccaggagctcgccatggaggcgaagaggctcgagaccttcgacaacctcaccgtgatcgttgtctgctttgtccccgacctcgccgggggctcggctacgccctcggagcatgtgccggctggaaggatcaggtgccgcaagagcttgtcgccagaggcactctgcaagctgaggagatggctcgagtctgaccagtagacgcttctatctgtagaggccagcgccagcctgtgtttctgtgctgtggctgtgtaaatatnggcgctga

SEQ ID NO: 71271 - DNA, 422 bp, Zea mays
  Clone ID: LIB3078-025-Q1-K1-E4
tcctgattcgtcttcgtctagaacgtcagaattcaccaaatcagccctcgcgggtggcccttcccccggctcccggcgtctctgcgctgcggccgtacggcgatgcggtggctatcgaggctgctctctcaagccgtcgccgccaggagggcctccgcggcggcgaggtccaacactagtctcgtcaagggaggatcccacgggttcgctagtggcggcagggatgggtcaccggacgtgcctcgggagtggttgcggaagctgtgggtagacgagctgaagaagcacaaagaagccgcgaggagatggggcgtcggctcatcattagaggttgcaggagcgaccgaggaggcaccgtcaaggagctatcagtacgaatacagcggctctaaccccgtggaggcaagcggattctgaaactc

SEQ ID NO: 71272 - DNA, 296 bp, Zea mays
  Clone ID: LIB3078-025-Q1-K1-E6
aaaaaacataaataaaaaaaaataaactaaaactacctaaaaataaaaacaagccagaagcggttttaccaggcgaggcgtgcaataaccttatcctcaagttctgcgaagcgcctttccaagtacggcgtctccaaggagctgtcccacgcctgaataccctgatccatccatttttgtccacctcgctgtgtacgtatgtgtaacatatggttttcatctacctgttagagccccgagagcttcttaagcataccagcgtgattacagaataacagcattcaatcaaagccaag

SEQ ID NO: 71273 - DNA, 346 bp, Zea mays
  Clone ID: LIB3078-025-Q1-K1-E7
cccactcgtccgcggacgcgtgggcgcctctacatttcttctctctctgctcctgcggcttcgcctgatccatccaagacagggatcgccatgtctgactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttggagatattgttccttcatcacacaactgtgacattccgc

SEQ ID NO: 71274 - DNA, 93 bp, Zea mays
  Clone ID: LIB3078-025-Q1-K1-E8
gtgaaatcattttgcatgttaattttcattaacaatgatctagctagctagctagcggcttaattttcattgctgggaaacaagctagctagc

SEQ ID NO: 71275 - DNA, 336 bp, Zea mays
  Clone ID: LIB3078-025-Q1-K1-E9
ctgaggtaccaccagatgcttctgcaagcgtccacgggcagccagggcaccttgctgccgttctatggcggcggcatgagcaatccctacggcggcggcgccgccatgaccggttcctacggtggagccggcggcggcaacacgagtggttccttgggctcctactactcgttcccggcctactctgtttctgtcgccaccgtgccgtcctctacttcctctgcttcggggtactactactcgtcgccgcacgactcgcaacacagcgaggcgtccgcggcggcggactggaactgggagagcgcgctggcctggcccgactcgagccagtacccg

SEQ ID NO: 71276 - DNA, 330 bp, Zea mays
  Clone ID: LIB3078-025-Q1-K1-D10
ctccttgcgcggcattcctgtccatccgcttaggtggcgcgacggcgacgcggttcgctggactggcggtggcctcgcagccagcggagcgtcgcgccgcggcgatggtcgcgatggcgaagagggagcaggagctggaggagatccgggccatgacgacggaacagatggaagaggaggtggtagacctcaagggggagcttttcctgctccgccttaagcgctcggcgcgccaggagttcaagaacagcgagttcagccgcatgcgcaagaggattgctcgtatgctaaccgtgaaaagagagcgggaaattgacaaggaatcaataa

SEQ ID NO: 71277 - DNA, 273 bp, Zea mays
  Clone ID: LIB3078-025-Q1-K1-F10
cggacacgtgggcactcaggctgaccccagattctcctgtacctcagtttcaagggcgatggtcaccattgacctgtccgaggacgacgtcatcaccctccgctaagaggttgacacgtacatgatcgatgcagaccttcaaccttgcacccatgtggcgattgagaggctctatgatattatgtgctacatgggcattcagctctagcttggactcccagctcggggcccgaggacaatgctcaactgcctgacactttaaggaacgagggc

SEQ ID NO: 71278 - DNA, 353 bp, Zea mays
  Clone ID: LIB3078-025-Q1-K1-F11
aaactaactgcttgctctagctagctagctgctcccggcccatatccactacacaggtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctgctccatcgccaccaccgccgtcgcccaccagcacgccgtgccctccgccgccgtccagctccggcggcaagtgccccaagaacgcgctgaaactgggcgtgtgcgccaacgtgctgggcctcgtcaaggtgtccatcggcaaggtgcccaccgactcgtgct

SEQ ID NO: 71279 - DNA, 365 bp, Zea mays
  unsure at all n locations
  Clone ID: LIB3078-025-Q1-K1-F12
ggcgtccgccaaggtcgccgatcgaatcgtgcgcgttctcgccatcgatctcaagggggggcgcctcaaggtcgtcggcctctccggncatacactcctccgcgcgctcgccaacgcggagctcatcgagccggcctcccaccgnctcgaggatatcgacgcgtgctccgccgagtgcgaggtccacatcgcgcatgagtggctcgacaagctgccgccaccgtcctacgaggagcggtacgtgctcacgcgcgcgtacaggaaccgcgagctcaacaagcacgcgcgcctgggctgccaggtcgtcctcacgccggagctgcatggcatggtcgtcgctgtccccgagcctaagccgtgggaca

SEQ ID NO: 71280 - DNA, 74 bp, Zea mays
  Clone ID: LIB3078-025-Q1-K1-A1
atcccaaaagcctcgaacccctttcttttttccttcggcggcggttggcaccccagggaacagccacattggcc

SEQ ID NO: 71281 - DNA, 301 bp, Zea mays
  Clone ID: LIB3078-025-Q1-K1-A11
gtggtgcggcggctgcagtcggagctgttggcgctgatgatgggcggcgacccgggcgtgtcggcgtttcccgagggggacaacatgctccactgggtgggcaccatcgacggctccgccgggacggcctacgagggcacctcctaccgcctcgcgttggccttcaccaccgagtacccgtacaagccgcccaaggtgcggttcgacaccccctgcttccaccctaacgtcgacgtgcacggcaacatctgcctggacatcctccaagacaagtggtcctccgcctacgacgtgcgcacca

SEQ ID NO: 71282 - DNA, 299 bp, Zea mays
  Clone ID: LIB3078-025-Q1-K1-A3
ttggagactttcaatggttccggccatgtatgttgcgatcgcatgcggtgctcttcacgctatgctatgtgggcgtactactcggttttgtacctcgactctggtgatgggtgtgagccacactcgtgcgccatttaccgaatggatatgtcccttcctcatgccccattcttcgtttggatcttgctggtgcgggacctcacagactccctcatgaaaattctcactgagaggggttactccttcacaacctcagccgagcgagaaattgtaagggacatcaaggagaagctagcata

SEQ ID NO: 71283 - DNA, 261 bp, Zea mays
  Clone ID: LIB3078-025-Q1-K1-A5
accggcggcgccggcatcatgcgggagggccccaacctcttgaagctggcgcgcaaggagcaatgcctggcgctcggcaccaggttgcgctccaagtacaagatcacctaccagttctaccgcgtcttccccaacggcgaggtgcagtacctccaccccaaagacggcgtctacccggagaaggtcaaccccggcagggagggcgtcggccagaacttccgcagcatcggcaagaacgtcaaccccatcgacgtcaagttc

SEQ ID NO: 71284 - DNA, 294 bp, Zea mays
  Clone ID: LIB3078-025-Q1-K1-A6
aatggtggaagcaagtgacacatatgtgatgagtaccaggatgagaaacggattatgaagatattagtttcattttcatccatgaatagaagttaaaagtggtattatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacaggtcctctatttatgtgagacatatatttcttttctttc

SEQ ID NO: 71285 - DNA, 311 bp, Zea mays
  Clone ID: LIB3078-025-Q1-K1-A9
cccacgcgttcgtggacgcgtgggcgtggaaccatgggtcacatcgcccccgaatacctgtccactgggaagtcctccgagagaaccgatgtttttggctatggcataatgcttcttgagctagtcactggtcagcgtgccatcgacttttcacgtctggaggaagaagatgacgtgttgttacttgaccatgtcaagaagctgcagagggaagggcatctcgacgccatcgtcgaccgcaacttgaacagctgttacaacgggcaggaggtggagatgatgatccagatcgcgctgctctgcacgcaggc

SEQ ID NO: 71286 - DNA, 341 bp, Zea mays
  Clone ID: LIB3078-025-Q1-K1-B10
aagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccagatactagcgtcatgaactgcctttagctaaaattttccataagttgttctcgagcagctatgtgttgcatgttggctacttccaaacttatatctggtttggtttggattgtgatgaactaatggctctttgaatttatattatgatgttgacgat

SEQ ID NO: 71287 - DNA, 84 bp, Zea mays
  Clone ID: LIB3078-025-Q1-K1-B11
ctcccccatggtcgacccggagctcgaggcgctcgaggccgggcccgggctcccgcaggcgcggctccgaagagttcaagccct

SEQ ID NO: 71288 - DNA, 329 bp, Zea mays
  Clone ID: LIB3078-025-Q1-K1-B12
cccacgcgtccgcgcaggtcgtcagctccggcatcctctggggcctcggcgacatgggcgcccataccgtgacctactactccgctagccccgaccgtcgcggccacgacagcagcccgtccgaccccgaggattaagattatatagacaataacgagtttaaagttgattggaagagggtgggcatcacaagactcttcggagttgcttttgttggtcccagtgggcattactggtatgaatacctggatcgcatcatccggcggaggtttcagcctaacacgttcaaattcgtcgcctcaaaagttgccgcggatggattcctcttc

SEQ ID NO: 71289 - DNA, 157 bp, Zea mays
  Clone ID: LIB3078-025-Q1-K1-B3
gttcttgaaccaatcggcttattggtgatgattaatcaagagggggcgtccatcatgccggaaccagaaccggttcaatgatctacaagccggagataatggccattggactggtttccatgtattggaagcaagttaagattgatccacaagattt

SEQ ID NO: 71290 - DNA, 182 bp, Zea mays
  Clone ID: LIB3078-025-Q1-K1-B5
tgcgacacccgacacctcgccgagctcaagtgaagagctaagacggccgccttgccatgttctccatgttcggcttcttcgtgcaggccatcgtcaccggcaagggccccatcgagaacctctttcgaccacgtcgccgaccccgtcgccaacaacgcctgggcatacgccacgaacttcgt

SEQ ID NO: 71291 - DNA, 188 bp, Zea mays
  Clone ID: LIB3078-025-Q1-K1-B8
cccacgcgtccgcccacgcgtccgaagaaaccctcctccaccaacccaatccagctggcgtccgtctgggtgaactccagggccaagatcagttcgccgccttcgttcgcatcacctacgcggttcaatccaactggcaggaaagaacgtgatggccaaaacgagctcgttcaagctggagcaccccc

SEQ ID NO: 71292 - DNA, 115 bp, Zea mays
  unsure at all n locations
  Clone ID: LIB3078-025-Q1-K1-B9
cccacgcgtccggctgtcctctgtgctatccgctagggtttatctgctcgaggaatggcgtcngtgcaggtctccggcgcgggggtcggtgccgcggccttctctgtgaaaggga

SEQ ID NO: 71293 - DNA, 153 bp, Zea mays
  Clone ID: LIB3078-025-Q1-K1-C10
ttccaaagaggagggccgggcccgggcccggacccggaacccgaaaggttaagggggtaaccccgaattcaacaataaacctcacaaagcgcctccccggttgccacctcaaaaaaaaggccccgaatgccatcaaggagatcaggaagttcg

SEQ ID NO: 71294 - DNA, 236 bp, Zea mays
  Clone ID: LIB3078-025-Q1-K1-C11
acttcaccacggacgtgaacgggaggggggacgccgtatacgccgacggctgaggcatatccccttccgcagggtcagggtcgtcggggtcgtcgggaggctccaagtccacctccggcgccgagagtaggaggaggaggatgaccggcggttggttcgtcgccgtattggttgcggtggttggatccttctgggtttggtgagcaacgacctgttgacgaaggatgggggtgggt

SEQ ID NO: 71295 - DNA, 418 bp, Zea mays
  Clone ID: LIB3078-025-Q1-K1-C12
cccacgcgtccgctcaaattcagtcctgagctccgtgctaatcttgatgggatcttctctgagatgtcacaatgtatggacaagggtcaagttcagccgaagtctgcaatggcagctgatgttgtttcccttggggactcttggctcggctatgccatccgcaagggattgctagagcctatcaagaatgctgaagaacaggattggtttcatagcctgagtgacagatggaaggtccatttgtgcaggaaccagaacggagaagcagatcctaatggtacaatatggggagttccatacagatggggcaccatggtcattgcttacaagaaagacaagttcaaaagacataatttgaagccaatacaagattgggaggatttgtggaggcccgagcttgccgggaggatttcaatgg

SEQ ID NO: 71296 - DNA, 399 bp, Zea mays
  unsure at all n locations
  Clone ID: LIB3078-025-Q1-K1-C2
cggacgcgtggtctgacccctgggtccggccttacctcaagtcgaaggtaacggcggccgaggcagacgatcagggcggcgtggcgctcctgagcgagaccatgtacacacacgtgctggttgccacagcacaccagaccctggangacgtcgagtgccacttcgaggccgtgtcggggcttccggtcgtcgacagccgcctcagatgcgtcagtgtgatcgtcaagaacgaccgggcatgagcctctcatgggtccaagacgaagatatcggaagtgatgacatctccagctatcacactatcgtctgacaaaaccgtgacggatgctgctgttctcatgctcaagacgaagatccacagattaccagttgtaaaccaggacgaaaaagtaataggta

SEQ ID NO: 71297 - DNA, 154 bp, Zea mays
  Clone ID: LIB3078-025-Q1-K1-C3
gtggacgccacccttccgaaaaaagtgttggggccgccgttctggaggattaaaaaagaaggttccaccaaccgggggtggcaagaagccgccaacccctttggccacccccggaattgccccgaaccacccaaaaaactcgggggttggggcc

SEQ ID NO: 71298 - DNA, 218 bp, Zea mays
  Clone ID: LIB3078-024-Q1-K1-H9
gagcttgctcgctgacctagtcctacctattgacttgcttgccatggcctgcatctactgtgacgacgtcaccgggcttggcttcagcttacccttatcagaccactccgtgatcagaaggatgttcttcatcatgctcgcctatctcctcaaggccaccagcatcgcctacatggtaaaggctgacatcgccctgtttgctctgcgggctcaacacc

SEQ ID NO: 71299 - DNA, 412 bp, Zea mays
  Clone ID: LIB3078-025-Q1-K1-C4
gcctagctcaggggttatcctgaggaaagatggcttctacctgcaagaatattttgagtgagagcgtggtgggatcttactgcaaagttccctgtgatgctcttttcatcctaggaacataaacaatcctaaggatggaagtacttaaatcgagacttgggctaggaacaggtgatgctccgcccgggtcaattaaggattggatgcgtatgtaggcctgttgatcaaggactatcctatctagccacatgccctgagaatgggacagggtaagcttgaacccggctattccatacatgaaaagacaatcgcgcacttggcgtggagagatggcgagagtgacacgtacccttctggcaacggatcgcctaaaaagggtggtgtactctcgggtggcgcggaccctgtcatg

SEQ ID NO: 71300 - DNA, 366 bp, Zea mays
  Clone ID: LIB3078-025-Q1-K1-C5
cccacgcgtccgggggatcgaagcggatagcaagggagcggtcgagcgggtgacatggtcgtcatccagggtttctcaatcggcagcgatggcgaccagggcggcggcgaggttcctgcagcgcaggtttctgtcttctggcggtaaggtcctcagcgaggaggagaaggccgccgagaacgtgtacatcaagaaagtggaacaagagaagctggagaagctcgcacgcaagggccccagctcaggagagcaaccctcgtcaaccacaggctctgcagcaagtgatgtgaatgccgatgctgggccaacggagtcagcatctgcaagtgtgtcgacggacaagaacaggaactatgctgttctggc

SEQ ID NO: 71301 - DNA, 183 bp, Zea mays
  Clone ID: LIB3078-025-Q1-K1-C8
ctcgaactcgagagtctaccataccatctacatctaccaagcaagctacgccgtcggggatggatagcaaagagagaaaggaactcgtcatcgtactaagctcgacatgccgttctgtatgccgtgcctgggatcccacaccggttcctggacctcttcgttgggccggcattcatgacggca

SEQ ID NO: 71302 - DNA, 101 bp, Zea mays
  Clone ID: LIB3078-025-Q1-K1-C9
cgcttgcactatgaaaccctgcaggccctatgggcttcatgaagctcaatggggtggtctacggggaggggactaacggacgataccccatgctagggacg

SEQ ID NO: 71303 - DNA, 72 bp, Zea mays
  Clone ID: LIB3078-025-Q1-K1-D1
cccttttcttggttagctttggtttcctggggccgaattcttcttcttcttcttcaaccttgttcgttccct

SEQ ID NO: 71304 - DNA, 468 bp, Zea mays
  Clone ID: LIB3078-024-Q1-K1-G4
cccacgcgtccgcggacgcgtgggcggcctacaaaaacactgtcgagggcataactgggatcatgtcgaaaaccatctcagagaaagggatgcttgaagtgtacaactctttgagcgaggaaggcaaaaaggagttcaacaaggcttatagcgcatcgttttacccatgcatggatatactctacgaatgctatgaagatgtggcctctggaagtgaaatccggagcgtggtgttggctgggcggaggttttatgagaaagagggcctcccagcttttccgatgggcaacatcgaccaaactcgcatgtggaaggttggtgaaaaggtgcgctcaacccgtccggaaggtgatcttggcccgctccatgccttcactgctggagtgtacattgccctgatgatggctcagattgagatcctgaggaagaaggggcactcctactctgagatcatcaacgagagcgtga

SEQ ID NO: 71305 - DNA, 459 bp, Zea mays
  Clone ID: LIB3078-024-Q1-K1-G5
cttcaaaagccttggcaaggtcaaacctcggaacaagatggaaataaaggtgaaagccaaggtggaagcacagaaggtcaaagagattgcagaggagagtgcaggatcaaaaactcgtatgaacatctacctggggctgatggggatactcgggattacaattgcgaatgccatctttgcaacaccagaggtggagtggaggaaggttgctgctctgggtctgattttcattggtctggttgctcaggtcatctacgagcaggatatctcaccgccggaagctgagaagacagagaaaatagaagaataaaaaaggagttgcagacatatcggtagggtggtgtaatctcacacaggcaatgtaaactgtatatggtagcatgaatagatacaaggtttaatacttcaaaaaaaaaaaaaaagggcggggcgccgcgatctagaacgaaattctttact

SEQ ID NO: 71306 - DNA, 440 bp, Zea mays
  Clone ID: LIB3078-024-Q1-K1-G6
gccatgcgatcggcgacagtatctggcataaggccaatatggctcacgagagggacgccgagaaagacatgtcgtgagaggcagacagttgggaggcaaccctaaagacatgaacataccacgcatgatctgcatgcgtaccttcatctgcaccacctccaatgcctagtgccatgaacatgcagacgcgacgtatccaagcaacgacctctaccagtgatttcgcaacctcaagaatgatcttgcactagaagcatatgatctggtcagctaaaagacaagtactacatatatatatctacactgggtgtaaatgaatgggttgttagctgatgctgatgcagatggctcatacgtggatcccaatgtgattacgtactgtgacccttgactggcaacgaactgtgcataaaaccaaaaaaaaaaaaaaaacccacgcg

SEQ ID NO: 71307 - DNA, 199 bp, Zea mays
  Clone ID: LIB3078-024-Q1-K1-G7
cggacgcgtgggagatgcagcccctcgcgccggcggggtaccgccgcgcgccggagatggaggagaaggtggaggcgtcggtggtggacctggaggccgggaccggggagactctgtacccggggatctctcgctgggagagtgcatgttcgatggggctacgttcgcaaggtctacagcatactcgctgcacagctgc

SEQ ID NO: 71308 - DNA, 373 bp, Zea mays
  unsure at all n locations
  Clone ID: LIB3078-024-Q1-K1-G8
agaagagcctgaacgccttcttcgagctggccacggcctgctgcagcccgtcgccgtccctgagacccagcacgaggcaggtactcaagaggctcgaggagatcgcgagataaatggacgcgagtgctgagcaggcctggcgacttgctgcttaatctgcatcgctctctattgcagcataccgttgagctgagaagcgtctaccttccctaagctaaacgaagaacgtatttttgtggtgggcgagtaggaaatggatgcatgtttttcacgtccagtaacctgtactgtacagtttcaccgagatgcanggttgttcatcagaaaacatacagggtgtgctttcggtgcaaaaaaaaaaaagnatttaatg

SEQ ID NO: 71309 - DNA, 355 bp, Zea mays
  Clone ID: LIB3078-024-Q1-K1-G9
cagggttgctgaggaggtgatctttggccaagacaacgtgacaacaggagcttccaacgacttcatgcaagtgtcacgtgtcgcaaggcagatggtcgaaagatttggattcagtaagaagatcggccaagttgcgatcgggggaccgggtggaaaccctttcttggggcaacagatgtcaagccagaaggactactctatggcaacagcggatgttgtggacgccgaggtgagggaactcgtggagaaggcctactctagagcaaggcagataatcaccacgcacatcgacatgcttcacaagctctgccagctcctgatcgagaaggagaccgtggacggggaggaattcatg

SEQ ID NO: 71310 - DNA, 368 bp, Zea mays
  Clone ID: LIB3078-024-Q1-K1-H1
cccacgcgtccgcccacgcgtccgcagggtcgagacgaggggtgcagccgctgcacaagagctcagagaatctgggctctccgatgtcatcttccatcagctggacatcaccgacgctgcgagcgtcagtcggctggctgagttcctcaaggctcgttttggaaagctagatatcctggtaaataatgccgcagttggtgctgttgagtacgtccaagatcctgctgacagttcaacgagcgaggaagagctgagtggcatggatatggtccaaaggcttcagtgcatgcttaagagagtccgggagacctacgacgctgcgacagaaagcatcaagacaaactactatggcataaagcatgtgatcg

SEQ ID NO: 71311 - DNA, 296 bp, Zea mays
  Clone ID: LIB3078-024-Q1-K1-H10
gccttacgtagcgaagctcagagcaagctagggtactgtcaaggggggtgatggcgctggctcgacgcatggcggctcccgtcctcgtcctcatgctcctcctcgtcgccacagagctggggacgaccaaggtggccgaagcgaggcactgcctgtcgcagagccaccggttcaagggcctgtgcatgagcagcaacaactgcgccaacgtgtgccagaccgagaactttcccggcggcgagtgtaaagcggaaggcgccacgcgcaagtgcttttgcaagaagatatgcctgtag

SEQ ID NO: 71312 - DNA, 372 bp, Zea mays
  unsure at all n locations
  Clone ID: LIB3078-024-Q1-K1-H11
cggacgcgtgggcggacgcgtgggcgacgaccaccagcagcagcaccaggagtgctacgcctcggaccacttctggaacgacatcgcggcggcggaggcggccatctacatgttgatcgacggcggctggacagggtccggccccggccatcccgccgccgatccgccttcgtcgccggcgtgggagtactgctctgattactcgctctggaggatcgacgacgacgagtactacgagaagatgctcgactcctcctcctgattcgattatccagccatcacacgcatatgcatatctatcattagctaantctttctttttttggctgatagctagctacacagcttgagaatcaagcttcggtcggcttt

SEQ ID NO: 71313 - DNA, 239 bp, Zea mays
  Clone ID: LIB3078-024-Q1-K1-H12
tgcactcttatctatttatttggtaccatcttgctatttcaccttgtgcaatacaagagtgctctaggacctatatgttgaccttttggcattggtaaattgaatttacgaaaaaaaaaactgctgataaacaagatacagaaataagaatttagttgaaaatataccttaataaacggattgggagttatgatatgaaaactaaatgggggggaggtttagaggaccaaaacttacga

SEQ ID NO: 71314 - DNA, 454 bp, Zea mays
  unsure at all n locations
  Clone ID: LIB3078-024-Q1-K1-H2
gatttacccggtgtgagatatcgcattattcgaggaaccctagatgctgtcgcagtaaagaatcgtcaacaagggcgttctaaatatggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacanaagacagaaacaaatccactattggttttacgtcaagcaatacgtagagtaactcccaatataagagtaaaaacaagacgtaataaaaaaggatcgacgcggaaagttccgattgaaataagatctaaa

SEQ ID NO: 71315 - DNA, 460 bp, Zea mays
  Clone ID: LIB3078-024-Q1-K1-H3
cccacgcgtccggcaatatccgcagaggttaagcagctggctgaaaaggcaagagctgggaagcttgcacctaacgaatttcaagggggaactttcagtatctcgaatcttgggatgtaccctgtggaccatttctgtgcaatcattaaccctccacagtctggcattctcgcagtgggtagaggaaacaaggttgttgaacctgttgtggacagcgatggaaccgagaaggctgctgcagttacaaagatgagcctgacactatctgctgaccatcgtgtatttgatgggcaagtatgaagcaagtttttcacggagctggcgctgaatttcagcgacatcatgaggctgctattgtaaatgaaaggaagcaattaccgtgttttgacgtattctttgggagcgaaaaccgctcatgaaaagagaacatttggatgcaacccgtggtctgctgcttgat

SEQ ID NO: 71316 - DNA, 436 bp, Zea mays
  Clone ID: LIB3078-024-Q1-K1-H4
gccttacgtagcgaagctcagagcaagcgagggtacggtcaaggggggtgatggcgctgtctcgacgcatggcggctcccgtcctcgtcctcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttccccggcggcgagtgtaaggcggagggcgccacgcgcaagtgcttctgcaagaagatatgctagtagtagcctcggctttgctggcacaagcaggtcgtcggcacgcaacgcaattcaagcatcatatcggtcctacatccgggttgctgtctactcgaccccgttttctctttcgatcgatttcgttggttcctggtgctctcttc

SEQ ID NO: 71317 - DNA, 463 bp, Zea mays
  unsure at all n locations
  Clone ID: LIB3078-024-Q1-K1-H5
ggtaaatcctaggaaatttagatgagaagaaagctatagcgaggcgcttgccaagtgcttggtgaatcgcctcaaccggatgtggttgtcgatctcgcggagtcgagtcgagtttagtcgtggttgaagatacaaactcatacgaagtgatcgtgtgtatggttataaagtataccaatctactgttgggaccatgcttcgtcgccgaaggtcctgcaggaagaaacagcttcggctgaagctgtctgcacgtgatgaccgaaggttgctgttcatgaagcttcggaattacaaaccgacttaaaagtagaatgaccttttagtccataagtgtttgagtcgttgttgtaaacttttatgaggggcatgtttgtaattcctcacaggctgtgtctngtgcctataaatagtgaacaatattcctttactgttcacacattcttgtaattgcaatcgcatcaat

SEQ ID NO: 71318 - DNA, 466 bp, Zea mays
  unsure at all n locations
  Clone ID: LIB3078-024-Q1-K1-H6
ccggcatctgcaccagcggcaggggacgaagaagaagaagaaggcccctctctcgacctgctccgccgccagctcgccgcgggcgactaccggcaggcggacgagaccacgcgggcgctgatcatcgacctcgccggcgagcccgcgaggcgccgagggtacgtcttcttctccgaggtccagttcatcccggccgaggacctcgccgccatcgacgggctctggaaggagcacagcggcggcaggttcgggtacagcgtgcagcggcggctctgggagaagtcgcggcgcgacttcacccgcttcttcatccgggtcggctggatgaggaagctggacacggatgtggagcagtacaactacagggcctttcccgacgagttcttgtgggagttgacggacgacacgcccganggacacctgccggttaccaacgccctcaggggcacgcaacttctggcgaaca

SEQ ID NO: 71319 - DNA, 251 bp, Zea mays
  Clone ID: LIB3078-024-Q1-K1-H7
cggacgcgtgggcggacgcgtgggaacagttgctgatgtagcctcccatatccagcatgagattcactatggatgtgacaatgcatcagcctctccaaggtcacaataccctagccaaagcactgcaccgacaatgcacattcccaacacaagcaaccagcaaccatcgtcaagcttatttgcttcatgaaaccctgggttgacacagtccaagaattccatggtcttttcaagcgcattatccagcccca

SEQ ID NO: 71320 - DNA, 236 bp, Zea mays
  Clone ID: LIB3078-024-Q1-K1-H8
caactattaaattctgggatcttgtagcttggaggactatgtgtacccttactcaccagaaaaagtctgtccgagctatggcgcttcatccaaaggagaaagcatttgcatcagcatcagcagacaacgtaaagaagtttaaccttcccaaaggcgaatttctgcacaacatgccttctcagcagaaaacaataatgaattcaatggctgcaaatgaggaacgtgtcttggcaact

SEQ ID NO: 71321 - DNA, 278 bp, Zea mays
  Clone ID: LIB3078-024-Q1-K1-G3
cccacgcgtccgcccacgcgtccggttcgtcaagaaccgggagctggaggtgatccactgccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatccttgccatctgggcctgccaagtcgtgctcatgggcgccgtcgagggctacc

SEQ ID NO: 71322 - DNA, 369 bp, Zea mays
  Clone ID: LIB3078-024-Q1-K1-E7
ggccacggcaagttcaagcatggtcacggccaccacggcaagttcaagcacgggcacggcaagttcaagcatggcaagcacgggcacggcatgttcggcggcggcaagttcaagaagtggaagtgatgtgccctccatggttgatcgtagctgaactcaggcttccaggacatgtgttgccagtaataccttttcagcgttactcatccttcatctgtatttccagtaatccagcttgtggcgagtgacataatgctaataagtgacataaataaccatttgctgatatgctgtatatgttggtcttgtggatggagcgctctgaagattatatccattgccagtaataaatcgtggctttatctgacc

SEQ ID NO: 71323 - DNA, 469 bp, Zea mays
  Clone ID: LIB3078-024-Q1-K1-E8
cccacgcgtccgatcacccaggtcatagctacatcggttatcttaggtttactgtggtggcactctgatcccagcacactaaaaggtctagaggatcaggctggcctgctgtttttcatcgctgtgttttggggcttctttccagtgtttactgcaatctttacattccctcaagagagggcaatgctgaacaaagagcgcgcagtcgatatgtacaagctcagtgcatacttcttggccaggacgacgagtgatctaccacttgaccttttcctcccaatcatattcatggtgatcgtgtacttcatggcaggcctcaaagcaactgccacacatttctttctcagcatgttgaccgtctttctcagcataattgctgctcagggacctcgattggcaattggagctactctgtttgacatcaagaaagcgacaactctagctttagttacagtcatgacattcatgc

SEQ ID NO: 71324 - DNA, 235 bp, Zea mays
  unsure at all n locations
  Clone ID: LIB3078-024-Q1-K1-E9
caacaactcggcacacggtcagaaagtgtggacgtcgatgcgccggtcgagcacctagcgccgncttcgaaagcgacgacgggagctcgcggcggcctgctcgccgccgtggcgacgacgacgagcagctgcacggcagtgttaccgtgtcacgccttatcangcgccggagcggtggaatcgggaccgcggtggtggacgtcgncgctggacaccctgtaccgcgcggcggcgg

SEQ ID NO: 71325 - DNA, 271 bp, Zea mays
  Clone ID: LIB3078-024-Q1-K1-F11
cccagcacgccgtccccgatcttcggcggtagcactgtcgggctgctccgcaaggcgcaggtggaggagttctacgtcatcacgtgggtgtcccccaaggagcatgtgttcgagatgcccaccggcggcgccgtcatcatgcgggaggggcccaacctgctgaagctggcgcgcaaggagcagtgcctcgcgctcggtaccaggctgcgcttcaagtacaagatcacctaccagttctaccgcgtcttccccaactgcgaggtgcagtatc

SEQ ID NO: 71326 - DNA, 349 bp, Zea mays
  Clone ID: LIB3078-024-Q1-K1-F12
gctagatgataagtctacagcagatgggaaacctgtagagaatgccacagtcgcgacgaatgaggattcaacaacagttgagaatactctgaaggatgcaatggttgcgccaccaggtacaaataccaccaacgccgaagaaactgctctgggtgccacagttaaagcactagatgaggatgctctagcagtggagaagactatagaggatacctcggttgaggcatcagatgtacaagcaggcaggtgcaagtgagtaaaccagcttatcgaaccttgcgttcctgtcagtttctgttgatatcgacgtagtttgctcaactgattctctcatctagaactttagatg

SEQ ID NO: 71327 - DNA, 220 bp, Zea mays
  Clone ID: LIB3078-024-Q1-K1-F2
cggacgcgtgggcggacgcgtgggcggcgttggccatcgtcgccctgttttttattttggggttcatgtactatttgtgtgagagttcttgatctcttgtcgccgcggaattgtgttactatcttattactgtaccattgaccatttttcttgtgagattcatttgagtagtcactttaacagagtaagagatgtattctatgtgacttcgcgattgatt

SEQ ID NO: 71328 - DNA, 213 bp, Zea mays
  Clone ID: LIB3078-024-Q1-K1-F3
gccacgcgtccgccgacgcggccgtccacgcgtccgaggaaacgtgtgactgcacacatagtcctggctgggctaggctccaccatggtcgacacaagcatggtgctcgagctacttcatctggtctcagaataaatctggttttgtcgtgccggaactgtgagctcacagagatgaacaaataccataacgatgttgctagctgatgtggtg

SEQ ID NO: 71329 - DNA, 366 bp, Zea mays
  Clone ID: LIB3078-024-Q1-K1-F4
gaaggatgcatcgcggcgctctgctgctgctggatctgcgagatgtgctgcgactaggcacgcagctagcggtcagctagctctccgtctccggcggctatacatacgaaatacgatgagagagctagcctgccacagcttctgcttctgcttctgcaagagagatctgcttaaattattctatcgtccagagctgcagcaacacctgatatgtttgtttggggtgttattagtagggagagctagctcagctttattattgttaataataattctgtgctgtacgtagctatagcaagcatacgtatgtatacacgtatatgtatgtgttttaccgtgacttgaatgtttggaaatggtgatttc

SEQ ID NO: 71330 - DNA, 442 bp, Zea mays
  unsure at all n locations
  Clone ID: LIB3078-024-Q1-K1-F5
gcaccacgccgctgcccaacgagcgcgacgccgagatccggagcaagatgaaggcggacggcacgttccagcagaagcgggagcaggcgacgcagcaggggatccacgagtcctactaccgcgacatgaccgtcatgttcggcaagtgggagttcgaccccatggcgctgccggagccgccgtgccccgtgcacctctggcagggcgacgaggacggcctcgtccctgtcgtgctgcagaggtacctcgccggcaagatcggatggatcaactaccatgaactccctggcaccggccacttcctgtcgtcggtgcctgggctcggagacaacgtccttaggacccttttcagtgacaagcagtaaacaaacaatcctncctcacgacgtatcgaagctttcgagcatggtggtggtggttgcgcattagttcattttaatat

SEQ ID NO: 71331 - DNA, 468 bp, Zea mays
  Clone ID: LIB3078-024-Q1-K1-F6
atagtccggtcactgtggagccagcaggagtggaagttgcagtttttcgtcagatagacgtggagtctattctccagcttcttgcgcagcgagggctctgcagcgtgctggtggacttcagagaggccggcgaaagcttcgcgtcgcttctgaacgacttccaggaggacaagctggtgcagaaggtcgtcgttgaggtcctgcccttttggctcgcgagcgacgggctcagcaacctggcatttggtggcagccaatcgttcccgttgaagaacttggagctcagggatgtgaatgggagtgtgctgctggaaggctatgtgtaatagcctctcttctgtcggagattggcattgtttgttttccctcgtgtaaacagatagccctgtaatatacttgcaagagccgccacgagccatgtgggggtttgcttttttatatatatagttgaaaatcaatgccatgcgt

SEQ ID NO: 71332 - DNA, 459 bp, Zea mays
  Clone ID: LIB3078-024-Q1-K1-F7
gacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggcccgccacggctgcagctgcggtggcaactgcaagtgcgacccctgcaactgctgatcacatcgatcgacgaccatggatatgattattatctatctagcttgtggtggtggttgaacaataataagcgaagccgagctggctgccatacataggtattgtgtggtgtgtgtgagagagagagaaacagagttcttcagtttgctatctctctctgcatgtttg

SEQ ID NO: 71333 - DNA, 303 bp, Zea mays
  Clone ID: LIB3078-024-Q1-K1-F8
gcccgcgacgcctgctgaaaggggaccgctactggggacaaccggatcgcggacagaagctagttgctgctgtaccggttggtgcgccaggagctcggctgcatgttcctcagcggctagaagctctaattcaactaggagtagtgcaacatggcgtttatctgcatcagccacggctggcttgatgaacccatgctggagtggctaatggagtgagacagctagccgatgcccagcagcatcagcttgtagacgctatgagtcagcatgcattctgacagcctggcatggactgacgacgag

SEQ ID NO: 71334 - DNA, 370 bp, Zea mays
  unsure at all n locations
  Clone ID: LIB3078-024-Q1-K1-F9
cagactcccaatttaaagaacgtgtgcttttttaggatttgaggatatgatatccaagtgctgcaagaaaattactccttacgtgctgagttttctaacccaagtgctaatggctaacaaattgctagcttatcagctattcagttacactgccatactagttagtagataaccagatggcccagtaaatgttgtattagttcatgcacgtaaatgaggtgtagctgtgaaagtagatcgatgaaggttcctgatgtgaaaaagtcaaaagacaatgtangagcttctgggtcacagtttcaaaagattntgtcccttggcagtgattgtaagatctttttggaaagtatgccnntttgttgntctggcc

SEQ ID NO: 71335 - DNA, 390 bp, Zea mays
  unsure at all n locations
  Clone ID: LIB3078-024-Q1-K1-G10
ggggttcgtggccccgcagctggaccccagcacgccgtccccgatcttcggcggcagcacgggcgggctgctccgcaaggcgcaggtggaggagttctacgtcatcacgtgggtgtcccccaaggagcaggtgttcgagatgcccaccggcggcgccgccatcatgcgggaggggcccaacctcctgaagctggcgcgcaaggagcagtgcctcgcgctcggcaccaggctgcgctccaagtacaagatcacctaccagttctaccgcgtcttccccaacggcgaggtgcagtaccttcaccccaaggacggcgtctacccggagaaggtcaaccccggcagggagggcgtcngccaagacttccgcagcatcggcaagaacgtcaaccc

SEQ ID NO: 71336 - DNA, 337 bp, Zea mays
  Clone ID: LIB3078-024-Q1-K1-G11
agcgggccggccacgccgccggagatcttcgacaaggtgtctgagagcatcaagcaggcggaggagacgtgcgcggacgaccagaagggcgacgccgagtgcgcggcggcgtgggacgaggtggaggagctcagcgccacggccagccacgcccgcgacagcctcaaggagaccaacgccaacgacccgctcgagaagtactgtaaggagaacccggactccgaggagtgccgcatctacgacaactagctatagtcgtagctatatagggcgtggaatgatactctcgatcggcgcgtcatacgtggaatgaacttgtatgaagctatacctcaat

SEQ ID NO: 71337 - DNA, 358 bp, Zea mays
  Clone ID: LIB3078-024-Q1-K1-G12
gtcttacgatgttgtggggactcaaattgtccagacaggtgttcctgcttccaaagcgggtctaattcgaggaatggagggttcaattgcaagccttgctgagctagtcatgcttgctatggctataattgcaaatgatgtgtcccatttcggcttcctggccatcctgtatgagtcatcacttgctggtgcagcatggatgttctgtcagtggttaacaaatccaacacatgatcaaagggaactatttatggttgatcccctatatcaagttcaggcaatatattggatgacgcatgaaacaaccaggaaaactgcatgcgcctacttgctggtggtgcttggctgatctgcaata

SEQ ID NO: 71338 - DNA, 431 bp, Zea mays
  Clone ID: LIB3078-024-Q1-K1-G2
gctcggcgctggtgatcagcctgagcacgggcgtgtcgctcttcctgggccgcttcgtggtcttcaacttccagcgggagaacgtggcgaagcaggtgcccgcgcagaacggcaagacgcacttcgacgccggcgacgagcgcgccaaggagttcgcggccctgctcaagtccaacgaccccgtgggcttcaacctcgtcgacgtcctcgcctggggctcgctcggccacatcgtcgcctactacatcctcgccacctccagcaacggatacgaccccaacttcttctgagcggtcgtcgaggatgtattctacagacagccgtgtgcgtgcgtgtgtgcttgtcatgtatccgatcaaagtttggttaatttggacaagtagtgcaactgcagaataattggtatttggatagtgcaccatgccaacatg

SEQ ID NO: 71339 - DNA, 317 bp, Zea mays
  Clone ID: LIB3078-024-Q1-K1-E6
tcccgacccaacccacccgtccgccagatccctccacccttcatgatttaatataacttgacatggtaaacgattgtgcatggtccattcctttgcaccctggacaacaaagctactcactaccaaacaactttcttccgcatatgccgagaacaacccacgaacaagattacaggtcatcctctatatattaacaaacgcctggaccactcaacattcaacccccatctttcagtcacaatcatcgagagcctttatgcggccatataatagcaaaccacctctatccaaaacaaccttgatgaaccctttctcca

SEQ ID NO: 71340 - DNA, 427 bp, Zea mays
  unsure at all n locations
  Clone ID: LIB3078-027-Q1-K1-G6
cctgttgcccgagcacctgctgctggccaacaaacaaatcagcaggccgcatcacccgctcagccagcagttgcattgccagtgcagccatcacctgcctctgcagggcctaatgcaaatcctttgaacctttttcctcagggtgttccaagtggtgggtccaacccaggtgttgttccaggtgcaggatctggtgctcttgatgccttgcgacagcttccacagtttcaagcactccttcagttagtccaggctaatcctcaaatcttgcagccaatgcttcaagagctaggtaaacaaaacccacaaattctgcggttgattcaggaaaatcaagctgagtttctccgcttggtgaatgaatcttctgagggtggtcctggagggaacatactangtcaactggcagctgctgtgccacaaacgc

SEQ ID NO: 71341 - DNA, 251 bp, Zea mays
  Clone ID: LIB3078-027-Q1-K1-G7
cccacgcgtccgcggacgcgtgggaacttactggacctagaggacaagctgcaccccggtgggcccttcgaccccctgggcctggccagcgaccccgaccaggccgccatcctcaaggtgaaggagatcaagaacggtcggctggccatgttcttcatgttcgccttcttcatccaggcctacgtcacctgctaaggccccgatgagaacctatttttgcacctcatcgaccctttcttcatcaacctgct

SEQ ID NO: 71342 - DNA, 350 bp, Zea mays
  Clone ID: LIB3078-027-Q1-K1-G8
cccacgcgtccgcggacgcgtggggagagatcgcatcttgcctgcccacccaagcttggctttcgttcctcctcgccccagcgacgcggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgt

SEQ ID NO: 71343 - DNA, 457 bp, Zea mays
  unsure at all n locations
  Clone ID: LIB3078-027-Q1-K1-G9
ggcgccttcccgtcgctggacgtggtgccgctgatggtgacgatggtggagcacgtggacatgtcgcgggactacgtcgtgaccaagtccatctggcatctcagcgacgcagccctcaagagcgtctataccttctacgccatgttcaccgtctggggagtctgcttcttcgcgtccatgaaggatcccttctacgacagcgagacgtacaggagccagggtggcgacgggaccgtgcactggtactacgacaggcaagaggacctggaggcgtctgcgagggaggagctgctgcgggaggagctgctcgaggagattgagcaganggttggggcctcagggagctggaggaagcgagcaaggaggagcagctcacnaagtgatcacgcgggcgaatgggctactcatcagctctctatctgagcttcgttagcaaataagtcagacttctctttac

SEQ ID NO: 71344 - DNA, 410 bp, Zea mays
  Clone ID: LIB3078-027-Q1-K1-H1
gccgtagccgtagccgtagcgataagagtgagctagctggtgcacaccggcatggcggccacggcgtactccgtggcgctcctcggcggcgcgcgcctccccgccgctccgcgctccgccctcctccctcggcgcagcgtctgccagcttcgcttccaagatgcaccgaggctctccctgctccgtgcgaaggccgcttccgaggacacatcggcctccggcgacgagttgatcgaggacctcaaagcgaagtgggacgccgttgaggacaagcccaccgtcctcttgtacggcggcggcgccgtcgtcgccctctggctgacgtccgtggtcgtgggcgccatcaacgccgtgccgctgctccccaagatcctggaactcgttgggctcggctacaccggctgggtcgt

SEQ ID NO: 71345 - DNA, 404 bp, Zea mays
  Clone ID: LIB3078-027-Q1-K1-H10
cggacgcgtgggttggaacaggaaattaagtttcttagtcaatttaagcatgaaaatattgtgcagtactatggcagtgaaactatcgaagatagattctacatatacctggagtatgttcatcctggttcaatccataagtatgttcatcaacactgtggatcgctgacagaagcagtcatccgtaacttcacacgtcatattctcaagggtcttgcttttttacatagccaaaagattatgcatagggatatcaaaggggcaaatttgttagttgatattaacggtgtagtgaaattggctgacttcggaatggcaaagcatttgagtactgcagctcctaatctttcattgaagggaacaccatactggatggctcctgaggttgttcgggctacactcga

SEQ ID NO: 71346 - DNA, 423 bp, Zea mays
  unsure at all n locations
  Clone ID: LIB3078-027-Q1-K1-H11
cccacgcgtccgcccacgcgtccgcccacgcgtccggttggtccgctacgcacgccggagttttgcatcgagcacggagatctacaacaaaaacatggagctacgacgcgattcccaaggtacaatcgtaattatgttcaaacaatttttaagtcgtcctgcgctccttctattacgagcaacgttttatattctgtgcttgcataataaatcgaagaaatcctgacaccaatcgaactgaagatcctgaaacgcacgttaataccgttgacgtccgcttcacccagctcgattttcagtcttgtaataataattgagaactccaatgaactgagagttactaatcgctccatgagtctgaagcgtgcanaaatttaggtcgcagctacacaaaattacaacgctgtctatattctattatct

SEQ ID NO: 71347 - DNA, 425 bp, Zea mays
  Clone ID: LIB3078-027-Q1-K1-H12
ttcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgacgacatggaagctctgtacaagaaggtccatgctgccatccgtgctgatccttctgtggtcaagtcaaccaagcagccaccaaaggagcacaagaggtacaaccccaagaaactgacatacgagcagaagaaggccagtctcattgaaaggctcaaccaactcaactcctcgggcggcgcagatgacgacgacgaggatgacgaagtaaagttcgtcccatcgaagtaatgctatcttatg

SEQ ID NO: 71348 - DNA, 405 bp, Zea mays
  unsure at all n locations
  Clone ID: LIB3078-027-Q1-K1-H2
tggttgtgttggtgctgcgcaggtgtacccgctgttcgcggcgatgggagttgccgttggcatctgcgggtttcagctcttccggaacatcaccggcaacccggaagtcagggtaaacaaggcagggagggcagccggcgtgcttgagaaccatgaggaggggaggcgttacgccatgcatggcctcagaagctttgtgcacgacaagacccccgagatcatgccagctatcaacaagttctttactgaccccaagtgaagcaaagcagctttggttggccgctgatgacgatggttctggtactagttgcccttggggattgtgtaccctntttatggcaattcgatatgggaatgagttcgacggtccctggttgttcttcgtactcacctgtcatgtggatt

SEQ ID NO: 71349 - DNA, 141 bp, Zea mays
  Clone ID: LIB3078-027-Q1-K1-H3
ctcgactgatcgctccgtgccgacttacccttcgatccgctggagctgagcaaggaccgggcggggctcaagtgataccgggaggcgcatctgatccatgggcggtgtgcgagtgccaacgggactgacatcatcctgggg

SEQ ID NO: 71350 - DNA, 55 bp, Zea mays
  Clone ID: LIB3078-027-Q1-K1-H4
tcccacgcgaacgtggaccggatgtggcacatctggtccactaagctgggcggga

SEQ ID NO: 71351 - DNA, 418 bp, Zea mays
  Clone ID: LIB3078-027-Q1-K1-H5
atcaagctccttgctccccgaccaaaccctacctgtacccgccgccgccgccgcagcagccatgccgcccaaattggacccctctcaggtggtggaggtcttcgtccgcgtgacgggaggcgaggtcggcgcggcgtcgtcgctggcccccaagatcggcccgctcggtctctccccgaagaagatcggtgaggacatcgccaaggagaccgccaaggactggaagggcctccgcgtcaccgtcaagctcaccgtgcagaaccggcaggccaaggtctccgtcgtcccctccgccgcggcgctcgtcatcaaggcgctcaaggaacccgagagggacaggaagaaggtcaagaacatcaagcacagcggcaacatcagcctcgacgacgtcatcgagatcgccaagaccatgcggaac

SEQ ID NO: 71352 - DNA, 387 bp, Zea mays
  Clone ID: LIB3078-027-Q1-K1-H6
cggacgcgtgggcggacgcgtggggaaggacgagtcctggcacccgctaccagagaggctgtacaaaagcctggactttatgactaggaaactgcggttcaccatgccgttccccttgctcgcgttcccgttatacttgtttgcgaggagtccagggaagtcaggatcacacttcaacccaggcagtgatctgttccaacctactgaaaagaatgacatcataacatcgacggcgtcctggctggccatggttggtgttctggccggtctcacctttctgatgggtcctgttccgatgctaaagctctacggagtcccatacttggtatttgttgcttggctggatatgggcacatacttgcaccatcatggccacgaagacaagct

SEQ ID NO: 71353 - DNA, 249 bp, Zea mays
  Clone ID: LIB3078-027-Q1-K1-H7
ctgacgcatatgcggacgcgttttgaatttcgagtcctggcacccgctaccagggagggggtacaaaagcctgtactttatgactaggaaactgcggttcaccatgccagtccccttgctcgcgttcccgttatacttgtttgctatgagtccattgaatgtaagatcacacttcaacccaggcagtgatctgttccaacctactgaaaatattgacatcatgacatttactttaatctggctggccat

SEQ ID NO: 71354 - DNA, 210 bp, Zea mays
  Clone ID: LIB3078-027-Q1-K1-H8
gtgctacaggataggatcatctcttgactgccatggaaccccctcagctgccggccggggagcgctcctgggctcacgaggtcaagcaggcctctgctgagaaactccggctctcctacggcgccgtctccgacacaccggtggccggtgaaccgagccgtggcgcctactgccacagctcgtccgcctaggaccctataaggagagtca

SEQ ID NO: 71355 - DNA, 377 bp, Zea mays
  unsure at all n locations
  Clone ID: LIB3078-027-Q1-K1-H9
cccacgcgtccgcccacgcgtccgcccacgcgtccgcccacgcgtccgccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggatcttctgggtgggcccactgatcggcgccgncatcgccgncgnctaccaccagtacgtgctgagagccagcgccaccaagctcgggtcctaccggagcaacgcctaataagtcccggcggcgggagcttgtggcgccaccgatcga

SEQ ID NO: 71356 - DNA, 358 bp, Zea mays
  Clone ID: LIB3078-028-Q1-K1-A1
gaccaacaagatcatggacttcatcaagtttgacgtcggcaacgtggtcatggtgaccggcgggaggaacaccgggcgtgtaggtgtgatcaagaacagggagaagcacaagggcggcttcgataccatccacgtcgaggactccatgggccaccagttcgccacccgcatgggcaacgtgttcaccatcggcaagggcaacaagccgtgggtgagcctgcccaagggcaagggtatcaagctcagcatcatcgaggagcagaggaggcgcgactttgctgcccaggctgctgccaaggcataagttctctgaatgtgctgcttggagctttttgctatgtctaagttaaattttatc

SEQ ID NO: 71357 - DNA, 419 bp, Zea mays
  Clone ID: LIB3078-027-Q1-K1-G5
gcccaacttgatcttgctagtggaagattgtggtcgcagttgttgcatttcaaacaagaaggttttcttcttggtgctggaagtccttctggatctgatgctcacatctcatcaagtggcattgttcagggacatgcgtactcaattttgcaggtaagagaagttgatggccacaaactcatccaaatcagaaatccatgggcaaatgaagttgaatggaatggaccatggtcagactcgtcaccagagtggacggaacggatgaagcataagctcatgcatgttccacagtcgaagaatggggtattctggatgtcttggcaagattttcagattcactttcggtcaatatatgtttgtcgtgtttatccacctgaaatgcgttactctgtccatgggcaatggcgtggctacaatgc

SEQ ID NO: 71358 - DNA, 254 bp, Zea mays
  Clone ID: LIB3078-028-Q1-K1-A11
ctccgttcatggattgcaatcctggctaacatcacgatggatgtcgtgtgtgctttaatcaccatctctaaaattgatgccatcggtcacacgattctaagatctatgtcggagttggattccttgcatatacatacacagattacgaagcaaccggtttataacaaacatatgtcttctgttctgcctgttgcccaattctcttttagtgtagcctacttacaataattaaaagaacagctggtgtctggttg

SEQ ID NO: 71359 - DNA, 270 bp, Zea mays
  Clone ID: LIB3078-027-Q1-K1-F10
cggacgcgtggggtgatgagtctcgaggagcacttcgatattagcgtggaggagtccagcgcacaaacaatcgccacagttgaagacgccgcggacctcatcgacaagcttgttgctggcaaagcgtagttctgtacctcctctatcgttgtcctaccactctaggtctatcccttgatctaggtttctatggtcttaagatttgtgattttctccgcactgttgttgctatccccgtgtcgtaataatacgagatgttttaagcggttg

SEQ ID NO: 71360 - DNA, 451 bp, Zea mays
  Clone ID: LIB3078-027-Q1-K1-F11
ctcttcgacaaggctgcgaactccttcaagctcgccaagaactggagcagagctgcatcagtgtacatcaagattgctaactgtcatttgaagggagatagcaagcatgaggctgcctcagcgtacgtcgaggcagcaaattgctacaaaaagttttcacctcaggaagctgcgcaagcgctaaaccagtctgataatcttttcttggaaattggtaggttgaacatggctgcaagatacagcaaggatattggtgagatatatcagcaagaacaagatttagagaacgctacagattacctggaaagggcagctgacctttttgacagtgagggacagtcgtctcaatcaaacaccatcaaacagaaagttgcagaaattgctgctcagttggaacagtacccaaaagcaactgagatatttgaagcgatcgctcgtcaggcaatcaaca

SEQ ID NO: 71361 - DNA, 274 bp, Zea mays
  Clone ID: LIB3078-027-Q1-K1-F12
actcactctctctcaccatccgcgccagttcaaccaagtcagcacccgcgcgcggcaaggagttcacgcccatggcgagcaccaacatggcgtccgccacctcgcgggtcatgctggccgcgggcgtgcccactgtcagtagcggcagcggccgtgtcagcttcgcctcggcgcccaaccggcttggcaagaggcttgtggtccgggccgatgaagagtacccggcagagccggcgcccacggctgaaggggagggcgccgtggtcaccaagcc

SEQ ID NO: 71362 - DNA, 256 bp, Zea mays
  Clone ID: LIB3078-027-Q1-K1-F2
aattgatgttctatgttggttgtctctgtttcaaggtggattggattggccaaaagaagcaaattgatgctgctaagagcatcggtgcatagcacatagttttggtgggatccatgggaggaacagacatcaagcacccgctaaacaagttatgaaatgcaaatatactgctgtggaagcacaaggcagaacatgacctagcagactccggtctttcatatacaatgataatagccggcagtttacaagataaaga

SEQ ID NO: 71363 - DNA, 403 bp, Zea mays
  Clone ID: LIB3078-027-Q1-K1-F3
cccacgcgtccgcccacgcgtccgcccacgcgtccgctcgccgaggaggagcgcctcgtcatcatgcgcttcggccatgactgggacgagacctgcatgcagatggatgaagtgctagcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaagagttcatcgacattgtggagaccgtatacaggggcgcccggaaaggccgtggtctggtgattgctccaaaggactactccaccaagtacc

SEQ ID NO: 71364 - DNA, 460 bp, Zea mays
  Clone ID: LIB3078-027-Q1-K1-F4
agctcgacgacgaggttagcgacgacgactcaccagcctgctcctcttccgccactcgacgtctgaaacgtcgccgcgcagttcttgctccggcggcgaaaggggagggcaaggcacaggccgcactggagaacctggaaacagccatggcgaacagcgcacagttcgtcgcgcttctgtgcgggtgtgagcgcctgtcccgtcggacctacgacgcgtacctctacctcgggagtatcatgtttggccgacacgccgagaagcaaaggctcctcaacttcttgctgcagcagcagccaggcgacgactgcgcaccgactaccgtcctaccaatcgtcggcgctcttgcggccgggaagaaaactctggtcggccacgtgtgcgccgacgacagggtgcgctcgaaattcgcttcggggctcatctgagacgagacgacttactcctgaacaccgggcac

SEQ ID NO: 71365 - DNA, 432 bp, Zea mays
  Clone ID: LIB3078-027-Q1-K1-F5
cccagaacgaggccatggacgaggcttgttggtccgacgtcgaattctgcagaaccactcaggtcaggtgacagaaaaaaaaagcttggcacggcaccctgttgagcctgttcctctcatccccgccctcacctttctgtctcctcccgtcgctcctctgccagaactggtactgtctctccaagacactcgcggagctggaagcgcttgattacgcaaagaggagtggactagacgtggtgtccgtctgcccgtcgctggtgatcgggcccttgctgcagtcgacggtgaacgcaagcagctccgtcatagtcgattgcttgaaaggagatcgtgaggtgaagctgaagctgaggaacttcgtggacgtccgcgacgtcgccgacgctctgctcctggtgtacgagactccggaggcgtctggacggtaca

SEQ ID NO: 71366 - DNA, 431 bp, Zea mays
  unsure at all n locations
  Clone ID: LIB3078-027-Q1-K1-F6
tttagccattgagctatccaaaagagaagatgagttgctacggcaaaaaacagaggtcacaaaaattgcagacacgcttaaactggcttttacagaatccaagagaattattgacgaaaaaagagccaatgctcggctggagatagaaagtgctaaagcttctgtacaaaaaattcaatcagcacttaaagagcangaaattttttctcaaagaactgggaagcangacgtcgatgaactgaaggaagaagttcaagaagcacgaagagtgaaaatgctgcattgcccaagcaaggcaatggacattgagaacgagatccaagttctgcgtgatcaactggctgaaaaatcttcagattctcttcgccttttgaaagagttggagctgcatcgaatttaccgggaaaatgacatgcccttggatgaattaa

SEQ ID NO: 71367 - DNA, 414 bp, Zea mays
  Clone ID: LIB3078-027-Q1-K1-F7
ggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggctgtggaggcggcggcggtgggtacggtggtggccgtggaggcggcggctacggcagtggcgggcgccgtgatggcggcggcggctacggcggt

SEQ ID NO: 71368 - DNA, 450 bp, Zea mays
  Clone ID: LIB3078-027-Q1-K1-F9
ggatcatgtctgaatcacttctcaacctttgacgagcaagattgtgtggagtagcaccggaatgatccaagccttttttattttttttcatgatggagatgatgagttctttcccatacaattggagtccagccctatgtgggtcagcgaaactaactttagtcaacaatcagctcaagtacataaaaatgcaccaaatcgtcatgagcccagaatgaacagtacttgaacctggagcattaggattacaacagccaccatgataaacatgctggggagggtggcgctgactgaaggaccggtgaatgggctgcaaactagttgcggaagaccagctaacaaactcctatatggatattcttaggagtattatataatggagatgggctatcgttcctagtgtgacccgactgtagtcgtctgctgattattttgactatctgacaacac

SEQ ID NO: 71369 - DNA, 370 bp, Zea mays
  Clone ID: LIB3078-027-Q1-K1-G1
gtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacgagatcgacgccatgcttcaccagaccggaggcatgcgtcctagcaccacctaaaagcagcagctgcggagcctcgttttgctctccgccctgcgtagtactaaacaaaagggaaaaagtctttttaaggaacttgtgatgctctggctccttgtgccattgctgagggacattcttagcctttatt

SEQ ID NO: 71370 - DNA, 433 bp, Zea mays
  Clone ID: LIB3078-027-Q1-K1-G10
aaacggtataatcttttatgcaggtagcatcttcaaagctgcagggctcaagaacagtaacctggacacatgtatacttggagtgattgcggttcttgccactgctgttacgaccaagatcttggacagggctggacggagaatcctccttatcatttcttcttttgggatgaccctaagccttcttgtggttgctgttgtattttacatcaaggacaatatttcacatgactctgacttgggtaacaccttaagtatggtgtccttggttggtgtcttggcttatgtcactgcctactcctttggtatgggtgccattccatggatcataatggctgagatccttccagttagcatcaagagtgtggcaggaagctttgcgaccctagccaactggttgacatcctttggaataacaatgacagcaaatttg

SEQ ID NO: 71371 - DNA, 388 bp, Zea mays
  unsure at all n locations
  Clone ID: LIB3078-027-Q1-K1-G11
cccacgcgtccgggaggaggaggaggaggaggagctcgtagcggaatcagatcagatggtgcgtcgccagagcagagaaggccggggcctgggctggcctgcgtgctgcctcggcttcctgctcaagctgctcgcgttcctccaggccttcgccgccgtctccgccctcatctacgccgcttggatcctctcccgctgggcgcgccaccaccagctccacctccgcgaccttctaagcccggacctatggttcccgtcgctcgtcatggcggcgggggatcttctactgcctnctgctnctcgcgggtacttggcagctgagatcaacaccggatgctgnctctgcttctacaccatcccagccatggctatgatgctgctggaagct

SEQ ID NO: 71372 - DNA, 311 bp, Zea mays
  Clone ID: LIB3078-027-Q1-K1-G12
gccgatcctaaacttcaaaggcttcatgtatggaaatgcggtaattgacgatgaccaggactttatcggcacattcgagtgcttgtggacgcactggcttatctgctacgtaacctacctgatgctgctgcttgcctgcctagacgactgtatcgacgactccgtcctaatgtacaccgattggatcctctaccgctgggcgcgccaccagcagctccacctccgcgaccttctaagcccggacctatggttcccgtcgctcgtcatggcggcggggatcttctactgccttctgctcctcgcgggttact

SEQ ID NO: 71373 - DNA, 312 bp, Zea mays
  Clone ID: LIB3078-027-Q1-K1-G2
cggacgcgtgggcagcgtacgactccattccgacgtggtacctcgaccctgcctgagatgtggtgaaagatggattcaacggggtagttctgaattcgtttgatctcaagctatttcgttcgcctgattgttatatttcgttcgatctcaaactattctgactgtgctcgatctgaattcccaagtacaggagcttcaaacgattcactcccaccttatttgttttgagtcctcgtagacctgtgcataaattgtgtgtccccatttcgacggtagtcaccattctttacaccttgtcgtctgcttaagccg

SEQ ID NO: 71374 - DNA, 323 bp, Zea mays
  Clone ID: LIB3078-027-Q1-K1-G4
attcgttgctcgcgatcctcgcttcgggatccggaagagatggccaagtcgaagaaccgcacggggcacaaccagtcgtacaaggcgcacaagaacggcatcaagaagcccaagcgccaccggcagaccttcaccaaggggatggaccccaagttcctgaggaacctgaggtattcaaggaagggcaacaagaagagtggtgaggctgaggagtatgaaggaaagcatgggtgtgtttcctatgttttagctcagttgtatggtgggacttatgaccttttgctgccgtaatgtttttatgataatcatgttttgaagagttt

SEQ ID NO: 71375 - DNA, 402 bp, Zea mays
  Clone ID: LIB3078-027-Q1-K1-F1
agcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaagttactgccctgaggttcacggagacagcaagggccaggattgtcaatgctggtggcgagtgcctcaca

SEQ ID NO: 71376 - DNA, 381 bp, Zea mays
  Clone ID: LIB3078-027-Q1-K1-C8
gctgccccaatctccggtggcgaccatttggaaggaataaaagaaaagaatacaaaagaaaaagaatcgcttttggaggaggatgttgctttgaagaggttcaaatcatacaagaacagtgtgaaacaggtctccaagattgggaatgttctcactttagctgttgtattcggttgtagctacgagcttggtttgttggcggcaagcatgaagtgaaggaaaacacagccattattccgggaagtgatccatcagcgtagactgtcattctatcacctcgtgtttttagcctgtctgtctctctcttattttgtcgtgcaccatgtataaaataaaactaaactaggttaaccttgatttgcgaataacgttttctgtttc

SEQ ID NO: 71377 - DNA, 395 bp, Zea mays
  unsure at all n locations
  Clone ID: LIB3078-027-Q1-K1-C9
cccacgcgtccgcccacgcgtccgcccacgcgtccggggaaggggagccgctggggttcgaggtgtcgacggagcccatgccgcggctgccagacccggagacgcccgacttctgggagggacctcagtgggaggccctcggcttcttcgtgcagtacatgtgggcgttcggcgtcgtcttcggcctcattgcttgcggtgtcgctgtggccacttacaacgatggtgcaacagatttcaaagacacgcctgcttacaaggagtcccaatcacaggagttccctgaagagtcagaatcatcaagcgctgatgtgtntgaaggcaatccgactgaggtagcaccagctctcgagtaggactatcaagggaggcacgggagaaaaagtgtctctcga

SEQ ID NO: 71378 - DNA, 421 bp, Zea mays
  Clone ID: LIB3078-027-Q1-K1-D1
cccacgcgtccgcccacgcgtccgctcacgttcgtccaccagagacaacaatggccatggagacgtgcttcagagcgtgggcgctgcacgcccccgctggcagcaaggacaggctcctcgtcggcaacctgcaggtgctgccgtcgaagcgggcgctcgcgccgctgtccgtcggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgccggtgatcgacgagctggccaaggactacgccgggcagatcacgtgctgcaaggtgaacacggacgacaaccccaacgt

SEQ ID NO: 71379 - DNA, 347 bp, Zea mays
  unsure at all n locations
  Clone ID: LIB3078-027-Q1-K1-D11
gtcaaaatcacttggtaacgttgttgatcctcttgaggtgataaatggcatgtcgctggatggtcttctgaaacgtttggaagaaggcaatctggatccaaatgaattaaacattgcaagagatgggaagaagaaagattttcctgatggcatatcagaatgtggtaccgatgctctacgctttgcactgatatcgtacacnttccagtctgacaggataaatcttgatattaagagggtggttggatacagacagtggtgcaacaaattatggaatgccatccgctttgcgatgggcaaactgggtgaccattacattccgccggcaactgttgatgtgtctctta

SEQ ID NO: 71380 - DNA, 442 bp, Zea mays
  Clone ID: LIB3078-027-Q1-K1-D2
cccacgcgtccgcccacgcgtccgcccacgcgtccgcgctctcgccctcccgctcgctgcgagtgcactcagcttgcttcttgcgtgctcagctcgctctgcccctcatttctgttgcgtgctagagctcctccagtggtcccttgctcactgacgtcgaggatcgccgcagtcgtccctgcgtcgtctgatcccgtcaccacgcagtagttgcagattgtcacgtcatcaccgacacagttcagctcaccaaaatccaacgccgtcgcgccgtcgctccagggaccccttggcgaagcccgccagccacttcgtcgaagcaattccttgcacagttcgccgtcgtgaagctcgttgccggaccgtctgcatccgtacgccgttcgccatccgtggagcctcgccggagttcgcgtctcgccttaccgcgatcgaatccctc

SEQ ID NO: 71381 - DNA, 435 bp, Zea mays
  Clone ID: LIB3078-027-Q1-K1-D3
cccacgcgtccgcccacgcgtccgcccacgcgttcgcccacgcgtccggaagaaaggagcagcagtgggcaccatgaaagtgaagacgggagaagaaaggtataagggtgcatcagagcaatcggaggcccaaatatttgtgcagatggtagcggcatttggattgaaagataagttcgatgaagagttcttgagaaagctgtttgttgctaatggacggaagaaggagcttgctaggattgcatgcgtgcttggatttgaggaaaagccttggagatattgttgaggaactaataaagtcagggaatgctatagaggctatatatgttgcccatgaagctgatttgcttgggaaattccacctgtgcctctcttaaatcttatctgcagaattccactgataaggctcaagcagtgttgaaaagtggaagacat

SEQ ID NO: 71382 - DNA, 421 bp, Zea mays
  unsure at all n locations
  Clone ID: LIB3078-027-Q1-K1-D4
cgcccgatcgggatggcaagtgccgccagcgacaggtgtcatgcagcgcggccggngatgctgtggcggccccgaaggcggaagaaggaggcgggctcatgaagacgctgtggctcggctcgctcttcggcctctggtacctgttcaacatctacttcaacatctataacaagcaggtactcaaggttttcccataccctataaacatcacagaagttcaatttgctgtcggaactgtagcagctctgttcatgtggatcactggtattattaagaggccaaagatttctggagcacagcttgtagccatcctacctctggctattgttcatactatgggcaatcttttcaccaacatgagccttgggaaaattgcagtgtcatttacgcacaccatcaaagctatggagcctttcttttc

SEQ ID NO: 71383 - DNA, 251 bp, Zea mays
  Clone ID: LIB3078-027-Q1-K1-D5
cgcaggcctacggtagcatcgttcacgtgttcctcatgctggacaagctcctgatgcagcgcatcaatgaccagatcacagattattgcacggccattgaaagcgattagagctgacttagtgtgacagcttactttgaactgtataacttgacacgagctgacaaatagaaatccagcgatggctaacgactaggacggtgacgtgagtgtacgagatacagagcatgcactatcgatagcatctgccga

SEQ ID NO: 71384 - DNA, 439 bp, Zea mays
  Clone ID: LIB3078-027-Q1-K1-D6
gaataatcctgtaggtttgatgcttctttctgaggttgctttaggagacatgtatgaactaaagaaagccacgtccatggacaaacctccaagagggaagcattcgaccaagggattaggcaaaaccgtgccactggagtcagagtttgtgaagtggagggatgatgtcgtagttccctgcggcaagccggtgccatcatcaattaggagctctgaactcatgtacaatgagtacatcgtctacaacacatcccaggtgaagatgcagttcttgctgaaagtgcgtttccatcacaagaagtagctgggagactaggcaagtagagttggaaggtagagaagcagagttaggcgatgcctcttttggtattattagtaagcctggcatgtatttatgggtgctcgcgcttgatccattttggtaaagtgtgcttgggca

SEQ ID NO: 71385 - DNA, 405 bp, Zea mays
  Clone ID: LIB3078-027-Q1-K1-D8
gtcacaagcaaaccgaagctagtcagtcacacacagctctccagcttccatccacaaagaagaaggaaacaagctaaccatgatgatgagcgccaagaagattgctcatctcgccaagaaatggcagaggatggccgcgcaagggaggaagcgcctcaccttgggggcggcggcggcaaaggaagtcgacgagtgctgcggctctgtggcgagcaagggccattgtgcggtgtacacggccgacggggcacggttcgaggtgccgctggcctgccttagcacccctgtcttcagggagctcctgcagatgtcacaggaagagttcggcttcgctggcggcgatggcactggcaggatcacgctggcctgcgacgcggcggtcatggagtacgccatgtgtttgct

SEQ ID NO: 71386 - DNA, 368 bp, Zea mays
  unsure at all n locations
  Clone ID: LIB3078-027-Q1-K1-D9
gctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggggttctgctccgtgaccagcacggcatcccgcttgtcaagagcgtgactggtagcaagatcctccgcattctcaaggcccatgggttggcgccggagatcccggaggatctctacttnctcat

SEQ ID NO: 71387 - DNA, 71 bp, Zea mays
  Clone ID: LIB3078-027-Q1-K1-E12
cccacgcgtccgtctgcttgctctggggggaaggagagagagagagagcgagagaaagatctagtagagag

SEQ ID NO: 71388 - DNA, 420 bp, Zea mays
  Clone ID: LIB3078-027-Q1-K1-E3
gtcatcaacctggtcagttcgaatgtcgtgaattcagagaatcaatccttggcatcatgcctcatcattgggataggagagaggatactaccctacaacttgcacattttaggaagcataaaaggaaacaagttaagagaacgcctggaaaggctgttattaatagcgtgaacaagcccattgaacacaatccacctgggaaggatgcttccaatagaatagctagagctcttgggaaggctgcagatatggctaactcaaataaagccaggaaggcacagaggatgcagtatgttccgacaatcactaatcatactcaagtttggtgggttcctaatgttgttgttgtacatgaaaaggaagggatagaggttgtccatctagcttctggacgtacaatatgcaagcttcatttaaatg

SEQ ID NO: 71389 - DNA, 391 bp, Zea mays
  Clone ID: LIB3078-027-Q1-K1-E4
ccgctccgcaaggagcctgaattttatgttcttaaagaagatgagtcgccctgtatttttggtccaatcgtgaaacaaagatggtcctatgcatgcgcaaaacaacttattgagaggcttgtatttgctgaaggtgcagaaaatggccttgatttcacaatcgtgagacctttcaattggattggaccaaggatggacttcattcctggtgttgatggtcctagtgaaggtgtgcctcgggttttggcttgcttcagtaacaatctgctccggagagagcccttgaagcttgttgatgggggtcagtctcagagaacctttgtctacatcaaggatgccatcgaagctgtagtgctgatgattgaaaatcctgctcgagccaatggccaca

SEQ ID NO: 71390 - DNA, 118 bp, Zea mays
  unsure at all n locations
  Clone ID: LIB3078-027-Q1-K1-E5
ggaanttcccgggctcgactccacgccgtctcgggccgcctcgtctccctcactcgagaggcgtagtatgtcgcanngctgcagctcggtaaaggtcagatgtgtgactgtactcgtc

SEQ ID NO: 71391 - DNA, 367 bp, Zea mays
  Clone ID: LIB3078-027-Q1-K1-E7
cggacgcgtgcgcggaatggctccatgttcaatcgcaaatggaaaggcagaaatgaaagccagataagccatggaccagcaaccccgcaggctgtatatcgcaagctgctgttcatgtttacagaaccggggtccagtgtcatgccaacagataaaaaagagcttctgaccaactacatataggacctaacactttttgccgatgacttcagatccaaccccaacgacatatgtgaggaccttaaaatgacccgccaaaatcttaaaccatactatgaccagttgggatgcagatctgtgtcagatggtgcttttaagtctactttcatgacgctcccaggccctctcaaggtcccaaaggaagtta

SEQ ID NO: 71392 - DNA, 470 bp, Zea mays
  Clone ID: LIB3078-027-Q1-K1-E9
ctcatgggtgccgtcgagggctaccgcattgccggcgggccgctcggcgaggtcgtcggcccgctgtaccctggcggcagcttcgaccccctcggcctggccgacgaccccgaggccttcgccgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccggcaactaagctcaacggctatgctatgcaacttcattgtctttcggatcggagagggtgtacgtacgtggattgattgatgctgcgagatgcatgtgtgtcttttgtttcacgttgcattgcataggcaagtcgagatgatgagttggcgttgtacacttagatgaaccatgtttggg

SEQ ID NO: 71393 - DNA, 370 bp, Zea mays
  Clone ID: LIB3078-027-Q1-K1-C7
gttatgatcggctccatactgttccaaagggacgagggtttctagctccagtagccatggactcgctctgtcaagttgcttcttgaccgggacagtcatgcggtcatgccacaggaaggtggtattaatgtataataactcagtcgaatcaattacaataactggagtttgttagggagtatagccccaggcatgcattcgtcaaaaggcgaagttatgttctacccctggcggttctgatacttgtgtttgctttgacactgcacttgaatttgttcatctgtaagtcagagatgagttatactatacaatcggccactgtcatatctggaattgcgacacggtgcagcagatgttaatactttggctt

SEQ ID NO: 71394 - DNA, 254 bp, Zea mays
  Clone ID: LIB3078-027-Q1-K1-B12
gagaaccaatcttaccagagatgatgttttcgtctctgaagatgtaaaatgtcacggtttccacaagtgtccaaatgcggtactgaagatgcagcagcaactccccactactcatatgagaatggcatccgttctgtttgccgcgcattttaagctgtatatgcttattatgcatttgggcttgtacctcagtcgatatgaacgatgtatcctttgaactaacgcattataatttttgaaaccgttttagccag

SEQ ID NO: 71395 - DNA, 394 bp, Zea mays
  Clone ID: LIB3078-027-Q1-K1-B2
cccacgcgtccgttcaacggatcacactgccgctcccccacgctaaatttgggggctacagtgcacacgctagccgatcaacggctcacgctaccaggcgctctacgcggatgtgccccctagccagcttctctctccccctcgttctgtggtgcctctctcaccctctctaatattgttcacgtgggcccacttccaattattagtagatgaaaaattgataggaggtgaaaagtatgtatagaaaatgatattttatggttgtagtggggtataggggaaggatttatggggaaacgctgtacagagtggagatatatggggggaagagaacgctgacgtggcacgtgagtgggatatagggagaggaaattatgggtaacccgctgagaca

SEQ ID NO: 71396 - DNA, 458 bp, Zea mays
  Clone ID: LIB3078-027-Q1-K1-B4
tactctgcagtccaagggacgtgccaaaacgtccagccagccgtcaccatcagcggcttccaggacctgcccagcggcgacgagaacgcgctcgccaacgcagtcgccaaccagccggtgtctgttggcgtcgacggcggatcgagtcctttccagttttaccagggtggcatatacgacggggatggctgtggcacggacatgaaccatgcagtgacggcgatcggctacggcgccgatgaccagggaacccagtactggatcctcaagaactcctggggcacaggatggggtgagaacggtttcatgcagctacagatgggcgtcggcgcctgtggtatctccacgatggccttctacccaacttcatgaacacaaatcttcagataaagcgtagtatataccagtccatgcatatgactgcagaataaagcatggagagataattacatgcgtgc

SEQ ID NO: 71397 - DNA, 356 bp, Zea mays
  Clone ID: LIB3078-027-Q1-K1-B5
cccacgcgtccggccacgcgttcgaaaatcacgattccttcatcttcatcaaattcgaggacaacggcaaggcgacttgggacagccagagccagcacatggcggcagctcccgcgaggtcgtcatcgactacgaccatggtagcagtggagcacgtcatgcgtgtcaacgtcacccggtggcgcaaacatgtggtcggccggatgctgcaactgacgctctcgtcgaggtattccgtcactgcatgtagcctgtactgcaagatggcggcggcagcaacggctgaacggtccatggccagacggtgaggctggatctggagcctgactacgacgcacgctcactgagacccagcg

SEQ ID NO: 71398 - DNA, 466 bp, Zea mays
  Clone ID: LIB3078-027-Q1-K1-B6
cttcaattcaacagcagcttgcatctttgaaacttaaagatgcgccggtcattggtgctgttaatcctgtgaagggagagatagtcctcgcacaatttagcgttgacaactcctggaacagagctatgattgttaatggacctcgttctgttgaatctccggacgacaagtttgaagtattctatattgactatggcaaccaagaggtggttacctacagtcgtttacgacctgtagacccatctgtttcctcgtctactgctcttgctcagctatgcagccttgctttcataaaagtgcccagtcttgaggatgactttggtcaggaagcagcagagtatctaagtgaatgtttgctcagtagctcaaagcaatacccggcaatgatcgaagaacatgatactttctgggggaaatcaaaaggacaaggaaccggaaatgttctcattggtactcttggtgatgc

SEQ ID NO: 71399 - DNA, 421 bp, Zea mays
  Clone ID: LIB3078-027-Q1-K1-B7
cccacgcgtccgagcaaactcgtgttgcctccaatgaaccagctgagcaggtggagcaagttgagcaggttgaacgggttgagcaggttgaacaagttgatcaggttgaaactctttctgactcaggaagtagccaggggcatgttgttgccaagggttcactgtttcacagtcctggcgtagaagcctctggcccctcacagtatagcagcagcttgtcatctgggcttggcaggaggaggaataccaagggtgaaggccttgagccagtagtgtcgaggagagactcgacagctcaatccacatcatcttatggtagtttcaccacataccagaagatccctgccaagaaaggaaacaaggaagacgaaacgatgaccccagttcggcgctccagcatgctgaggaatgtgaaaacttc

SEQ ID NO: 71400 - DNA, 363 bp, Zea mays
  Clone ID: LIB3078-027-Q1-K1-B8
cccacgcgtccggctgcacgcccccgctggcagcaaggacaggctcctcgtcggcaacctgcaggtgctgccgtcgaagcgggcgctcgcgccgctgtccgtcggccgcgtcgccacgcgccggccgcggcacgtctgccagtccaagaacgcagtggacgaagttgtggtggcggacgagaagaactgggacgggttggtgatggcgtgcgagacgccggtgctggtggagttctgggcgccgtggtgcgggccgtgccggatgatcgcgccggtgatcgacgagctggccaaagactacgccggcaagatcacgtgctgcaaggtgaacacggacgacagccccaacgtggcgttcaccta

SEQ ID NO: 71401 - DNA, 378 bp, Zea mays
  unsure at all n locations
  Clone ID: LIB3078-027-Q1-K1-B9
cgtcggtcctcgcctcctctgctctgttgagctgctctctccctctatcctctctctcgattccacttcttgaccgacacggcaatggcgaagggtgggctgagcaagcttaagtgcatgataaagaggtggcactcctcgagccggatctcgcgcacgccgtcagggtgctcggcgcgctctcacgacgtcggcgacgctggcgccggcttcgctctggagaactcgtggaggaagggcgtcgctgcctcgtccgtctttgccttctgcggcggaggcacggngtcggcatcgttccacggcaccgacggcctgccccgggcctccacaccgtctacgtctgcaagtcgcgccgccgctacctcatcgccgcggacc

SEQ ID NO: 71402 - DNA, 409 bp, Zea mays
  Clone ID: LIB3078-027-Q1-K1-C1
gcgggggcggcgagcggctgctcagggcgtcgcagtgctacctgtcgaccacggccggcccgatcgccggcatgctgttcgtgtccaccgagagggtcgcgttccggagcgaccgctcgctggcgctgccgctgacgtctccggccggcggcggcagcggcagcggcacgacgacggtgctgcgggtgccgtacaaggtgtccatcccgctgcgcagggtcgcggcggccaggccgggccagaacagggaccggccggagcacaagtacgtgcaggtcgtcacgcgcgacggcttcgacttctggttcatgggcttcgtcaggtaccaggcgtccctgcaggagctggagaaggccgtcgcgcagtcgcagtcgcaatgacctcaggcgatccgccggccggcccggcg

SEQ ID NO: 71403 - DNA, 302 bp, Zea mays
  Clone ID: LIB3078-027-Q1-K1-C10
ggcacgcgtgcggtcaccggatccatgttcgcattcacctgcccggccgtacgcggagccctacgatgagcaagatgatgctcgatttgtcacacagcctgtcagcatgcatgttgttgttaaccccgtctaaagggcctgataatgtgcatgtgaccatttttatgatgaataacgtcataattaatgctaggtcaacgactatgatcacgttgatgatcatatcatcgtatcgatgatggatccaatccaatgtgcagtcaaatgcagagtcgttgcaagataaaaagggcggacgatct

SEQ ID NO: 71404 - DNA, 297 bp, Zea mays
  Clone ID: LIB3078-027-Q1-K1-C11
cccacgcgtccggcggaatataataatgtaaggagccagcttagtgcaatcaacagaaagcaaagtgggagcttagcggttcgtgatctttccaatctggtaaaaccggaggatatgatcacctcggaacatcttgtgacacttcttgcaatcgttcccaagtactcccaaaaagactggctgtcaagctatgagacacttgatacatttgtggtacctaggtcatctaaaaagctctatgaagacaacgaatatgctctctacactgtgacactatttgctaaggttgttgacaac

SEQ ID NO: 71405 - DNA, 364 bp, Zea mays
  unsure at all n locations
  Clone ID: LIB3078-027-Q1-K1-C12
cctaggggcactcgcatggaaaggcctcctagacaatttgcgcctgctttcagagcttatgttggcaacttgccatggcaagctgatgactctaggctggtgcaattgttcagcgagtacggagaagtcgttaatgctgcggttgtctatgatagagaaaccgggcgctcacgaggattcggttttgtaacgatggtgtcgaaagaggaactcgacgacgctatctctgccctggatggacaggaattggacggcncgcctcttcgggtgaacgttgcagcagagcgaccacaagagggcttttgatgcngcggtacgagagagatggcttgcttgttgtgatgagagcacngagacacaacgc

SEQ ID NO: 71406 - DNA, 402 bp, Zea mays
  unsure at all n locations
  Clone ID: LIB3078-027-Q1-K1-C3
cccacgcgtccgcccacgcgtccgcgttgaggacaagcccaccgtcctcctgtacggcggcngcgccgtcgtcgcgctatggttgacgtccgttgtcgtcggggccatcaacgccgtgccgctgctccccaagatcctggagctcgttggcctcggctacaccggctggttcgtctaccgctacctnctcttcaagcaaagcaagaaagagctggtcgacgacattgagaccctcaagaaaaagattgctggaacggcggaataagcgctagctctcgtggaaagctttagaaaaccaacgacgagaggggccgtttcttctttgcaaattaagatatcaaaccgaggaacgtaccaatgcagctactggtcgccatgtcatgtgttgtgtgatgcataccc

SEQ ID NO: 71407 - DNA, 416 bp, Zea mays
  Clone ID: LIB3078-027-Q1-K1-C4
cccacgcgtccgccacgcgtccgccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgttcccg

SEQ ID NO: 71408 - DNA, 427 bp, Zea mays
  Clone ID: LIB3078-027-Q1-K1-C5
cggacgcgtggggttggaagggatcctgctggtatgagccaccccacagagaaaagggacctctatgatgctgatcacggaaagaaggttttgagcatggctcctggccttgagaggctcaacatccttcctttcaaggtggctgcatatgacacaaagcaaaagaaaatggatttctttgatccatcaaggaaagatgatttcctcttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaatctggaaaatccttcatataaggaatgctactatatcttagcaagcggttctttgcgaca

SEQ ID NO: 71409 - DNA, 301 bp, Zea mays
  Clone ID: LIB3078-027-Q1-K1-B11
cccacgcgtacggtagttctagatcgcgttcggacactcgcgatctagatgtgagcggggtcatacagttccagcacaacgacgaactcgacccggcgaagaagctctaccctggcggctcctactatgacacgctcgcacttggcggacgaccccgagaagaaagagcggatgcagctggccgagatcaagcacgcgcgcatggccatggtcgacttgctcggcttctccaagcaggccgtcaccatcggcaagggggcactcaacaactgggccactcaccgtagcgacccactccata

SEQ ID NO: 71410 - DNA, 421 bp, Zea mays
  Clone ID: LIB3078-026-Q1-K1-H8
gccggcggactcaaaggggttgccctcatcggcggcagcgccaacagcacgggcgctggggtcattcacttcttcgaggacccctccaccacgtacaccgaggtgaggggcaaggtcacgggcttgactccgagaaggcatggattccacatccacgtcttcggcgacactaccaatggctgcaactcaaccggtccccattttaaccctcataataaaccccatggagctccatttgacgacgaacgacatttgggcgacctgggaaatatagtagccaatgaagatggagatgcaaaagtgttcataagagacttaccgatttcattgagtgggcctcattccattctgggaagggcatgtgttgtacatgctgatcctgatgacctacggaggggtggccatgaactgagtaagtcaa

SEQ ID NO: 71411 - DNA, 418 bp, Zea mays
  Clone ID: LIB3078-026-Q1-K1-H9
cggacgcgtgggcggcagtcacctggccgccggcgtccccttctccgcgcgagtaggcaggagcttaggccgcagtggcgtcaccatctacatgagagcccagaagaagcgcaatagtgaatctgggagcagtagcggaggtggggacgtgcgggccagcagcgggcggcgagtgtggcgtcgtcggaaactgaccaaagaggatgacatgttgcgttacaagttggatcgtatcccttttctagaggagaaggtgagaaaagtaagggagaatgggaagatcatatgcctggacattaatcagctgatgttatctcaagagaatagatttgcattcaccatggaggtggctgaagaagctaatgtctatcttgagaagaacaggcatgaatatgggctgaagaagcctatactgcat

SEQ ID NO: 71412 - DNA, 435 bp, Zea mays
  Clone ID: LIB3078-027-Q1-K1-A1
cccacgcgtccgcgtcgctcaagaagtacgcgcccgacagcgccccggccctcgccatgaacgccaccatcgagaagaccaagcggcggttcgagaactacggcaagttcggcctgctctgcggcgccgacggcctgccgcacctcatcgtcagcggcgaccagcggcactggggcgagttcgtcaccccgggcctgctcttcctctacatcgccgggtggatcgggtgggtcggcaggagctacctcatcgccatcagcggcgagaagaagcccgccatgagggagatcatcatcgacgtcgagctcgccacccgccttctccccagggggttcatctggcccgtcgcggcctaccgcgagctcatcaacggagacctcgtcgtcgacgacaaggacatcggctactactagctgctggacctgtgcttgcaca

SEQ ID NO: 71413 - DNA, 408 bp, Zea mays
  Clone ID: LIB3078-027-Q1-K1-A10
tccacgcgcagagcatcctcgccatctgggcctgccaggtcgtgctcatgggcgccatcgaggggtaccgcgtcgccggcggcccgctcggagaggtcgtcgacccgctctaccccggcggcagcttcgacccgctcggcctcgccgacgaccctgaggccttcgcggagctcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccgggcagtgagggggtggaggcgccaccgcccaccggccaccgctgcggatatctaggtgttcggatgcacgtg

SEQ ID NO: 71414 - DNA, 375 bp, Zea mays
  unsure at all n locations
  Clone ID: LIB3078-027-Q1-K1-A11
ggcagcttcgacccgctcggcctcgccgtcgaccctgaggccttcgcggagctcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgagggggtggaggcgccaccgnccaccggccaccgctgcggatatctaggtgttcggatgcacgtgagcgcgcactggttccagtttgtaccatgatgtaaattacttaccgtaccagggttcaatcggcaaggaaagaattgttgtgttcc

SEQ ID NO: 71415 - DNA, 189 bp, Zea mays
  Clone ID: LIB3078-027-Q1-K1-A12
gtcgaggttcaacccgatcggcctcgccgtctaccctcaggcctcagcagacgggaacggggacgatttcaagagcgtgtggatcgccatgttcaggatgatcggcttcttcgcccaggccatcgtcaccgccaagggcgacgatcgagaaccatacccgagcacggagttcaaccgcagtgaacaaca

SEQ ID NO: 71416 - DNA, 420 bp, Zea mays
  Clone ID: LIB3078-027-Q1-K1-A2
ggatgagtaccagcttgaagatcttgaaatcgtttctgctgatgatatgttgaaggtgggagtatctaacttccgaaatgcctgggaaaacatggatccagagactgagcgagttgacgagtatgggcttggagtaagggagagcttggctgatgctgtaagtgctgttataagcatccttggcatgcagccttgtgagggaactgacgtggtcccaagcaattcaaggtcgcacacttgtctgctctctggtgtgtttattggcaacgtgaaagtcttggtgagactgtcatttggaattagtgcaccgaaggaagtggccatgaagctggcagttagatctgatgatccagagatcagtgacaggatccacgaaattgtcgctaatggcttaaaacaatggtagtatcttttttttta

SEQ ID NO: 71417 - DNA, 446 bp, Zea mays
  unsure at all n locations
  Clone ID: LIB3078-027-Q1-K1-A3
gattgatgaacagatcgcagcagtagtctttgtgccagcgtgtatggaagctacgcctaataatgtgataaatacaagcaaaaccgtggagacctttgctgctcatcagtctcctgagtatgatagtggattgaaagataaggatcagagaatatcatttgaagatgagatatctgagggtgggcaagctgaacaaagtactccacaacaggaattgtgggctatgccaccagatactagtgaccgtgaaactgttgagaggacaaccagaagtattgaggtggagcatttctctcaggttgagtcaaagcataaaatgaactctatgtncgtggaagcttctgagcatgtcactatcactcagattgagaagaagccggttcaacaagttgagataactcangagttagattcactggcgatatgttctatggagcattctaatg

SEQ ID NO: 71418 - DNA, 399 bp, Zea mays
  Clone ID: LIB3078-027-Q1-K1-A4
caagaacaggaaggaaacaccgccgccgtcgcgccttccattccagtactcgcggaggaaaggaacaccagccagcgccatggtcacgtcgacgaccgccgccgccgtgctgtccccgccgtccgtggccgggcttcgcctggcgccgtctccccgggcgcgcgtggcgttccgcgcggcgcgggcgcggcggtccgtggcggcgcgcgcggagctgagcccgtcgctggtgatcagcctgagcacgggcgtgtcgctcttcctgggccgcttcgtcttcttcaacttccagcgggagaacgtggcgaagcaggtgcccgagcagaacggcaagacgcactttgacgccggcgacgagcgcgccaaagagttcttcggcctgctcaagtccaacgaccc

SEQ ID NO: 71419 - DNA, 390 bp, Zea mays
  Clone ID: LIB3078-027-Q1-K1-A5
cgcacacgttcgcgccaaccatatcgctgtggcgacgactcacacgcaggaccacgcggggagcgacaagtactgcgtgtggtacgcgctggacttcgtcgacggcgagctcaaagaggagatgtttgctattcgctttggatctgtcaagaattgcgagactttcaaggacactgctgaacagatagctgagcaccaaggaaagagcgatgataaagaatatgatgaagtctccactgccgcttatgatttgacacagaagttaacagtggcagagcccagcgcggaggaaaatgcagataatgaggacgctgatgcatacgatgataagaaggatgctaaagagtgaaagttgaatgcaatcaatggtcaaatggatgccattccatt

SEQ ID NO: 71420 - DNA, 416 bp, Zea mays
  Clone ID: LIB3078-027-Q1-K1-A6
cccacgcgtccgctcttgataatattaatgtggtgcctttaacaacagagtcagaagtaggccacaatgagcattcaaatgaagcacctacaaaaacttttgcagaagagacagccaaactacctaatacttttaagacaccagaggccaacaatgaaagcacacatagaaatatggaagtgcttgtagacaagcctgaggagaaagttgttgtcaatgcgtctaatcttggtaattttgttgggaagcctgtgttccaagcagagcgcatatacaatcagactcctgtcggagtggtcatgggtttagcttggaatgctatgggtggttcgaccttgtacattgagacagcaaaagtagaggaaagcaaaggcaagggaacactttttgtgacaagccagcttggcgatgtcatg

SEQ ID NO: 71421 - DNA, 376 bp, Zea mays
  Clone ID: LIB3078-027-Q1-K1-A7
gccacacctcctgtctcaatctgacaccttacatccgttgctcggtgagtcgtggccaggcgcacacatggcctatgtcgagcttgcctgcacctgctcggctctcattctcagcgaccatggcatcgacatcacggtcggcaagatcggcacgagcgataaggctgtcaacatcaatgtcgagtactactgaccgggactgtttgacaagctactgaataagcgcaacgtcgatgacacaatcctgtccgttggagctgagggctaaactgctacagttgctgatgccgaaactgatagcagtgctgatgctgcagctgatcaagctgtcaagaataaaaaggaatatgtcatcgaagagtcagatgactacatg

SEQ ID NO: 71422 - DNA, 443 bp, Zea mays
  Clone ID: LIB3078-027-Q1-K1-A8
cccacgcgtccgcccacgcgtccgctgcatcgctcgctccgcggtcgccaccactgccaggccgctccgcctcgccgcctcaaggtccgcgcgggctaccagactcgttgcccgcgccagcgtagtcgatgacttgccgctggtcgggaacaaggcgccagacttagaagccgaggctgtgttcgaccaggagttcatcaacgtgaagctctctgattacattgggaagaagtacgtcattctgttcttctaccccttggatttcaccttcgtctgcccgaccgagattactgcgtttagtgacagatacgaggaatttgagaagttgaacactgaggttcttggtgtttccattgacagtgtgttcttccaccttgcatgggtgcagacagacaggaaagtcggtgggctcggcgatcttaaatacccacttggttctgatg

SEQ ID NO: 71423 - DNA, 292 bp, Zea mays
  Clone ID: LIB3078-027-Q1-K1-A9
ctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgccagaatatccggaagttggttaaggatgggtttatcatcaagaagcctcataagatccactctagatcccgtgcaagaagggcacatgacgccaagcaaaagggacgccactcaggatatggtaagcgtaggggtaccagggaggctaggctacccacca

SEQ ID NO: 71424 - DNA, 356 bp, Zea mays
  Clone ID: LIB3078-027-Q1-K1-B1
gtctgactgcaaacatgcacagcgacactgtagcgatccctatgtgtgaaggagctgcgactgcaaagtctgcgtgtaatgcacctgaactgaccaatatttacatatttgccagtgagtctatcagaaaatcgttggttattgacaaacccacgtggtcatctgatagatgctatcgtaagcagcggctcttgccatactacggctgcctttgatagcatgaatctacgaagcacgcgatgaacgaccgtacgggtgtgtacacgtgctataacatcgattcacagtcattccacaacttctaatgggacctctactaatattacatcaacgagtgcgatacttttgccctatat

SEQ ID NO: 71425 - DNA, 414 bp, Zea mays
  unsure at all n locations
  Clone ID: LIB3078-027-Q1-K1-B10
ctccttcttatccccacctccctcgcggatcactcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttcgaggtcgagcggagcaccgaggagggcaagcctnctccccactacggtcgcagctggaaggcttctgaactgcgactaaaatcttgggatgaccttcagaaattgtggtatgttcttctaaaggaaaagaacatgctaatgacacagcgtcaaatgctgcattcagagagcatgaggtttccaaatccagaacgaatttccaaggtaagaaatcaatgtgcccggataagcatgtctngactg

SEQ ID NO: 71426 - DNA, 457 bp, Zea mays
  Clone ID: LIB3078-026-Q1-K1-H7
acttgggaaacgcagcgatggatggccagccaggtgctgctgcgttgtcgagtcctggtgcgagagtaaaagcaagcctggttctgggatccgaatcgttcgctatcaactccgagttcggtaccctgtcggagcagctggccgcggtgaaggagaagagcatggcggtcctcaaggaacacatcgccaggcacaatgctccgaacgaggtccccgacgaggccgccgagggcgagtctgacagtgagggcgaagcgccgcttgtcgacaacccgccgaagaaacctaagaagcagaagtgaccgtctctagtcatgcacttgactttttttttttttgccatgcgttgcttgtgtaacgccagactgttgtcagtcacaatagcaatatgcaggtgttagcactcacttgctgttcgtaccactatcattagttctgcttctctgtcatgtgttca

SEQ ID NO: 71427 - DNA, 327 bp, Zea mays
  Clone ID: LIB3078-026-Q1-K1-G2
tgggctcttcctccccttccggttcgggttcggattcgtgaggttctccggggttcggggtcatgggtcagcggatcgagatggcggcgtccgatgttgagtaccgctgcttcgtcggcggcctcgcctgcgccacggacgaccactccctgcacaacgccttcagcacctacggcgaggtcctcgagtccaagatcatcctcgatcgggagacgcagaggtcccgcggctacggcttcgtcaccttctccacggaagatgcgatgcggaacgccatcgagggcatgaacggcaaggagctggacggtcgcaacatcaccgtcaacg

SEQ ID NO: 71428 - DNA, 355 bp, Zea mays
  Clone ID: LIB3078-026-Q1-K1-G3
cggacgcgtgggcgcgttaccccctctcccttggtttcctctcccaccaccaacccccaggccgggtatctccgccgccgcccgctttgggaaggcgcgacgaaggcaggcgagaggctccagccggacgaggaggaaagaggagcagcagggccggaggagagatgttcctgtgggactggttctacggggtgctggcctccctcggcctgtggcagaaggaggcgaagatcctcttcctcggcctcgacaacgccggcaagaccacgctgctccacatgctcaaggacgagcggttggtgcagcaccagccgacgcagcacccgacgtcggaggagctcagcatcggcaagat

SEQ ID NO: 71429 - DNA, 353 bp, Zea mays
  unsure at all n locations
  Clone ID: LIB3078-026-Q1-K1-G4
cgacgagatggaccgcctcttcaacgctgagatcaacaggcagctcaaccaggcggagtgcgacgcgctgctgcaggagttcaagacggactacaaccagacccacttcgtgcgcaaccccgagttcaaggccgccgccgacaggatggagggcccgctccgccagatcttcgtcgagttcctcgagcgctcctgcaccgncgagttctccggcttcctcctctacaaggagctcggccgcaggctcaagaaaaccaacccggtcgtggcggagatcttctcgctcatgtcaagggacgaggcgcgccatgcagggttcttgaacaaggggctgtctgacttcaacttggcgc

SEQ ID NO: 71430 - DNA, 370 bp, Zea mays
  Clone ID: LIB3078-026-Q1-K1-G5
cccacgcgtccgcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaaccctaacct

SEQ ID NO: 71431 - DNA, 458 bp, Zea mays
  Clone ID: LIB3078-026-Q1-K1-G6
gcggtcctcctcgctgcctccttcctcccagtagccgagtcgtactgcgtgcgagatagctcattggtgagagacataagccaaatgccgcaaagcagctatgggattgaaggattgtcacatataacagttgctggtgcgctcaatcatgggatgaaggaggtggaagtgtggcttcagacaataagtccaggtcaaaggacgccaatccacaggcattcctgtgaagaagttttcactgtcctcaaagggaagggtacgctcttgatgggatcaagctcactaaagtacccagggcagccacaggaaattcctttctttcagaataccacattttcaatccctgtaaatgatccacaccaggtttggaattctgacgagcacgaagatttgcaagttcttgtgatcatatcgagaccgcctgctaagatattcttatatgatgattggagcatgcc

SEQ ID NO: 71432 - DNA, 452 bp, Zea mays
  Clone ID: LIB3078-026-Q1-K1-G7
cccgcgcgtacgcaagcttcgcttcatctgcaacatgtacaggaccgggtgctgggtgcgggagtatcaccggacaccgtcgggcgtctgcaatggcacgagcggatgtcaggcgatgcttatcagatgctacatcgaccgctaaagcatgttcagcatgacgccgtaggcctgcgcagcactgggggccatgacctacagatgcatcaaggcggtggaatgcgagccccatgcggtcacctacggacgtctgctgacctccatgaaatccattatgaccaacgccagcggctgctaccagcatctgaagggcgcttgcgcaaccgcccgctaggtcgtaagcttcagcagaatgcaggaacctaacctgtcttgctcggacatgttcgacggctaccgctagcgctttgcgctgtgaacctggtctgcatcgccatcgcctttgcagacta

SEQ ID NO: 71433 - DNA, 436 bp, Zea mays
  Clone ID: LIB3078-026-Q1-K1-G9
gggatcattcctctctgctttaaagcaggagaggatgccgattcactcggcctcaccggacgtgagcgctacaccatccacctccctaccagcaccgccgagctcagtccaggccaggacgtgaccgtcacaacccacgacggcagatccttcacttgcactcttcgcttggacacacagcttgaggtcacatacttcaaccatggaggcatccttccctacatggtccgcaacctggcagcacagatgaaataagttaaaaagcaagctagcttattggcgcggtgggaataaattaaaaaggtactcagtgccccacgtatttgacgtatgtctgtaaataagtggcacattcgagcgctcttcgctctgccattgaggtggatcgaagctgccacatattttctccgcaagacatcggcacgaattttgtctt

SEQ ID NO: 71434 - DNA, 368 bp, Zea mays
  Clone ID: LIB3078-026-Q1-K1-H1
caggccgtggagtgggccacgccctggtcccgcactgccgagaacttcgctaacttcaccggcgagcagggctacccgggcggcaagttcttcgacccgctcggcctcgccggcaccgtcaaggacggcgtctacatccccgacgtcgacaagctcgagcggctcaagctggccgagatcaagcacgcccgcatcgccatgcttgccatgctcgccttctacttcgaggccgggcagggcaagacgccgctcggcgcgctcggcctatgatttgcatgctgccggcgaacgagtcagttctcgattgcgtggggtgggtgagctcctagggacgtacggctgcagcggatcagacgccttgcctcgca

SEQ ID NO: 71435 - DNA, 390 bp, Zea mays
  Clone ID: LIB3078-026-Q1-K1-H10
ggggaacatacaatgggatggatgttgctattaagcttttggagcgacctgaggctgaccgtgagaaagctcaactgttagagcagcagtttgtccaagaagttatgatgcttgcaacactgaggcacccgaatattgtcaagttcattggtgcgtgcaggaagccattggtttggtgtattgtgacggagtatgcgaagggtggatctctcaagaatttcttgagcaagaggcagaacaggtctgtcccgctgaagttggcagtcaagcaggcattggatgttgcacgtggcatggcctatgtccatggccttgggttcattcatagagatcttaagtcggacaaccttctgatttctggtgataagtccattaagattgctgactttt

SEQ ID NO: 71436 - DNA, 337 bp, Zea mays
  Clone ID: LIB3078-026-Q1-K1-H11
gccgagctcaaggtgaaggagatcaagaacggccgcctcgccatgttctccatgttcggcgtcttggtgcaggctatcgtcaccggcaagggccccatcgagaacctcgccgaccacctcaccgaccccgtcaacaacaacgcctgggcttacgccaccaacttcgtccccggcaagtgagcgagggcatgatgcttgcatgcgtgtaccgtagacgtacgtattcctacgtactgcaggttgcaccagtatttgtgaagggagctttgggagccagagattgtaccgctagtgtatttgtatgcatgatgtggagctgatcaataaaatatgttgt

SEQ ID NO: 71437 - DNA, 386 bp, Zea mays
  Clone ID: LIB3078-026-Q1-K1-H12
gtgagattgccgctcaagagatggattatgaccacaggcgtgtcagtgctctgcagcagaggctggttgatggcatacgtgcgcaggatgatgatgatgtcatcaatggaagtatggagcaccgttacccaggcaatctaaatttgtcatttgcttatgtcgaaggggagagcttactgatgggtctgaaggatgtggctgtgtcaagtggtagtgcctgcactagtgccagcttggagccctcatatgtgctgcggtcacttgtggtggaggaggatatggcacacacttctattcggttcggcatgggtcgctttaccactgacgaaaaggttgacagagcaactgagcttactgtgcatcatgtgaagaagcttcgtgacatg

SEQ ID NO: 71438 - DNA, 294 bp, Zea mays
  Clone ID: LIB3078-026-Q1-K1-H2
cccacgccgtccgaaaaaaaaaaaataaaaacaaactagaacaaaaactacaataactaaaccgaaaagcaaaactacccaaacagcaaagaacttacacccgctcaagactaaacgacaccgtcaaggacagcgtactacatccccgacgtcgacaagctcgagcggatcaagctagccgagatcaatcacgcgcgcatagccatgcttgccatgctcgccttctactttgaggctctacagggcacgacgccgatatacgcgctcggcctatgaaaagcatgctaccgggaa

SEQ ID NO: 71439 - DNA, 433 bp, Zea mays
  Clone ID: LIB3078-026-Q1-K1-H3
cggcgagaggccaccgtaccgccgggctctcccgccggcgttgctcgttttgctctgcctgcaatccgccccgcacggactgtactgtacctatacacctatatactacgacgtgcacctgtactacgacgtgctgctgtaccatactaatactagtgcgctgctgctcccttgccttcttgcttgcaccagccactcccgctttttttgctcgaacgatcgactgctcgtgtcgcgtcgggccacggccggtcgtcagtttgggtgtgtccactccactgtaaagctcctctcttttttttgggtactccctccatgccaaagttagcggacgtgtactaggtgtggttcggagcagcaggttgtattacttaccacccctctgtaatgtaagaacgcggtctaaaattatcatggcgatacccaagataac

SEQ ID NO: 71440 - DNA, 327 bp, Zea mays
  Clone ID: LIB3078-026-Q1-K1-H4
ccgaaacctggtgcacgcacacagcatgctggccatctgggcgtgccaggtggtgctcatgggctgagccgagggctaccgggtccgacgctgctcgctcgattaagggctcgaccaggtatacaccggacgcgccttagagccgttgtgccgagactgcgacccggacaccggcggcgagctcaaggtgaaagagctcaagaacggccgccatgtcatgtaattcatgatcggcatgttcacacacgccattgagagctacaaggaccatatcgagaacctctccgaacacgtcgcctacccagtatcctacaacgcctgggcata

SEQ ID NO: 71441 - DNA, 60 bp, Zea mays
  Clone ID: LIB3078-026-Q1-K1-H5
acgctcagggagctggacggccgcaacatcactttcaactaggcccagtacctctggggc

SEQ ID NO: 71442 - DNA, 432 bp, Zea mays
  Clone ID: LIB3078-026-Q1-K1-H6
gtcgccgagttcgagaacgtctacaactcgctcacgggcaccgaggtcgccaccgtcacctccgtcgtgcagctcgagtcgcaggacctggcgcagatcgcgcagcacgtccagaagatgaccggcgcccagaacgtccgcatcaagacgcagctcgacccggagctcatcgccggcttcaccgtgcagtacggccgcgacggctccagcttaatcgacatgagcgtccggaagcagatcgaggagatcgcgtccgagttcgagttgcccgccgtcccgctcgaagtctgaccggcccgaggcgtcctctatcctcgcccatgagatgctttggtgcttcctgctgcctctctccctgctcttcatgtgtaccattctctgattgaatatttgagtgaatggtgaatactgcatacctggatttcaggattc

SEQ ID NO: 71443 - DNA, 413 bp, Zea mays
  Clone ID: LIB3078-026-Q1-K1-G12
cccacgcgtccggacccacgcgtccggctgtgtgctaagctggagctatggtgaagaagagtcctgtttaccagcacatcgcaaatcttgctgggaacaaaactctggtgctccctgtacctgcctttaatgtgattaatggagggtcacatgctggaaacaagcttgccatgcacgagttcatgatcctcccaactggtgcctcctcgttcaaggaggccatgaagatgggagttgaggtgtaccacaacctgaagagcataatcaagaagaagtacggtcaggatgcgactaacgttggggatgaatgtggtttttgcacctaacattcatgaaaacaaagaaagccctgaactattgaatgcagccattgaaaatgcttgctacacttgaaaggtggtcatttgaatgga

SEQ ID NO: 71444 - DNA, 414 bp, Zea mays
  Clone ID: LIB3078-026-Q1-K1-E9
ggcggtcgggcgcggcggcggcggcggccatgagcagcgggagcgagagcactaccgccagcagggggctcgagctggccacgctgcgcgcgctggcgcgcgacgccgcggagcagcttcggctgccgcgggccggcacgtcggcgtcggcgtcgtcgtcgtcgccgtggcgcgggcgcgaggaccaccttcacggccacggcaagacggccaaggtgatgcacctgctgctctggggacccaagtgaagcggcggcgagaggccaccgtaccgccgggctctcccgccggcgttgctcgttttgctctgcctgcaatccgccccgcacggactgtactgtacctatacacctatatactacgacgtgcacctgtactacgacgtgctgctgtaccatactaatactagtgcgc

SEQ ID NO: 71445 - DNA, 402 bp, Zea mays
  unsure at all n locations
  Clone ID: LIB3078-026-Q1-K1-F1
ggaagttcaagtgatgaagaggctgatgatgagtggactgacaagagtgctaaggaaccagcatccagtgcttcaggtagggcagcatctggcatgtcaagtgatgaaaagaaccagcgtcagagagatgctcgagttcttatgccgccaccacgctcattagccccaaatagaggcagacatgcagataaacgtgcgatatccagctcgagcagtacttcaaacagcacaagcggcgaatcatttaaaaatagaagagtaccaaatcgtcccggggataataacagtaatctgagctcaaattctgatgttcataaaccacggcgcanaaggaggcataagangaaaagaaagcttgcatgatgaatattcccaaagcgcgtgaactggtggggtccggtg

SEQ ID NO: 71446 - DNA, 415 bp, Zea mays
  Clone ID: LIB3078-026-Q1-K1-F10
ggctctctgattttacttctcagcggtagatcggcacacggagctagctaaacagagcacactgagagaaaagcaagatgtcggacggcacggcgacctgcatcgacatcatcctcgccatcatcctgccgtcgctcggggtcttcttcaagttcggctgccgggttgagttctggatctgccttatcctcaccttcttcggctacctccccggcatcatctacgccgtctgggccatcaccaagtagccggccggagcagagcaaccacggccccctgcaatgactccgtcgcgtgcgttagcatgcaatgtcttgagatgtgattcctttcttctttggttagttgctgctgctcctgctggtgtaatggtgtattcagtccttttaattctcttgattaggttgctcggctg

SEQ ID NO: 71447 - DNA, 423 bp, Zea mays
  Clone ID: LIB3078-026-Q1-K1-F11
cccacgcgtccggaagcaggaatggccatgcccctatcttcctctggtacaccctcaacaggaagggctacagaggcttccagaaagaagtccaaaagtgcttgagaaacgcacactacctaaaagatcgcctcaaggaagcaggaatcggagcgatgcttaacgagctcagtagcacggtcgtgtttgaaaggccaaaggatgaagaatttgtccgaaggtggcagctggcttgtgaagggaatatagctcacgttgtggtgatgcccagtgtcaacattgacaagctagactatttcctgaatgagttagttgagaaacgggcgacttggtaccaggacgggataagccagccaccctgcattgccagagacgtaagtgttgagagctgtctctgtggccttcacaagtagcgagcctttt

SEQ ID NO: 71448 - DNA, 375 bp, Zea mays
  unsure at all n locations
  Clone ID: LIB3078-026-Q1-K1-F12
gcccgtggtacggccccgaccgcgtgctgtacctgggcccactgtccggcgagccgccgggctacgtgactttctanttcccgggcgactactgctgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcg

SEQ ID NO: 71449 - DNA, 388 bp, Zea mays
  unsure at all n locations
  Clone ID: LIB3078-026-Q1-K1-F2
cccacgcgtccgcacaaatacagctcagaagcaactcacacacaggctcctctcccccgttgcgcaacgcgctttcccccacttcacccgcctcggcgccatggctaagctcgcgctggcgctcctactcctgctggccgtggcggcgtccgcgtcggccagcagcgggagccacctggatctcgacctgngcttcctctcctctggggaacgccggacggagtgccgcggcacggtggccgagtgcctcgccgaggagtcggatgaggagggccttgacctggctggatcccaccgtcgcgcgctctacggcggcgggtacatcagctacggcgcgctgcggcgggacaacgtgccctgctcccgacgcggcgccagctactacaac

SEQ ID NO: 71450 - DNA, 418 bp, Zea mays
  Clone ID: LIB3078-026-Q1-K1-F3
cagctccatctccagctccggctccagccgcggggatatgccaggtcccattggcggccgacgtcaagcgacacggtgccggaactctgcccttcagctcaccgaaccggacctctgcggtaccggcctacaggatggagtttcatgaccaacaaggcctgcagtgtggccctctgcatgatcagttgctcgccagccagagcgtcctgttctaggcgcggtggcagcccaccctgcgccatggatcgaccaggtgcctattgtataatacttgtggtatcgctgtagcttcagcgcctgtattgaagggattagcctttcgggagcataacagaaaggagatcttcatttcatgggtggtccataaaatttgttggagaatgtaacaaaaagaacgccgagaattcgatgccatggt

SEQ ID NO: 71451 - DNA, 387 bp, Zea mays
  unsure at all n locations
  Clone ID: LIB3078-026-Q1-K1-F4
aagggccctaaccatggttgggagtcctctactgatgggaaatgtgaaaaattgccatcggcaaagatgctcaacgtgcgcatccagtcattgccatgctttgagcaggaaggaatggtctgaatttggcctggggatgacccaccaaaggctacaatcccttctcttctgcctccttcaggatttacagtacacgcagagatagtgatggaactgccagttgaacatggactactcctggataacctcttggaccttgctcatgctccttttacacacacatncacctttgccaagggctggangtgtccaagtttggtgaagttcttaacacctgcgtctgggcttcaagggtaactgggatctttaccgatcgacatggagttc

SEQ ID NO: 71452 - DNA, 423 bp, Zea mays
  Clone ID: LIB3078-026-Q1-K1-F5
cccacgcgtccgatcgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctgttaagt

SEQ ID NO: 71453 - DNA, 345 bp, Zea mays
  Clone ID: LIB3078-026-Q1-K1-F6
accacgcgtccgaccacgcgtccgcgcctgtctcaatctgataccgcacatccggcgtggggtgagtggaagccgcacgaacccatggcctccggcgagcttgcctgcacctactccggtctcatcctcagcgactatggcatcgccatcaccgccgagaagatcgccacgatcgtgaaggcggccaacatcaaggtcgagtcctactggccggccctcttcgccaagctcctggagatgcgcaacgtctaggacctcatcctctccgatggatctggtggcggagctgctccatttgctgctgccgcacttgctggtggtgcttctgctgctgctgccctggct

SEQ ID NO: 71454 - DNA, 455 bp, Zea mays
  Clone ID: LIB3078-026-Q1-K1-F7
cgcgggctcacgggcagcgagatggcgcgcttcaagttccgcaagggctgcctggccatgtacgtctacaccgtgcgccggctcggcgccgccgggttcatgcgcaccgacgacctcaggcggatgctgcagtgacgcggcgagctcaaggacttcctggaccacacagccatgctcgccatcccgagccagaagagcatcaccctgcagtcccggacagcggtggctcactgagaggagatcgtcgtcacagggcatgtcacctccagagcctcgagtctgatctgattctgatgacgccggaagaacctcgatcggttcagcatcgcagaacagcctgaacaggtatggtcgtcggattgtagctgtaatcttcagagggcctatctcattttgtttgcccccctctccctctctcggatggattcgtttgttcagtgtcggtggtgcaagtg

SEQ ID NO: 71455 - DNA, 293 bp, Zea mays
  Clone ID: LIB3078-026-Q1-K1-F8
cccacgcgtacggcgctatactttgtcttagatggcatagagaaccggacaacggatttgtcggacatgctgacatcccaagagtctatagccgcaccaatgactaacctgtatctaacataccaggataaaggtcttgtctatcatgcaaagggcttcttcagtgcaccttacgtgtgctggatgcatagagtgtacggacactacatactctatgtactatacgtctgtctgattcagacgcaagctattgtgatcaacgccacatacgcacattacctgactatgactca

SEQ ID NO: 71456 - DNA, 429 bp, Zea mays
  Clone ID: LIB3078-026-Q1-K1-F9
cgctgccatctcttccgtttctccctctctccccactcctctctagtggagacagcagcaccattattgacgctaatggcactgacaactccattcctctccccggcgctccctctgctcttccccctctctataaatcgcgagctcatgacccgtggagcctgttcctggctgcccaacctctccacgcgctctgttttctctctcgtcgtggaactcgccgccgccgcccctattcgtcatcgtcggagtcaccgaacacctcctgtcgccagcacgtgggttcccgagcgcctcgtcgatcccgccgccggtgtcccgctgtctcgactgccggttggagttcctgcctcatcgttgaccatcaccagctcgcctgtcgcgctgtgcgtagaaacagagaagagaaggttaaaggtagaagaaaga

SEQ ID NO: 71457 - DNA, 290 bp, Zea mays
  Clone ID: LIB3078-026-Q1-K1-G1
cggacgcgtgggcggacgcgtgggttcagatcgtaggcgtgtagtagttgcaccagcctgcgtatgctcatgatcgatgtgtgctcatcaatcaatgtcaatggctgcctgctgtaagcggtcgatgtaaactaagcacagacgcatgtatcgtcaaaaaaaaaaaaaaaaaaaaaaaaaaaaaaaaaaaaaaaaaaaaaaaaaaaaaaaataaaaaaaaaaaaaaaaaaaaaaactctaaaaacccaaacaaacaaaaaaaaaaaaagggccgcccgttcgcaattaaa

SEQ ID NO: 71458 - DNA, 364 bp, Zea mays
  unsure at all n locations
  Clone ID: LIB3078-026-Q1-K1-G10
cccacgcgtccgcccacgcgtccggaaccgcaaggcgacggcggggctgaagctggaggcgcgcgactccggcctgcagacgggtgaccccgccgggttcaccctcgccgacacgctggcctgcggcgccgtcggccacatcctcggcgtcggcatcgtgctcgggctcaagaacaccggcgccctcgaccagatcatcggctagatccctacgtcgtcgttgttaagatcagactcagcagcctcgatcgcgccgncggccggcaggtgcctgcaggtggtgactttgtaacgtgtgtgcgtgcgtacgtgtacattgcatncatcttggttccaatggacatatagctcctggtgctcctct

SEQ ID NO: 71459 - DNA, 411 bp, Zea mays
  unsure at all n locations
  Clone ID: LIB3078-026-Q1-K1-G11
gcgagcggcgcccttttttttttttttttgattaagcaaaacaaggttactggacaaatatgcgtagctcaacattggaaaaatagaagcgcgcacacacagaaaaagggcggcccggacgcgtgggcggacatcgattattngatatgcttnacttgcactcttttnttggacacacagcttgaggtcacatacttcaaccatggaggcatccttccctacatggtccgtaacctgtcagcacagatgaaataatgtaaaaagcaagctagcttattggcgcggtgggaataaattaaaaaggtactcagtgccccacgtatttgacgtatgtctgtaaataagtggcacattcgagcgctcttcgctctgccattgaggtggatcgaatctgccacatattttcttcgt

SEQ ID NO: 71460 - DNA, 454 bp, Zea mays
  Clone ID: LIB3078-026-Q1-K1-E8
gcggttctccgagaatacagtatgacatcagtcacagaaggcattgacgcaatcgcggcaactcgggttgttgtcactggagatgtgagcaacaacgccaaacatgccctgactggccagtctttcaaccgctccttcagcgggagcggggcatccatggacattgtggtgtccagtgtcagagcttacctgagcgccctgaacaagatctgcagtttcgctggcgccgtgaaagccagcagcgatgtagctgagaccgcaagcgtcccgagcacagaatgagctcccgtttggttcagagtgacatgttgttcaaaatttctgctggaaggatcgtcccttgagcttaggacaggcaggaagtcttgggacctatgtagtgtacaatttctgagtgtcatataccgtgctcgttgccagtttgtactgtaccatatataaaccatagaatctg

SEQ ID NO: 71461 - DNA, 379 bp, Zea mays
  Clone ID: LIB3078-026-Q1-K1-D11
cgaaagcacccgtcctgtcccctcgcaaaaccctagctccagccaccatgaagggcaagggtgacgcctccaagaaggacgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcaccctggcaacaagagcgttgcgaccgtgagcaaggcagcaggggaaaagtggcgtggctatgtcagatcaagaagagcaaccatatgtggaccaagctggacagaagaagcaggactatgagaagactaaggcaaactttgataagaaggagagcacaagctcaaaga

SEQ ID NO: 71462 - DNA, 345 bp, Zea mays
  Clone ID: LIB3078-026-Q1-K1-D12
cccacgcgtccggggccagaacgacatcttctacatcactggtgagagcaagaaggctgtggagaactccccgttccttgagaagctgaagaagaggggctatgaggtgctgttcatggtggatgccattgacgagtattctattggacagctgaaggagtttgagggcaagaagctcgtctctgccaccaaggagggcctgaagctggacgagagtgaggatgagaagaagcgcaaggaggagctcaaggagaagtttgagggcctctgcaaggtcatcaaagaagtgctgggcgacaaggtggacaaagtggtggtctccgaccgcgtggtgtacttcccctg

SEQ ID NO: 71463 - DNA, 423 bp, Zea mays
  Clone ID: LIB3078-026-Q1-K1-D2
cccgcatcgaacctaaccctcgatctgatcgaatcgaaagctgcggcggcgatgggcggagaccatggcggagggcacgccggcggcgacttgcgacagacggtatggagcatgacgggcggcccctactgccgccccgtccactggcgccgtaacaccgccatcgccatgttcagcgtcatcctcatctgcatccgcatcgctatgaagaccacagagctcgatcaacgcccgcatcacccagtccggccaattccatctcaactgtcgtgcaaaaactctggtaagaaggaatactgaacgaccctccaactagcatgaagtgtgaacaccttgctactgcattcattttgtggaaacctgtgcctagccataatgctgggataagtgctaggagcatctctggaatgcttagcgtagtat

SEQ ID NO: 71464 - DNA, 434 bp, Zea mays
  unsure at all n locations
  Clone ID: LIB3078-026-Q1-K1-D3
tgcactttcatgaaacacagtttgaaattaaggagtgtatatactgacgtcgaggattgggaaggaacaaaagacgccagcaaggaaccactggtgacaagctacaacagaaaattcatgggaacagtagactacatatgggcctcggagggtctgcatactgttaaagtcttggacacatttcccatagagattttgaaaaaaacaactgggttcccgaccaagaaatggggaagcgatcacattgcccttgcctgtgaattggcttttacaaaatgacgccttttatcaggcggagagggcgcctgcatagttgctagtgaccaaacacacctcaagagaaagaatactgtctacaagacgattaactgaaccaaacctcgctcttttagagctcgntaatttatttcatttttttttcgacacaccttttt

SEQ ID NO: 71465 - DNA, 301 bp, Zea mays
  Clone ID: LIB3078-026-Q1-K1-D7
ctgactcgtacgctgatgactactgtgatttccacctacatcttccctgtaaggtggagggtcatctagaccacgaccaactccacgtcagcctaggccgtaaccgaacacgtcaccgagctcaacactgacatcttcattcctatcttctaggctatcggcaacaccgccgtcgacctcgacatgtacatcgacttgtacaccccatgctacgtgccgggtaccatgattccttacattttccataagatcctcgacatcatcttcctcatgctgtacttcaaccagtactacatgcctc

SEQ ID NO: 71466 - DNA, 354 bp, Zea mays
  Clone ID: LIB3078-026-Q1-K1-D9
cccacgcgtccgcccacgcgtccgcccacgcgtccgccctgctttctccgctaggccgctcggcttctcgcttcgtctcaagccgtcgcctgccatggccgccgccggcgtcggcggcaacggcccccctaccgcacatggagactcaataggatcttctaggattggagaggttaagagggtgaccaaagagacaaatgtgcacgtgaagatcaaccttgatggcactggtgtcgccgagtgtagcacagggataccgttcttggatcacatgctcgatcagttggcatcacatggactctttgatgtctacgttaaagcaacaggcgacacccatattgatgatcatcactc

SEQ ID NO: 71467 - DNA, 374 bp, Zea mays
  Clone ID: LIB3078-026-Q1-K1-E1
gatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtggg

SEQ ID NO: 71468 - DNA, 354 bp, Zea mays
  Clone ID: LIB3078-026-Q1-K1-E10
cccacgcgtccgcccacgcgtccgggattttctcagccaccttcttcacgttctctgatcagttgtgagcagggatgggtgacattgcaactaactagagaaccaggatatggcagaggcttcttttctcctagatctgttactggttttctatctgatgtttgttcagctgctgcagatgaagttggcaaaatatacataacagcagatgagaatgtccaaggagcagtcttcgatttacctgaggaaattgcaaaggacctgcttactatggaggtccccccgggaaacacattaaccaaaatttcgaagctgcctgcgttgcaagatgataggcctgctactgatagctat

SEQ ID NO: 71469 - DNA, 415 bp, Zea mays
  Clone ID: LIB3078-026-Q1-K1-E11
gaaccctcttgatttgcttcctcctagcaagatgattcttgatgattggaagaggctgtactctggcacgaaaaccaacttccgtgaggttgctattaaaggtttctgggatatgtacgacccagagggctactccctgtggttctgtgactacaagtacaatgatgagaacacagtgtcgtttgtgaccatgaacaaggttggtggcttcctgcagcggatggacctgtgccgcaaatacgcctttggcaagatgcttgtggtaggctctgagccccctttcaaggtcaaggggctctggctcttcaggggctcagaaattcccaagtttgtcatggacgaagtctatgacatggagctttatgagtggaccaaagttgacctctctgatgaggcacagaaggagcgggtcaat

SEQ ID NO: 71470 - DNA, 235 bp, Zea mays
  Clone ID: LIB3078-026-Q1-K1-E3
agacgtgagccatccactacgatcccctcccgcgaattgaacagctttcataagagaaccccatgcttcgcttgcgccggtgcacgcttggtatatcgcaccctgaatcgacagacatgcaagcccgaaccatttttgaacctgctataacaatgaccaaccaaggtgttcaagtgtatccatagataatggctactcttgttggaacaccacaggaactggggcatcaagtgac

SEQ ID NO: 71471 - DNA, 393 bp, Zea mays
  unsure at all n locations
  Clone ID: LIB3078-026-Q1-K1-E4
ctaagaaccaatcgcagaaccgcggcaggataatgaccagcctgtcctccggcatctcggcctcgccatctgcagcgcccagcaccgctcggcgccgccatgacgcagcgccgcagcagctgagggtgaaggcggcggcgcggccacagctgctgcacgccggccgccggcgttcgagtgtcgggaggaggccgggcggcggngtggtggtggtgagggccgggcctgggccgctgtcggagatcgagccggacctggaggaggacgccatcgacgtgtaccgcaccaacggcatcagcccggaggacttcgagtacgggaagtatgacggacaccacacctatttcgaaggtcaagacaagaagggcttctgggaggatgtctccgagtggt

SEQ ID NO: 71472 - DNA, 457 bp, Zea mays
  Clone ID: LIB3078-026-Q1-K1-E5
cccacgcgtccggcatgaacggcaaggagctggacggccgcaacatcaccgtcggcgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatccttcgctccagcagacccatgcat

SEQ ID NO: 71473 - DNA, 447 bp, Zea mays
  Clone ID: LIB3078-026-Q1-K1-E6
cataatcatgttaagttttcatgaaaaaaatttgcttaaactatgactgttccggtcaggtttttacctaaagaaggtattcacaagaatcttggcatttaacagacctgcacaccttgactttatgaaaagggacatgtcttcaggaacacagtactgttttaattccaggtgaacatagccgaggaagctgtcaggaggctaactgggatcaccctcatgctaccgaccgcttttgagaagcccacgagcagcgcgcccctgtcatcatgtccatctgatgcagcttctgcttctgcttctgccgccattgaagacagcgtgaagcatttactccaggcgccacttgaaaacagtgggatcatcccaaacgcagcagtttttcagaccaagccagcttctctgcaccgtgttgctagcctggagaacctgcacaagaggatcgtc

SEQ ID NO: 71474 - DNA, 450 bp, Zea mays
  Clone ID: LIB3078-026-Q1-K1-E7
tcggtcactcgatagcggttataatcgccacagtcgaggtactcgcagaatgtatcgtctctctgaacggtgatggtcttactaatctgtaacacgtactttgatgtctcttactggtttgttctccggtggaactttatcaaggcaaaagcacatcagcttatttcacttccttcggtgaacatcgaagactgcgagaacatcccaatttcggaccaagtcatgttaacggccggtaccattgacccatgtgtcgtcgcttgttgtgtagccaatgtctctgaggctgtggcaacgaggtatttcttacaacgcacgtaagcggacaagtcattagacagtcaagccgctcatgtgcacactgatggtgattttgtccaggctgatgagcatcggccacattcagtacgtgggtgcaagaggaaacctgtatctgcagagagtttgatg

SEQ ID NO: 71475 - DNA, 367 bp, Zea mays
  Clone ID: LIB3078-026-Q1-K1-D10
cccacgcgtccgcagggcgcgtggctgcgtggtggcgatggccgacctgctgggcgacttgggcgcgcgcgaccccttcccggaggagatcgagagccagtttggggagaaggtgctgggcaacgtggacacgctccaccagatcctcatccccaccctctccgcgctctccctcgcgagcctcccgctgcagcccgacgcggagccgctctccctcgacgacgcgcgcaggctcctcttcaaggtcgtcgggtggaggctcgtgctctccgacggcgactgcgacgaacagcggcccgcgcgggtgcagtgcctttggaaggtgcgcgacgagaccttgggtcaggagctcatcgtcaggatcaac

SEQ ID NO: 71476 - DNA, 457 bp, Zea mays
  Clone ID: LIB3078-026-Q1-K1-B6
gttgaaagggtggttggaaggcggcttgatcctgtaacagggaaaatatatcatgttgaagtattctccgccagagaatgaagaaatcgcttcaaggcttacacaaagatttgacgatacagaagaaaaggttaagttgaggctggagacttattaccaaaatatcgagtccttgctatcaacatatgagaacattattgtcaaagtgcaaggagatgccacagtggatgctgtctttgctaagatcgacgagctgctgggttctatcctggagaagaaaaatgaaatggtgtccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttct

SEQ ID NO: 71477 - DNA, 409 bp, Zea mays
  Clone ID: LIB3078-026-Q1-K1-B7
cggacgcgtgggcggacgcgtggggttctagatcgcgatctagaactagtctgggtagagtacactaccgaggaagctggaggtgctgctctaaaagcaatgaatggacagatcataaacggttggatgatatgacgcgatgctgctaaaactagatcgagagaccgactatctggcggatctaataaagcatcacgaccacactatcaggctacatgactgacatatgtacagaacttacagatggcgagttgagataagtactagagccaggaatagctgggggatgccgagccagctgatctgattgtacttcattgccatcgtcttgtgctaactgctcgtaaatgaatactgccagcagacaattatgtaaatgcagctgaagtgaacgattactaacttgtac

SEQ ID NO: 71478 - DNA, 449 bp, Zea mays
  Clone ID: LIB3078-026-Q1-K1-B8
gctgatgaacctcctcctcctgggcgccatatcgctgcccaccgtcggcatggtcgttcgctacggcgccttcttcgtccccgctggctccgggaacggcggcggcgggacctacgccaaggacaagctgggcaacgacatcacggtggaggagtggctcaacacgcacggtcccaacgaccgcacgctcgcgcaggggctcaagggtgaccccacgtacctggtggtggagcaggacaagacgctggccacctacgggatcaacgccgtgtgcacccacctcggctgcgtcgtgccttggaacggcgccgagaacaagttcatctgcccctgccatggatcccagtacaacaaccagggcaaggtggtccgcggaccggcgcctctgtcgctggccctggttcacgccgacgtcgacgacggcaaggtcctcttcgtcccgtgggtgg

SEQ ID NO: 71479 - DNA, 402 bp, Zea mays
  unsure at all n locations
  Clone ID: LIB3078-026-Q1-K1-B9
cccacgcgtccgctcgcctccctttccccgtcgccctgatggctccctccgcagctctcgctccgggggccttccgctccgccttctcgactccgctcgcgtcgaaccctacccgtaatagaataaacatagaaggcgctttctgtttgccgtgttccgcaaggaagagagctagttatagatctttccgagtgtacagtttatttggagggaagaaggataaagatgagaatggcgatgaagcgccatcgaaagcagggatttttggaaacatgcaaaatctctatgaaactgttaagaaggcccaaatggttgtccaagttgaagctgtccgggtgcagaaggagctngcagcgactgagattgatggttattgtgaaggtgaactaatcaaagttacac

SEQ ID NO: 71480 - DNA, 465 bp, Zea mays
  unsure at all n locations
  Clone ID: LIB3078-026-Q1-K1-C1
cacaggcatgcatagatgttgccacagaattgaaccatccagttatagacatctggaccaagatgcaggaatttccagactggcaaacatctgcattgagcgacgggctccacttcaccccggtaggaaacaagatcctgttcgaggaggtggtgaagacgctggagacgagcatcggtttcagccaggagcggctcacgtcggacctcccgctgttccacgagatcgaccccaaggaccccatgaaagccttcggagcttagcttgggccgcacggttggatcagccacgtctgctgcatttgagttcgtcgtcagtatgcaggagggctgctgaagccattacaggaacagtgagctttaataagcggtgttttcagtaccgtttggttgtcagcgcaacacgtgttgttggaacactngtgttccatatatataccatatatgtatctaagattcatcatta

SEQ ID NO: 71481 - DNA, 430 bp, Zea mays
  Clone ID: LIB3078-026-Q1-K1-C10
cccacgcgtccgggaggagcgtggcgaaggattcagaagagaacctgtcgtggggcgctcgcatagtgagaatggccgaggcgtcagcagcggagtagctgcgacaagcgaccctgccaaatgcagctgtactcgtacgtagcatgtggagcgaagcgaaacggaatatattttctggtgggtacaatttggtctgcaaggtttttaaggcgtggatctaaagatgtccagatggaaaccttcagagacagacctgttacgagaattggacgtgtagcagtagtagctgtagcggtggcatctggccagtattgaggaggaacagcagcacctggatggagtgtggtggctgctggctgcagaccaacacccttggccctggctacataatagttgagttcctgcctggccacctgggcctggctggctg

SEQ ID NO: 71482 - DNA, 428 bp, Zea mays
  Clone ID: LIB3078-026-Q1-K1-C11
ggtgatttagacaggaggagatctctttcaggttatgtttttactattggagattgtgcggtgaggtggaaagctcgtttacaggatactgttgctttgtctaccacagaagctgagtatatggcaattgcagaagttactaaggaagccttatggttgaaaggtatatattcagaactatgtggaattaagtcttgcattaccatctattgtgatagccagagtgccattcatctcaccaaagatcagatgattactgagaaatccaaacatattgatattcgctatcacttcattcgtgatatcattgaaaaagggttggtaaaggtatgcaagatcagtactgataataatccagctgatatgatgacgaagcatgtttctgttgctaagtttgagctatgctcaaacttagttggtattataaa

SEQ ID NO: 71483 - DNA, 420 bp, Zea mays
  Clone ID: LIB3078-026-Q1-K1-C12
cccacgcgtccggcgacgtgccgctcgtgtccgtcgacttcaggtgctccgacgtgtcctgcaccgtcgacgcgtcgctcagcatggtcatgggcgacgacatggtcaaggtcgtcgcctggtacgacaacgagtgggggtacagccaacgcgtggttgatctggcgcacctggtggcggccaagtggcccggcgcggcggcggccggcagcggcgaccctctggaggacttctgcaaggacaaccccgagaccgacgagtgcaaggtgtacgaagcatgaggccagggttctttccacgacgaaacgtacagcacgggcgcgagggttctttccatagagaataatatacagattattcgacgaaagagacgtatgttatatatatatatgagttgtatgcagtcaccgaactggcggt

SEQ ID NO: 71484 - DNA, 386 bp, Zea mays
  Clone ID: LIB3078-026-Q1-K1-C2
atctgaactggcgccctatcctgaaaactataatcgatgatcctcagaagttcattgacgatggcggctgggagttcctgaacatggaggcgagtgactcagagactgaggacacagaggaatcagaccaaggctatgtgccttcagacgctgagcccgaatccgagtcagaagatgatgactctgacagtgagtccttggtggaatctgatgatgacgatgaggagtcagacgaggactcagaggaggagaagggcaagacctgggaggagctggagcgtgaggcaagcaacgcggaccgtgagcacggtgcggagtcggacagcgaggaagaaaggaagcgccgcaaggcaaagaccttcggcaagtcgcgtgcgccggagcgc

SEQ ID NO: 71485 - DNA, 384 bp, Zea mays
  unsure at all n locations
  Clone ID: LIB3078-026-Q1-K1-C3
gccgagggagcaggacctgcttggagaaaactcccagatgtcgtccatcgattttctggggacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcngaagtggaaaccatcaacaaaaggaactctgaact

SEQ ID NO: 71486 - DNA, 297 bp, Zea mays
  Clone ID: LIB3078-026-Q1-K1-C4
accgacttaatttcaggccggaatggacaactactcccgggagatgatgtagctcatggggctcgtgaccagaaccctcgagaagaagggcgtgataggcaagattagggctgagctctgagcaggcgtctatgaagccattgtacaggaggatcgggtggagaatgatgatcgagggaaccctgctttgctagggagctgtaatgaccgagctaagcaactgcatgcttgatctacatgaaagttactaactgcactcgtatgcgaatacttggagtgggcgcagcttagtcacac

SEQ ID NO: 71487 - DNA, 449 bp, Zea mays
  Clone ID: LIB3078-026-Q1-K1-C7
cccacgcgtccgcccacgcgtccggcagcatctccgccgaccgcgtccccgacgtggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgccgagaacaagttcatctgcccatgccacggatcccagtacaacaaccagggcaaggtggtccgtggaccggcg

SEQ ID NO: 71488 - DNA, 394 bp, Zea mays
  Clone ID: LIB3078-026-Q1-K1-C8
gtgacccccgtgtattgtctatgctagtttctgttgacatacgaagtgtttgtaggtgggaaattttttcagattaaaaaaaaaaaaaaaaaacaaaaaaaaaaaaaaaaaaaaaaaaaaaaaaaaaaaaaaaaaaaaaaaaccaaaaaaaaaaaaacaaaaaaaaaaaaaaaaaaaaaaaaaaaaaaaacatataaataaaaaaaaaaaaactaaaaaaaaaaaaaggggcgccctcttaaaaatccccagtttaaatccccttccattcccatttaaagcctctttaaaacgctcccacaaatctcttttcttggccctccttttaaaaaactggaccttgaaaaacccttagcttaaccaaattaatacccttaaaagaaaaccccctttt

SEQ ID NO: 71489 - DNA, 353 bp, Zea mays
  Clone ID: LIB3078-026-Q1-K1-D1
gcgagtacgtcgtgataactcgaccctatggacttctgacatctggtaggaccctgatgaatagatgagggaggaacccaagcgctactctagtgaggggcaagtaagccggctattatgtgcctagagactagtctctagagcttgatgctgatgaatgacactatgcattgagatctggaacctggtgtattgggtgcaaagcttgctatgactggcggcagtaaaatatgtaggcttcccgaatgagatgctgtctatcaacgcgctggggttctagctcgattgacacgctgggcgctggagaccgtactgtaacagttgctaagcactatatactgcagtcaattgca

SEQ ID NO: 71490 - DNA, 423 bp, Zea mays
  Clone ID: LIB3078-026-Q1-K1-B5
cccacgcgtccgcacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcgtgacccagggcaccgtcg

SEQ ID NO: 71491 - DNA, 425 bp, Zea mays
  Clone ID: LIB3078-030-Q1-K1-C12
gcggttaagaaggtgactaacaagcccgttgctgttggcttcggcatatccaagccagagcgcgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctcggagaagacgaccgaccaataaaaataagccaagtggaagtgaagcttagctgtatatacaccgtacgtcgtcgtcgtcgttccggatcgatctcggccggctagctagcagaacgtgtacgtagtagtatgtaatgcaatgaatgtggagctactagctagc

SEQ ID NO: 71492 - DNA, 283 bp, Zea mays
  Clone ID: LIB3078-030-Q1-K1-C2
gcctggggaaggcggcgatcagcccccacctgcaacccccacagcggtaagtggcggtgaggagaaggggcttgaggcatctagtagcaagggagagcgcgtgaggatcaggatctatctagtgttgttaatgaaaattgaattctgggcttctcgagttagcagttcatatccttttaaccgcatcgcggtttcaggccatgtaccaatattgtttgtagtttgtaccgggaataacatatttggttgagcttctacgtattgaagaaccaactaatctgtg

SEQ ID NO: 71493 - DNA, 342 bp, Zea mays
  unsure at all n locations
  Clone ID: LIB3078-030-Q1-K1-C3
cggacgcgtgggcggacgcgtgggccaacccctacactcccggcggcggcgcaggagcaggagcacccgaggatggtgaagttcctcaagcccggcaaggccgtgatcctcctgcagggccggttcgccggcaggaaggcggtgatcgtgcgcgtgttcgaagagggcacccgcgaccgcccctacggccactgcctcgtcgccggcctggccaagtaccccaagaaggtggtccgcagggactcggccaagaagacggcgaagaagtcgcgcgtcaagtgcttcatcaagctcgtcaacttcacccacctcatgcncacccgctacaccctcgacgtcgac

SEQ ID NO: 71494 - DNA, 310 bp, Zea mays
  unsure at all n locations
  Clone ID: LIB3078-030-Q1-K1-C4
gtgatgttccataaccagtattggacgagcagcacgcgccgcaggaggctgaagaagagcgcatctgcatctcgaggaccttgaggatttgatctccctattatagaaaaccgggttcgcaggacgcatgaactgtgtgtgggggaataatcgcaggttagcactgttgctagtgtgcccgcctctcttggaatggaagcagcagagccagctatcagactggcagtgaccaccacctnctcagctacctggttgcatgccacagatctgaaattctgaaatgctgtgactgtgactgtgaggtatgaaa

SEQ ID NO: 71495 - DNA, 226 bp, Zea mays
  Clone ID: LIB3078-030-Q1-K1-C5
cccacgcgtccggcctcttccccgtggccgggatcggggaggccgacgcgctggtctggcggaaccttccggagagaggtcccccctaattccccttaacttttaacgcccccccctctaaaaacccctttgttttctataggactccatttaagtgataggctcctctgatcatatccaggagaaggctgatctgctataccctttgattaacggaaggcaactt

SEQ ID NO: 71496 - DNA, 360 bp, Zea mays
  unsure at all n locations
  Clone ID: LIB3078-030-Q1-K1-C6
cccacgcgtccgggcggtgtggttcaaggccggcgcgcagatcttctcggagggcgggggggactacctggggaaccccaacctggtgcacgcgcagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgtcgtcgagctcaaggtgaangagctcaagaacggccgtcttgccatgttctccatgttcggcttcttcgtgcaggccatcgtcaccggcaaggggccccatcgagaaccttt

SEQ ID NO: 71497 - DNA, 243 bp, Zea mays
  Clone ID: LIB3078-030-Q1-K1-C7
caattcgagggacgagtcacgcgtcccgtagataggaccctgtttccaactattacactattagtgaatgctcctaatcagagtgcgtggactatgttgaagttgctctaatgcaaatagagcccaaacctacattttggtctcctactcttcaataacgcgtacatcgttcccaacttagatgtgtacactctcaaccgattctacctacactgacttatcgccggcctgtgcaagtacccc

SEQ ID NO: 71498 - DNA, 407 bp, Zea mays
  unsure at all n locations
  Clone ID: LIB3078-030-Q1-K1-C8
cccacgcgtccgcagcgctccgcgtcggctaccgccacctggactgcgccgcggactacgagaacgaagctgaagttggtgacgcgctcgcagaggcattccagaccggactcgtcaagcgggaggacctgttcatcacaaccaagctgtggaactcagaccatgggcatgtgcttgaagcctgcaaggacagcctgaagaagctgcagctagactatctcgacctctacctcatccatttcccagtagccactcggcacaccggagtcggcacgacttctagcgctctgggtgacgatggcgtgctggacatcgacaccactatctncctggaaacgacatggcacgcgatggaagagcttgttccattgggcttgtgcgcaacattggaatcagcaactacgaca

SEQ ID NO: 71499 - DNA, 377 bp, Zea mays
  Clone ID: LIB3078-030-Q1-K1-C9
gcgtcaagcttgcttagctagccgccatggcctccctcgccgccgtctccgtgaagcccgtggccgtcaagggtctcgccggcagctccatctctggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcg

SEQ ID NO: 71500 - DNA, 198 bp, Zea mays
  Clone ID: LIB3078-030-Q1-K1-D1
caactattacactatcagcgaatgctcataatcagagtcagtggaatatgttgaagatgctcaaacccaaatagaccccaaacctacattatggtctcctattctgcaataactcgtacatctttcccatcttcgatgagtgcacccccaaccgatcctacctacactgactctttgtcggcctttccaaattcccca

SEQ ID NO: 71501 - DNA, 349 bp, Zea mays
  Clone ID: LIB3078-030-Q1-K1-D10
agcttgacaacattaaaaaataaagagcccaatagaaacttataaaggatcggcaacaagcataaaacgaagccaaaatgaactacgctgaactgatacggagaaacccgttgattaatatcaacaattctggctccttcaatgttaataaaatgttagacgacaactatctattcaataatcaaacactaagatagaccaatacacctaaactgttcatcaacgacaccatcaagagtgatttccaccgtaaatttcttcagaagtacattaagtgactctctcctctttcacaattcatcctttaaccccttaatcttatcatgtttgtcttataactaaaaatcat

SEQ ID NO: 71502 - DNA, 401 bp, Zea mays
  Clone ID: LIB3078-030-Q1-K1-D11
cccacgcgtccggaggtgatggctgtcgaggaggaggcggaggaggatgcgctgtcgggaatcgcgctgcgaaagtatgtgaagcagcggctgccgggcgggttcgcggcgcagcggatcaccgccacgggccgtcgcaagacggccatcgcccgcgtcgtgctccaggagggcaccggcaaggtcttcatcaacttccgcgacgctaaggagtatctgcagggaaatccaatgtggatggagtactgcaaggtacccttgatgactctagggtttgagaagaactatgacgtctttgtgaaagtacacgggggtggtctctcaggccaggcccaggcaatttgccttggtgttgcccgtgcgctggtgaagatcagcaatgccaacagggttcctctgaa

SEQ ID NO: 71503 - DNA, 364 bp, Zea mays
  Clone ID: LIB3078-030-Q1-K1-D12
ggcgggtatgggcgatatgccgatgaggcctgcgcggccgggcccgccgatgcagcaccggggtcgggccccgatggcgcgcctccgtcccgaaccaatcgaccgcgagaagacctgtcctctgctgctcacggttttcacaagggttgctggtcaccaccaaaatgaaaagtttgcagtgagagggaatgaaccaaaggatgaagttcagatttacacatggaaggatgccaccctccgcgagctcactgatcttgtcaaagaggttgctcttccagcaagaaaaaggaatgcaaggctttcttttgcatttgtatacccagacaagaatgggcgcttcgttgtcagacacgtgggttcgacc

SEQ ID NO: 71504 - DNA, 339 bp, Zea mays
  Clone ID: LIB3078-030-Q1-K1-D2
cttgctgtcgccgcctctctccgcgcgaccgatctaccgccgccgccaccatgtcgctgagcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggccaaccctaggcagttcaaggtgccggactggttcctcaacaggaagaatgattacaaggacggaaggttctcac

SEQ ID NO: 71505 - DNA, 459 bp, Zea mays
  Clone ID: LIB3078-030-Q1-K1-D3
gtgttgttcggagcgggcagcagcacacagccccatcccaatcctagtcgatcttcttcgcctcctcaaggaagaaaagaagctgaaccatggggaagagaaagtcagctgctaagccacctcctaagaagcggatggacaagcttgacactgtcttttcctgcccattctgcaaccacgggagtagtgttgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtcaacactgttgaaggcgacgatgatgcgtgagcttgccccatgtgatgaaactgttacctacaatcgtaatgtaatgtgctggtattctcgaatgccatagcccatagtcagccatggcttggaataacgt

SEQ ID NO: 71506 - DNA, 433 bp, Zea mays
  unsure at all n locations
  Clone ID: LIB3078-030-Q1-K1-D5
gtcggccgtctctaggtcgtcggcgaggaaggcgcccttcgtcgtcagggccagctccaggcctccagccaagcaaggtgccgacaggcagctgtggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctaggcgcggtgggcgccatcgccccggagatcttcggcaagatgggcatcatccccccggagaccgcgctgccgtggttcaagacgggcgtcatcccgcccgcgggcacctacaactactgggccgactnctacacgctcttcgtcttcaacatggcgctcatgggcttcgccgagcac

SEQ ID NO: 71507 - DNA, 426 bp, Zea mays
  unsure at all n locations
  Clone ID: LIB3078-030-Q1-K1-D6
cccacgcgtccgcgggaagccagttgtcctcagtccgaaggccagcctgctagaatactgcgagaagggttctgggtcactgacagtggtcttcaaagatttagggccacaggtctactacagcacactgttcttcttcgagtacctgggtcctctcatcatctaccccatgttctactatctgcccgtctacaagtacttcgggcacgagggggagcgggccatgcaccctgtccagacctacgcaatgtactactggtgcttccactacttcaagcggatcatggagacgttcttcgtgcaccgcttcagccacgcgacgtcgccgctctcgaacgtctttaggaactgtgcctactactggaccttcngcgcttacattgcttactactgcaaccacccgctgtacaccccagtgagtgatct

SEQ ID NO: 71508 - DNA, 333 bp, Zea mays
  Clone ID: LIB3078-030-Q1-K1-D7
acgcctcacgcgttcttcggagcgtggcctatgcacacatgttccattccagtcctagatgatcatcttggggtccggagggataaaaagaagctcggccattgtgaagagagatgtcactgacctgccaccatctaagaagcggatggcctaacgagacactgtcattttcacaccattctgtaaccaccggactagtgtgtaaagcctaattgacattacaactctgaatcgcgaaccatctttggaaacatgtgacgaaaacttgatcacaactgttgatgcgcctactgagccgcttgatctatatatggaacggagagatgcatgtta

SEQ ID NO: 71509 - DNA, 266 bp, Zea mays
  Clone ID: LIB3078-030-Q1-K1-C11
ccggccggacgcacgcgttctgccagaccaacaacgacattaatgagctttttctcaacgacatcaataacagcacacatcgccatgctctacatactggggtacttcatccaagtgctcctcacctgccttaatcctttccaaaacctcctcgaccacctcgacgatcccatacacaacaacgtactcaccagcctaaagttccactataacctagtacatcaacatacctgctgattcccacaccgccttcaatagtttgctct

SEQ ID NO: 71510 - DNA, 270 bp, Zea mays
  Clone ID: LIB3078-030-Q1-K1-A7
cccacgcgtcccctatcaccacgtcaagaactactggaacaccaagctcaagaagaaggccatgggggccaggagcatccgaacatacttcgcggcgcccgccacgccggcgctctcgcccggctcctcgtgcgtcaccagctccagcggcgacttgcgcctcggcgcgaagtacaccgagccggcgccgactcggcagtaggcccggctcgtacgctctggcgctacgcggaccgagctcgcgcccgtgccggcagtcgcgcacctgga

SEQ ID NO: 71511 - DNA, 378 bp, Zea mays
  Clone ID: LIB3078-030-Q1-K1-A8
ttggcttgtcctccccctccggttcgggttcgggttcgtgaggttctccggggttcggtggcgtgggtgagcggatcgagatggcggcgtcggatgttgagtaccgctgcttcgtcggcggcctcgcctgggccacggacgaccactccctgcacaacgccttcagcacctacggcgaggtcctcgagtccaagatcatcctcgatcgggagacgcagaggtcccgcggcttccgcttcgtcaccttctccacggaggatgcgatgcggaacgccatcgacggcatgaacggcaaggagctggacggtcgcaacatcaccgtcaacgaggcccagtcccgcggcggccgtggaggcagcggccgtgggtactgtggtg

SEQ ID NO: 71512 - DNA, 462 bp, Zea mays
  Clone ID: LIB3078-030-Q1-K1-A9
tctggatcgaggtgcttgtgatcggctacatcgagttccagcgcaacgccgagctcgacgcggagaagaggctgtaccccggcggctcctactttgacccgctcgccttggcggccgaccccgagaagaaggagcggctgcagctggcggagatcaagcacgcgcgcctcgccatggtcgccttcctcggcttcgccgtgcaggccgccgccaccggcaaggggccactcaacaactgggccacccaccttagcgacccactccataccaccatcttcgacacgttcggaggatcctcttaagcccgccattgatccgctccgtccatcgatcgaaacgtggtcttgaattaactatgatagatctctatgagcctggagatggatcaacccgtcgtgcgttgtttcattttgtgatgaatgggagagagggtatgggacaagattgatcaacccgtcgtgc

SEQ ID NO: 71513 - DNA, 452 bp, Zea mays
  unsure at all n locations
  Clone ID: LIB3078-030-Q1-K1-B1
ggcgcaccggatcacggcgggcgcggacatcctgctgatgccgtcgcggttcgagccgtgcgggctgaaccagctctacgcgatggcgtacgggaccgtgcccgtggtgcacgccgtgggggggctccgggacacggtggcgccgttcgacccgttcaacgacaccgggctcgggtggacgttcgaccgcgcggaggcgaaccggatgatcgacgcgctctcgcactgcctcaccacgtaccggaactacaaggagagctggcgcggcctgcaggcgcgcggcatggcgcaggacctcagctgggaccacgccgncgtgctgtatgaggacgtgctcgtcaaggcgaaataccagtggtgagcgaattaattggcgacgccgacggcggtcctgtcgcaggacctggacgttatttagaaggctcttcttcctggcggctttgatgcgtgcg

SEQ ID NO: 71514 - DNA, 366 bp, Zea mays
  Clone ID: LIB3078-030-Q1-K1-B10
acgacacgacaccaagtcgaggagctcgagggcaccaatcatggccggcgtgaactccagggtcgtggggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtg

SEQ ID NO: 71515 - DNA, 427 bp, Zea mays
  Clone ID: LIB3078-030-Q1-K1-B11
gccggcatcggcagtgcaggatggctctgaggatgtgggcgagctcagccgccaatgcggtcaagggctcggcgggcggcgccggagcccgggctgctgccttctctatctccaggttcttctccactgttcacgatgggttgaagtacactcagtctcacgaatgggtcaagacgacgggcgacgtcgccaccgttggcatcacggaccatgctcagggccacctgggagaggtggtgttcgtggagctgccggaacccggcacgaaggtggccgcgggaggacccttcggcaacgtggagagcgtgaaagccaccagcgacgtcaactccccgatctccggcgaggtcgtcgaggtcaatgccaaactgtcagagacgccccgcctgatcaacacgagcccgtacgatgactggtggatgatcca

SEQ ID NO: 71516 - DNA, 384 bp, Zea mays
  Clone ID: LIB3078-030-Q1-K1-B2
gatgcgccatctgtggggctatcacgcacgtcgcccccgcccctcctgtcgagcccaaccgcggtgccgtacagccgccgccggggtggggtccaccgccgccgccggtgcacgggcgaaagcgagccgtggtgtgcgggatatcgtatcggcactcgcggtatgagctgaagggctgcatcaacgacgtcaagtgcatgcgccacctcctcatgacgcgcttcaacttccccgacgactccatcattatgctcaacgaagaacaaaccgacccctacaaaatcccaacaaagcataacatagggatggccatgtattggcttgtgcaaggttgtcaacctggagactcattggtgttccattattctgggcatggagcacagc

SEQ ID NO: 71517 - DNA, 455 bp, Zea mays
  Clone ID: LIB3078-030-Q1-K1-B3
gatttgttgatttgactatggaacataagggggagatgaaggttgtggtcaggacagtgatttcagtcaccaaggaggaggagaaagaactcaaggaaaccttgcaggatatccttggggaaaacaaaactattttggttgaacagaagattgactacagcatcatgggaggattagtgattgaattcgggcagaaggtgcttgatatctcaatcaggaacagggcgaagcaaatggaggcgttcttgaagcaaccacttgacttctaacagccttttggataaaagaagcatcatcggaatgcataggctgtcctgttgaaagttttcctgtgtctgcaattttaatcttggccttttgaataaaatgtttcctctaacaagtgaaaggcactgttttaatgtctcgtgggccacagatgcctgctgaacaatttatgttcatttcttcttttc

SEQ ID NO: 71518 - DNA, 456 bp, Zea mays
  unsure at all n locations
  Clone ID: LIB3078-030-Q1-K1-B4
cttggtgtttgtggactgtaaggatggtatcatattaactaggcagtagaatgatagatggaggatatctgagttagtttgacctctgcgctgtaatgttatttttagaaggtaaggaaaccaacagggctaatttcaattatataacatggtgtcattgaaattcaatttattgtgctctaaatttgtaataaagtgattttagtttgtttcttatcgcagttctcctgcgtacttgaggaaaaaggaacttgtcaggataaattgtccacaaatggttcctgcttctgcagtttccactaattagcagtaagtagtttattctataattgcattgaagcttgaacattgantttggttgggcatgcagtaagtagcttacaagaacatggcttagttgggatactgaaatgcttcatcaatagctctaaacctgccacaaattacttgacattc

SEQ ID NO: 71519 - DNA, 445 bp, Zea mays
  unsure at all n locations
  Clone ID: LIB3078-030-Q1-K1-B5
gtccagatggacgatccaatacaagcaattgggacatacaatatatcggagaagccacggtctggcctttgctagtgcagatgcaccacaaggcaaaagaagctcaggtgagaatgttgtgatggttgatccactggaagctaagcgcctagctgctaaacaaatgcaagaaattagggccaaagaaaagctgaagaggcgccgtcaagcagaagcgatcaacggggcattggcagtgataggactcacggctggattgctagtggaggctcagacaggaaaggacatcttanggcagctagctggatatctgacggctatttctagtttatttgggcaataacactggaccatggttggagatttatttttcacgttccacggccaggagaggtcttatctgaatcttatttgatggatccacctcaattttttgggagctgat

SEQ ID NO: 71520 - DNA, 185 bp, Zea mays
  Clone ID: LIB3078-030-Q1-K1-B7
gtattttacatatttacatagccgtggttatgaacattatcttcaaaacaccgggttcaggctcccttgtggatgaggtcgagctcaaccacatactgcgggctatacttgctgactacgatgatattatggtcttacataaggctgacttcattattgatccaagcctagtgtatggattctgt

SEQ ID NO: 71521 - DNA, 389 bp, Zea mays
  unsure at all n locations
  Clone ID: LIB3078-030-Q1-K1-B8
gctcaaacagccaatagcaggagatgattatcgcacatggcttcgtaggacagcgtgcttgtgtgataggcaattttgatgcaaactgcagtgatgattggatgaaaagagttggtagtgataaactcttctacgaactacatacagcaaggggtctggagcaaaaaaatgtgccgttccacatctgtaacctcgtttttaagctattgaaagttgagtcagtgaactggacgtttttgcaatagcttagcatatgcactaggcgactttattagccatttttttttgttgttatacggcttttgtattcttggaagccttangcaagatatctgatggtggaatcaggtttagacttgacatttcttgcacaaatgctgcaccatgca

SEQ ID NO: 71522 - DNA, 328 bp, Zea mays
  Clone ID: LIB3078-030-Q1-K1-B9
cgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccat

SEQ ID NO: 71523 - DNA, 396 bp, Zea mays
  Clone ID: LIB3078-030-Q1-K1-A6
cccacgcgtccgcccacgcgtccgtgacgggcgagttcccgggcgactacggctgggacgccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggca

SEQ ID NO: 71524 - DNA, 396 bp, Zea mays
  Clone ID: LIB3078-030-Q1-K1-C10
ggaaggtgttgtagttggtggtggatgtagcctactaagactgtcagagaagattgacgcgatcaaggaatcatcgttggataatatagagcaggaggttggtgctgacatcttcaaacaagccttgagttaccctacctcactaatagcaaaaaatgcaggggtgaatggcgactttgtcattaaaaaggtgttactgaatgatgatgcaaattatggttacaatgctgccaagaactgctatgaggacttgatggctgctggaatactggacgcaacaaaggttgtgaggtgttgcattgagcatgctgctgtagttgctaagtcctttctcacctctgatgtggtgattgttgaagcaaaagaaggcaaacctattcgaataagacccccaat

SEQ ID NO: 71525 - DNA, 347 bp, Zea mays
  Clone ID: LIB3078-029-Q1-K1-H10
caattcctgacaacgtgggtcaaaaacttattggccttgttacaagtagagatgaaggcgctgatttactaaagcttgatgatgtcattgatcttgtcattccaagaggcagcaataagctggtttcgcaaatcaaagcatcaactaagatacctgtcctcggtcatgcggatggtatttgtcatgtatacattgacaaatcagctgacatgaatatggcaaaacgaatagtgatggatgccaaaactgattacccagcagcctgcaatgctatggggacattgcttgttcataaagaccttataaaggctccaggtcttgatgatatactcctatcactcaaaaca

SEQ ID NO: 71526 - DNA, 300 bp, Zea mays
  Clone ID: LIB3078-029-Q1-K1-H11
cttcgacaacgtcggccgctggctccattagctcaacacacattccgacacgacggtggccaagatgctggtgggcaacaagtgtgacctgtgcgacatccgccaggtgcccgtggaggaaggcaaggcgctggccgaggccgagggcctcttcttcatggagacgtctgccctggacgccaccaacgtgaagacggccttcgagatcgtgatcagggagatctacagcaacgtgagccgcaaggtcctgaactcggactcgtacaaggccgagctgtccctcaacagggtgagcatcga

SEQ ID NO: 71527 - DNA, 269 bp, Zea mays
  Clone ID: LIB3078-029-Q1-K1-H12
ctgacacatcgttcgacactctctaccttacctaaacacgccttccatcactactatggccggcttccttttgcgccaccgcatccaaaaaaagatagatacaacgcgctccaggagctgaaggccaaggcccagacaggcccaattggatgctctggtttcataaaaagtgcatagaaatgagcattggccacccacccatttgctaaacacctaatagaacgattagacagctggtgacacgtggtgcgctccactatatgatatat

SEQ ID NO: 71528 - DNA, 371 bp, Zea mays
  Clone ID: LIB3078-029-Q1-K1-H2
gccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggcgccgccggtgacctttaggtgtcccggatgcatgtgagcgcacgcctgttttc

SEQ ID NO: 71529 - DNA, 378 bp, Zea mays
  Clone ID: LIB3078-029-Q1-K1-H3
ggacggctataaagacgaggcccatctcgaaatccacggcgatcaataagacgggtggccctctcctgatcgtggtgtgcctcacagcagcatccatggcggtcgagccggagaagcatgcggcccccgcggcacaggtgacggccgtgcacatcgtgtacgttgaccgccccgaggacgccgaccctgaagagttccacatgcgcaccctcacccccgtgctcggcagcgaacagaatgccagggacgcattgctctaccactacaagaacgccggcagcggcttctccgagaagctcaccccccagcaggtcaaggatctcacagagcaacccagtgttcttcatgttgtgccgagccagacttaccagctacatg

SEQ ID NO: 71530 - DNA, 231 bp, Zea mays
  unsure at all n locations
  Clone ID: LIB3078-029-Q1-K1-H4
acgcagttcctatcaacattcaccataaactcttcatccatactactcccacctactaacagtgtcatttacaagacatatggctctcaaaatantccacacctcacacaatcacaaataatctccattatcccctcactacaaaacctcccttacctccactctattattactatgctataaacaacctttacaattgctaactcgccaactcaactctaacaacccctt

SEQ ID NO: 71531 - DNA, 297 bp, Zea mays
  Clone ID: LIB3078-029-Q1-K1-H5
accgtccggattccaggtggcgtacgtcgtcccgttctactcctactcccgtgtgtgccttttcttaaccctgatcctgaaacggcgcgaggcctttaccgtgcgcaacagagtctcaattgtcccagactactacaagaccaagtacaccagcatcgggtccgccatcgagtacaccgtgtgcgccctcaaagaggaagtccttgtagtcatccaacacaactactgcctttgcattcgggctctggtattactacaggaccgtgcacccgacaactttcacttcggactgaaact

SEQ ID NO: 71532 - DNA, 371 bp, Zea mays
  Clone ID: LIB3078-029-Q1-K1-H6
gaagaagaaaaattctaatgtcccagctgggcttttctttcagcatgctggtcataggtttggggtctgtgtcagatgcaaaaactaacccttcacactcatgcttctatttttaccatgcatttcataattcatgttgtacatgtcggcagggataatatcgtagacttccactggaattcgtcagatccttggacaattgtcagtgtctcagatgatggtgaaagcactggtggaagtggaacactgcagatatggcgaatgagtgatttgatctaccgcccagaggatgaagttcttacagagctggagaatttcaaggctcaacctgccagttgcgctccgaggaattgagtcatgtgaaaactctg

SEQ ID NO: 71533 - DNA, 208 bp, Zea mays
  Clone ID: LIB3078-029-Q1-K1-H7
gcatattatgcttcggtgctgatggcacagaaaattgcaaaggaaaagggttattctgatgtcggctacttggacgctgttcacaagaagtaccttgaataagtattctttatgcacatgtttacgacgccaaggactatgttatttctaccccagcaataaaaggaacaatattacctggtatgacatggaaaagcatattctacgt

SEQ ID NO: 71534 - DNA, 57 bp, Zea mays
  Clone ID: LIB3078-029-Q1-K1-H8
ccgaggactgcggtctataatggaggacattctgacagaacaatgtttgaattctga

SEQ ID NO: 71535 - DNA, 413 bp, Zea mays
  Clone ID: LIB3078-029-Q1-K1-H9
acgacgacgacgaggaccagatggaggttgacctcgagaagcttcccagcaacactggcgaccctgacaagctcgccaagatgaatgctatactgtcccagtttacacaacagcagatgaaccgttatgagtcattccgaagatccggatttcagaaatctaacatgaaaaggctattggcaagcatcactggaagtcaaaagatttctatccctacatcaattgtggtatcaggaatagcaaaaatatttgttggtgagctaattgaaacagcaagagtagtcatgagtgagaggaaagattcaggacccatcatgccttgtcacatcagggaggcatacagaagattgaagcttgaagggaagatcccacggcgctctgttcctatgctcttccgctagaactgacacaca

SEQ ID NO: 71536 - DNA, 334 bp, Zea mays
  Clone ID: LIB3078-030-Q1-K1-A1
cggacgcgtgggtcttaaggctgtcagcaatgtaaataacattattggaccagcaattggtggaaaggaccccactgagcaggttgagattgacaacttcatggtccaacagcttgatgggacctccaatgagtggggctggtgcaaacagaagcttggagcaaatgccatccttgcggtttcacttgcggtgtgcaaagctggagctatggtgaagaagattcctctttaccagcacatcgcaaatcttgctggaaacaaaactatggtgctccctgtacctgcctttaacgtgattaatggagggtcacatgctggaaacaagcttgccatg

SEQ ID NO: 71537 - DNA, 192 bp, Zea mays
  Clone ID: LIB3078-030-Q1-K1-A10
ggcgaagaggactctgtcttccactgcccagaccacgattgagattgactcgctgtatgagggcatggacttctactccaccatcacccgtgccaggtttgaggagctcaacatggacctgttcaggaagtgcatggagcctgttgagaagtgcctgagggatgccaagatggacaagagcaccgtccatga

SEQ ID NO: 71538 - DNA, 440 bp, Zea mays
  Clone ID: LIB3078-030-Q1-K1-A11
gccgccgcaccagcaatcacagcagcccggagaacgccctggtccaacaagatgcagatgttcgtgaagacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgcttaggctccgcggtggaatcattgagccctctctgcaggcgctcgctcgcaagtacaaccaggacaagatgatctgccgcaaatgctatgcacgactgcaccctagggctgtcaactgccgcaagaagaagtgtggtcacagcaaccagctgagggccaagaagaagatcaagaactg

SEQ ID NO: 71539 - DNA, 416 bp, Zea mays
  Clone ID: LIB3078-030-Q1-K1-A12
cccacgcgtccgggcgccgcttctccaacatcgtctgcaagaaggccgacatcgacatgggcaagagggccggtgagctgacgcctgaagagctggagcgcctgatgacggtcgtggcgaaccctaggcagttcaaggtgccggactggttcctcaacaggaagaaggattacaaggacggaaggttctcacaggtcgtctccaacgccctcgacatgaagctcagggacgacctcgagaggctcaagaagatcaggaaccaccgtggtctgcgtcactactggggcctccgtgtccgtggccagcacaccaagaccactggcaggcgcggaaaaactgttggtgtcttcaagaagcgataagctacatatctatcgacaaatctcagatgtactagtggtggttcatgttcaaac

SEQ ID NO: 71540 - DNA, 334 bp, Zea mays
  Clone ID: LIB3078-030-Q1-K1-A2
ctccgccgccgaccgacgctacggctcagtgcatagcccgccgagacctcatcgatcaccgttaacggtcaatcatggcggacgtcgatgcctaaccggatgttgcctgctgagctcccaagaagaggacgattctcaagtgcagctaccgttgcgacgacctagatgcgctaatcgacatgtccacagacgacctcgtacagtttttcactgctcgctccattagaagcgctcagaggggcctgaagaggaagcccatggcgcttatgcagaagctgcgcatggcgcttaatgatgctactgctggtgagaaaccatagccagtgaagacaca

SEQ ID NO: 71541 - DNA, 337 bp, Zea mays
  Clone ID: LIB3078-029-Q1-K1-H1
cccacgcgtccggccagctccagccctccagccaagcaaggtgccgacaggcagctggggttcgcgtccaagcagtccctctcctacctcgatggcacgctgcccggcgactatggcttcgacccgctgggcctctcggacccggagggcaccgggggcttcatcgagcccaagtggctggcctacggcgaggtgatcaacggccgctacgccatgctaggcgcggtgggcgccatcgccccggagatcttcggcaagatgggcatcatccccccggagaccgcgctgccgtggttcaagacgggcgtcatcccagccgcgggcacctacaactact

SEQ ID NO: 71542 - DNA, 353 bp, Zea mays
  Clone ID: LIB3078-030-Q1-K1-A3
cgtgcacgtacgcacgcaccgggacaccagcaacccccaacagcgccactgtccagtgcgcgcgtgaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgctctcgccctacaacccgtacagagcaagttcttcgagacg

SEQ ID NO: 71543 - DNA, 360 bp, Zea mays
  Clone ID: LIB3078-030-Q1-K1-A4
gctatagaccagctcgcttttactactacacgctacacttaggctggacatccatatcatagctcgtcggaatatgcatgagggacgagaatcaccgataccaccactctgttacagcagaggaagagacgaggagcaattcgacgcctgaacgtcagtgagtgcaccggctcaccatggccacagcgacggacgaggtgtccacgggcgagaacgactcgacgagtactacagtgatgagcatgaacgcagccgctaccagcacctcggccacgccgatggcatcggcggctacggcttcggactctactacaagcacgaggcgaagaacgacccggagcacgcgcacctacacaagat

SEQ ID NO: 71544 - DNA, 311 bp, Zea mays
  Clone ID: LIB3078-030-Q1-K1-A5
ctcgaatctggcttaaaaggtctagatgcagggatatcatcacagtgcgcttctgccagggacaactggcagccttttactttaataacattacatctggtgactcacctccatcaccagcttcagtaaatctcgcacgacatattggagagtgtcccaatttgtttcctcagatactgaagactctttttgagatcatgctctttgaagatgctggtaatcagtggagtctgagtcgaccaatactgagcctgataatgaccagtgaacagatgttcagtgaactcagagcgcacatattagcatcacag

SEQ ID NO: 71545 - DNA, 384 bp, Zea mays
  Clone ID: LIB3078-029-Q1-K1-E7
atggggagaagctgctctactcttagctgctggcgctaaaggtaaccgtgccgcactgccatcggggacaattatgataaaacagccaattggtcgctttcaaggtcaggcaacagacgttgacattgccagaaaagagattcgaaatgtcaagatagaaatggttaagctgctggcaagacacatcggtaaaccaatggaagagattgctcgggacatcaagcgtcctaaatactttagccccagtgaagctgtggattatggcatcatcgacaaggtgatatacaacgagaaaatccacgatgattgcggcgtcgtgtcagaactcaaaagatcaaatttgatatagtgttctttttacacaagtagacacgtctatgcatg

SEQ ID NO: 71546 - DNA, 362 bp, Zea mays
  Clone ID: LIB3078-029-Q1-K1-E8
gctggattctaccgcaactccttgcttcccaagggcaaggctgcgcttctaaccccagcagtccacaagcaaaatacaatagtggcatctgagaatgaaaatccacctttaatgccggcaatcatgactcctggtggtgcgcttgatctcgcaactgtactactgggaaatcgtataatcttcattggccaatatattaactcccaggtggcccaacgtgtgatatcacagcttgtaacacttgctgccatcgatgaagaggctgatattctgatatatcttaactgccctggtggaagtctctattcgatcttagcgatttatgattgcatgtcctggataaagcccaaagttgggacagt

SEQ ID NO: 71547 - DNA, 362 bp, Zea mays
  Clone ID: LIB3078-029-Q1-K1-F10
cggcgaggtgggcgccctcgcgggcggcgcctttgctctgtacgaggggcagcgtgcgaagaatgacccggcgaacgcgcataggcacaagatcgaggccggcgtggcaacggcggcggcgctgggcgccggcggctacgcgtaccacgagcaccgtgagcagaaggaggcccactacgagagcaggcagcatgagcacagggtgccgcacgggcacggtcacgggcacggctactcctactactgcgactgaaacgactgatcatcccatcgatcgagatatgcatgcagaactcgatatatatacggcccctatcgccgtacacgtgcgtgcgtgtaagtaaataagagcaaacgtcgtc

SEQ ID NO: 71548 - DNA, 255 bp, Zea mays
  Clone ID: LIB3078-029-Q1-K1-F11
cccagcgttcgcctttccccttccctccctggctctccacacgggccgtcggaggcgatttcgccctcgattggaccccgattactccgaccgcgaccgggattccctgctccaagcgcggatctgaacgctgcgctccgtgtcgccgatcgaatgcgccatgaacgggggcaaatccaagggcgccgccaaggccgatgccaagctggcggggaagagcaagggggccgagaaccccaccaagggcacgaaaag

SEQ ID NO: 71549 - DNA, 220 bp, Zea mays
  unsure at all n locations
  Clone ID: LIB3078-029-Q1-K1-F2
cccacgcgtccggtcaagtggttgcagaccatcaccacgctgccgatcctcgtcaagggagtgctcaccgctgaagacacgaggcttgcggtggcgaacggcgcggcggggatcatcgggtcgaaccacggcgcgcggcagctggactacgtgccggcgaccatcancgcgctggaggaggtcgtgaaggcccgccggggccagcttcccgtgttcgtcg

SEQ ID NO: 71550 - DNA, 354 bp, Zea mays
  Clone ID: LIB3078-029-Q1-K1-F3
gtttcattgattcttgaagagatcgagcttcttttgcaccacaaggtccaggatgtcgggcaactgcggatcaagctgcggctgctgctcaagctgcaagtgcggcaagaagtaccctgacctggaggagacgagcaccgccgcgcatgccaccgtcgtcctctgcgtggccccggagaagaaggccgcgcccgagttcgtcgaggccgcggcggagtccggcgaggccgcccacggctgcagctgcggtggcaactgctagtgcgacccctgcaactgctgatcacatcgatcgacgaccatggatatgattattatctatctagcttgcggtggtggttgaacaataataag

SEQ ID NO: 71551 - DNA, 224 bp, Zea mays
  Clone ID: LIB3078-029-Q1-K1-F4
acgcggacgcgtgggttttgataaacaagcttcatattcttaaacagataccataatattgtgggagaagataatggggcacaacacatcctaaccgattacaaagttcaccttgagaaaattgcaaaccaaacaataattccaactcaaacgataacaactaattgtccctcactgctcctcttcgatcacacccttgtcgctcacatagataccatccaaaa

SEQ ID NO: 71552 - DNA, 379 bp, Zea mays
  Clone ID: LIB3078-029-Q1-K1-F5
cttttgaagaagcccgagcagcaggattcaccgaagagagtgggacgctgggtgatagatgggagactgtatcaaacagtgatcttgttttgctactgatatctgattctgctcacgctgataactacgagaaaattttctcgcacatgaaaccaaacagtattcttggtttgtcacatggatttctccttggacatttgcaatctgtgggttttgatttccctaaaagcatcagtgtgattgctgtatgccccaaaggaatgggcccatcagtcagaagactttatgttcagggcaaagagatcaatggtgctggtatcaatgctagctttgctgttcaccaggatgttgatggaagggcaacagatgtagctctagg

SEQ ID NO: 71553 - DNA, 208 bp, Zea mays
  Clone ID: LIB3078-029-Q1-K1-F6
acgcgtatggatggacttgctggagaccgttcggaccatcaagaacctgaggtcgtactcggtcaggatcagggccttggaggtcgagtaatgcctgtagaaagtcggtgaggacgccctaacctagaagatgacgacagccatcgcggagcttaccacagacattggtaacaaggtgctacatggaccgatgcagcacctgaggtgc

SEQ ID NO: 71554 - DNA, 332 bp, Zea mays
  Clone ID: LIB3078-029-Q1-K1-F8
ggttgctctagatccgttcatcctggtggttttgtgaggtcgaaagcggcgagcgagttataagaggcttgacaagctgtgggacgacttggtggccggtcctcgcccggagacgggcctcgagaagctccgcaaggccaccaccgcccgtccgctcgtcatcaacaaagacgcggacggcggcagctacaagcggtcgcagtcgatgccgtcgaccccgacgacgccggtgacgccgtcgtcgtcgtcgtcgtcgacgacgccgcgcggcgccggcaacgtgtggcgcagcgtcttccacccggggagcaacctggccaccaaatggcatg

SEQ ID NO: 71555 - DNA, 377 bp, Zea mays
  Clone ID: LIB3078-029-Q1-K1-F9
ggcaccctctttggttggtcaaatgaccctcagtattcattttaccctggtggcttgtgacatccacgtcaagaggctgaaaattgggatggaacttccactagttacatggctactgctactgggggatacaaagtattttcccagggaacaacttcagacatgaggggtggtatggcaggcacattgctccaacagccaataatgtcaactcatgatagatggactgatggaagcagcgattctggaaggaactgccctcaagttgacatttcgtaccgcatgtacagcctattctagcaccatggcgagaggtctgcttcctagaccctaacaacagacatgtacaagtcataccttctaacctagtagatgcc

SEQ ID NO: 71556 - DNA, 361 bp, Zea mays
  Clone ID: LIB3078-029-Q1-K1-G10
gagcaaagttcggactccagccatggctgtgttatgtatggcatgcagtcagggtagggatgctttttcacagtctggcctgtattcaaatcaccaagacataggaccacgttatgcgggggtacttctcggactgtcaaacactgctggcgttctggcaggagtttttggtactgctgccactggctacattcttcagaaaggttcttgggatagtgtgtttaaggtgtctgttgtgttgtacatagtaagaacggtggtttggaatgtcttttcaactggagagaaaattctcgaataagctgtggacattcctatatgccactatacggaactgtgtgattttgatgatgtcattttg

SEQ ID NO: 71557 - DNA, 356 bp, Zea mays
  Clone ID: LIB3078-029-Q1-K1-G11
cacgatctcgtcgtcgacccacgttgtgcccacgacgtgctcgtcgactttgatgaggggatttccaatttcgtgctgcttatgtcgaccctcggaactcctcgtcgtactcgaccccgcaagtctccatctcgtcgtcaatccgtgcgtcagcaagaaatcccaagaatcgggtgaagacgaagctagcagcgcgatattccccaagcgctcgacaaattgcctggatcggaaaatcgctaccgatctcgcggattcgtgtcagctgctgaagcggtgcgataattaatcacgtgatgcggaagatgactcaagtcgaccccaagcgcgggctactccgcatggtgatgctgatg

SEQ ID NO: 71558 - DNA, 351 bp, Zea mays
  Clone ID: LIB3078-029-Q1-K1-G12
cccagccaatcaacaagagcgattgaggggtcatatatagtgcttccacctgctgccggttccatatacaggacatctgcctctgaaagtggtgcacagctcacaccatcaggtgtaatctccagttgcccctcgctgggaaacaattctgggtttcactctagtgttactgtgctgaaaacgagccttgagattgctagctcgcaaactcatgttgaacagccactttgtctggaatgtatgacggttctttctgataagatggataatgagattgaagatgtttatgctgatattaaagcttatgaggcttggcttcaacgtttggagcacgaaccctacaacatactc

SEQ ID NO: 71559 - DNA, 167 bp, Zea mays
  Clone ID: LIB3078-029-Q1-K1-G2
ggactaccgagctttctgtttggccaatctatgggtggagcagttgcattgaaggttgacttcaagcaaccaaatgaatggaatggtgcaatactggtggcaccgatgtgcaagatagcagacgatgtggttccaccttggcccattcagcaagttctaatttttat

SEQ ID NO: 71560 - DNA, 284 bp, Zea mays
  Clone ID: LIB3078-029-Q1-K1-G3
gtgtacccgcgcgcgcagcacttgagacgcgccaaggagtgcccgcaggaggcgactatgagggccaagtggaagaataagcgcatgaggaggctgaagaggaagcgccgaaagatgaggctgaatccaagtaggctgatggggattgtggatggtggtgtcggcatagttgtgtaacgtacttcgatgctggttcatggagagatgcacatcctagttcgtcgtcacgattgccatgggtgcaatggctcgtctaggaaacctgcacttcaataagccatgta

SEQ ID NO: 71561 - DNA, 158 bp, Zea mays
  Clone ID: LIB3078-029-Q1-K1-G4
gacccacgcgtacgcccacgcgtacggctccgtggcctggtggcccttaccccgctggccctgccttccggtcgccgcgacggtgccgagggggctgccccagcaccacgcgcgcggggtccgaccgcgagaggggcgggggtcgaggcgcttgcggc

SEQ ID NO: 71562 - DNA, 348 bp, Zea mays
  Clone ID: LIB3078-029-Q1-K1-E6
gccgcatcatggaccacgaggacggccccttcaacccggagaaggtcctcatggcggtgaagacgtactggaccgccgaagcggaggaggagcactagcagacgagtgacaccgagctcactagaaagcgtgaaccaagcctgttctactaccggccgagagggatggcgtcagggttttgcgtctcagtgtagtatgtatgtccctttcaccttttctatagttctttgtagctagctacaatcagatgggaaggtaagggagagttttgagaagaggggggggggggggtggcctctagttgagatacaggaagcggttttgtagcaggggaaggtttcgctggtc

SEQ ID NO: 71563 - DNA, 353 bp, Zea mays
  unsure at all n locations
  Clone ID: LIB3078-029-Q1-K1-G6
gagagacacatgtactgctgcttattatcccatggatggaatgatggatgcatctgatccgatcaccggccgtctgccgaggtgaaggactcggcgaagccggcggggcgggcggggatgctgcccttgctgtcgtccaggctcatgacgctcccgccgccgtccgtcaggccgccggcctccgcgtcctgccagctcttcaccatctgcagcagcggcaggtgcaggtcgatgcccaagtagtcctcggcctcgtccttgacttggcgctggaaagatgaagctcaacaancttatggagaaatggaagagaagcattccttcaggaatgtgctgtcccgatcttgagatgc

SEQ ID NO: 71564 - DNA, 410 bp, Zea mays
  unsure at all n locations
  Clone ID: LIB3078-029-Q1-K1-G7
cgcgtacacatgattttcccaactattcccactattggggtttggtaatctgcctcagctggtgaaggtggaggaaatatcacaaaccattgattctgagaacttcacagtgcaaaactgtatcaagttttcaggacctttggctacaacctcagttgccactaatgcaaaatttgaaattagaagccccaagcgtgtgcagatcaaatttgatgaagggattgttggtacaccacagttgaccgactccattgtgctaccaaagaagtttgagttatttggacagaacatcgacctgagtccactgaaaggcatattttcttccatcgaaaatgcagcatcctcggttgcaaagaccatatctgagcagcctncgctcaaataccgatcaggacaaacaatgctgaatc

SEQ ID NO: 71565 - DNA, 400 bp, Zea mays
  Clone ID: LIB3078-029-Q1-K1-G9
ggcgtggtcactcgttggggtgtcacccgccttccccgcaaaacccacaggggtctccgcaaggttgcttgtatcggtgcatggcatcctgctagggtctcctatacagttgcccgtgctggtcagaacgggtaccaccaccgcaccgagatgaacaagaaagtttacaagatcggcaaggctggacaagagacccacgatgcctccacagagtttgacaggaccgagaaggacatcactcccatgggtggcttcccccactatggtatcgtgaagggtgactacctgatgatcaagggatgctgtgtgggtccaaagaagaaggtggtgaccctccgccagtccctcctgaagcagacttcccggctggcgctggaggagatcaagctcaagttcatcg

SEQ ID NO: 71566 - DNA, 368 bp, Zea mays
  Clone ID: LIB3078-029-Q1-K1-C3
acgccatctagggcattaacggcaaggagctggacggccgctacatcaccgtgggcggggcccattcccgcgggggccgtggaggcggcggctgtggttacggtggtggccgtggaggcggcggctactgcggtggcgggcgccgtgatggcggtggcggctactgcggtggcggcggctactgtggcggcggcggctacagtggtggtggcggctgctactgcagtggcaaccgtggcggcggctacggcaacttcgacgggaactggaggaactgagcggtggtgcccgcgcggccaaattatcctgttcgctaccgtgatgtttaccctagtccagacggtttatcttcggtcgtgtcgtgtttg

SEQ ID NO: 71567 - DNA, 358 bp, Zea mays
  Clone ID: LIB3078-029-Q1-K1-C4
cccactcgtccgcggacgcgtgggcgacgaggcgcgcctgctcaaggcctacggggagcttcctgacacgctcaggctcaacgagggcgtcgacgtcgatgggcccgaggaaggcgaggagggcagcgactacatccagttcgaggacgaggacatcgacaagatctaagaaatctgttcctgcttacggctacctgtattgttacgtgacgcgttcttctgcttctgcttgcggctacctttattgttacgtgacgtgtactggtatgttgtggtatggtttagcctgggttatcttgtaaaaggatctgaagtggttaaataatcgggggtaatttcggttttaatctggtacatg

SEQ ID NO: 71568 - DNA, 328 bp, Zea mays
  Clone ID: LIB3078-029-Q1-K1-C5
cccacgcgtccggggggccaacatcctggtgggcggcgccttcgacggctcgtgcatgaaccccgccgtgtgcttggggcccgccctcgtcagctgggagtggggctaccagtgggtgtactgggtcggccccctcatcggcggcggcctcgccggcgtcatctacgagctgctcttcatctgccacacccacgagcagctgccctgcaccgactactaaaagccgaagccgaccgacccatgggtgcgcagcgcagcgcagctagcatccagcgctctcttcccgctcgccgacgtttagtttctctcgtgcacgtgcatgcatcgt

SEQ ID NO: 71569 - DNA, 388 bp, Zea mays
  Clone ID: LIB3078-029-Q1-K1-C6
ggcgaggctacgatcggacccgggtcttaagcggtaagcccaccggctcaacgagcaggctgcatatccccccaccccccacgcaactccatctcctctccgcctccacctgcacccatcgagcaccgaacggcggcggcatggaggctggtggcgaggagttcgcgatcggcgtggtgatctccgcgaagaccaccctgggggaggagttcgagggccagatcgtcgccttcgaccgcccctccaaccttctcgttatccaagatggcgtgggtagggcggagaggggggagcggaggaacgtgagggtcctcaaagcgaactacatccgggagttctccgtggtcagtaagggtgacgaccctctcgatcctgccagctgcatgct

SEQ ID NO: 71570 - DNA, 374 bp, Zea mays
  Clone ID: LIB3078-029-Q1-K1-C7
gctacgacgcgtgggccgagtgtgatatccatgatggctgaggcctatggtgacagcgctgcgaaggacgactgagaagcagaagaagatgacgagagtgccggggagagcagcatctctcttaaggtggtagtttccaaagactctggcccagagctcgagttcacatgcacagccttccgcgaggagatcaccatcgatgatatgctgatagtggagaaaacagacgacgacgaccgagaatagaagttcccctacgagggccccgagttcaccgagctccctgtgaatgttcagaaaggcctgttcaagtacctggagcaaagaggggtaacgctgtcggctaccaactatatgcacgattacatggtgac

SEQ ID NO: 71571 - DNA, 382 bp, Zea mays
  Clone ID: LIB3078-029-Q1-K1-C9
gatttttataccgcaatacctttggccgtttgaagactgaaaaggatttactgaatgggtgcggagcaaatatgattggagtcccaacattctattcaaaacttgaagaaagaatcaaaatacactcttgacaaagtagctatcggtgaaagcgatgtgcagcgtgggcgaactgatctgagatctactgggaagcagatacaatctcttataggttccatttacaaagcagaatctacagctgcaggtctgatggatagactaagaaccattccaaccaggcaatctctcgagctgcgagcagaggtggcttccatggcctccgatttgaagaaccagaggtgtgccttgcatgaaaggatcaacaaaatatctgaatatg

SEQ ID NO: 71572 - DNA, 257 bp, Zea mays
  Clone ID: LIB3078-029-Q1-K1-D1
ccatctccgtcaggtcggggttttcctggatctccatttcatcaacaagccagaactgtgcgttcaagccttccatcagccacccaagtttgacagcgatggaaatctggtcgatgctgaaatcagagagcggctcaagaaagtgctcctatcccttcaggccttcacgctcaggcttcagaaggaggactgaatcaactcggtaccattgtagtacgtgcttccctgagaagcgtttattgctcttggaagtttgt

SEQ ID NO: 71573 - DNA, 249 bp, Zea mays
  Clone ID: LIB3078-029-Q1-K1-D12
cggacgcgtggggaaggaaacaccgcctccgccgcgccttccattccagtactggcggaggaaaggaacaccagccagcgccatggtcacgtcgacgaccgccgccgccgtgctgtccccgccgtccgtggccgggcttcgcctggcgccgtcttcccgggcgcgcgtggcgttccgcgcggcgcctgcgcggctgtccgtggcggcgcgcgcagagctgatcccgtcgctggtgatcaggctgagcac

SEQ ID NO: 71574 - DNA, 387 bp, Zea mays
  Clone ID: LIB3078-029-Q1-K1-D4
cccacgcgtccgcccacgcgtccgcttttccacagctttggttcgggttcggctgctggggaggatcagtgctctctaagcctgctagacacggctctgccccacgcggccaacccacagtttgcttttcaaaagcagcagagggacttctgggaggatgccctacagaacgccttgcctaccggtagtgagcaaagacaggaggaggatgggcttttagtacccaactttgatggccagttacatgctgaccagacaaaggttgagttctagtccctggcgatcctcccaaggttgatatttttgtatataggtgggtaccaagacctgtggcaaacaaagctctctctctctctgtgtgtccgaagctgaccatcattagagtct

SEQ ID NO: 71575 - DNA, 320 bp, Zea mays
  Clone ID: LIB3078-029-Q1-K1-D7
acgccccacgcgtacggcgccaagctacccaccgacttcgggaagccgctcaccgtgcatctgaagaggctcgcggccgccggcaagctgacgagggtgaataactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaagcccaaggccaaggccaaggccaaggccaaggccaagcctgtcgctcctgccgccgcgtcgcccaagccccgcgggcgccc

SEQ ID NO: 71576 - DNA, 351 bp, Zea mays
  unsure at all n locations
  Clone ID: LIB3078-029-Q1-K1-D8
gcgttataataatgttctacttgatggaaaagctatgaagatagaagtcatcggaaatgacttangattgcctatgacacctcgtataaatgttgttggggcttctaatggcagagctacaagaacagttgttatgacgcctgagtttagtcaacgtggcagaggttcaagcagtagacctctaagcaacaggtttaataaccgtggtggtttccaagctggtcgaggccgtggccagttccagagctgggggagaggccgtggtcagttccagagccgggggagaggccgtgcccagttccagggacgagggagaggcatgaagcctgagaagactgcagatgagctgga

SEQ ID NO: 71577 - DNA, 386 bp, Zea mays
  unsure at all n locations
  Clone ID: LIB3078-029-Q1-K1-D9
cccacgcgtccgcccacgcgtccggcgccttcgacccgctcggcttctccaaggaccgggccaaggtcgaggagtacaagctcaaggagatcaanaacggccgcctcgccatgctggccttcgtcggcttctgcgtccagcagtcggcgtaccccggcaccggcccgctggagaacctcgcctcccacctcgccgacccgtggcacaacaacatcggcgacatcatcatccccagatcaatctccccttgagctcagctcagctgctggttgctgtttcctgtgtacgactaggccctgcctgtacaacgagcgacgactgtgacttcccgcccggaaattaaaccctcgtaatgtaaagcttatgttattaagtagcggctactc

SEQ ID NO: 71578 - DNA, 342 bp, Zea mays
  unsure at all n locations
  Clone ID: LIB3078-029-Q1-K1-E1
acccttccgcggccccttggcccggcagcgtcttcaacccgctcaacttcgcgcccaccctcgaggggaaggataaggagctcgccaacgggaggctggccatgctggcgttcctggccttcctgatccagcacaacgtcaccggcaaggggcccttcgacaacctgctgcagcacctgtccgacccatggcacaacaccatcatccagaccctgtcgggttgagtcgacggtccatcangtcatgtggtccgagctgaaaggccgagactcgaagacagttcgtgtgatgcgttcttaatcgactganggctaaggaatgtgacgtactggtatatgtaca

SEQ ID NO: 71579 - DNA, 365 bp, Zea mays
  Clone ID: LIB3078-029-Q1-K1-E10
cggacgcgtgggcggacgcgtgggcggtacgcgtgggctcgcggctgctgcggcggccgtggcagccatcggcggcgccggcgccgccatggcgggccccaagaacgggacccccgaggcgaagaagaagtacgcggccatctgcgtcaccatgcccaccgccaaggtctgccacaactgagcacgcccgcgttgcagctgcagggccggggggtggtatataattaatgtacgtgccacggtgttgttgtccctattgttggttcgagctttagatgcatgcctgacgtgaggccgcttaattgctttctgacggcctcggagctgtaagaatatcaagtgcactgcaaaactgaattcggttg

SEQ ID NO: 71580 - DNA, 209 bp, Zea mays
  Clone ID: LIB3078-029-Q1-K1-E3
gcgactcatcgagcgacagcatcacacactcagctagctaggagcaccatcaggggggcgggcaatggcagcctgcatgatctactcatcagctctggccgtggcgcctcacggccttccatcactaggccgccgcgcctcctccctactaccgctctactccaagaccatcatcaccatggaccagccctacggaattaacgccgtcc

SEQ ID NO: 71581 - DNA, 358 bp, Zea mays
  Clone ID: LIB3078-029-Q1-K1-C2
ccaacccttccggccttgggccaaaccctacgcagggagttgattgatcgattgcaggcatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaaatgaacaagaacaagaagcttgttaagaa

SEQ ID NO: 71582 - DNA, 296 bp, Zea mays
  Clone ID: LIB3078-029-Q1-K1-E4
cggaagctgcgggtcgcctccctcttccatgcagatgcaggaaaagaagctttctaaggacagcgtgaaagatttatcagctgatctacaaaaagtcatagatgactacatgaaaaagatcgaatccatccagaagcagaaggaacaagaactgatgaaaatttagacctcaagctgactgtatggctggtgaggaataatcgcctccgtgaagcatggacccctgcatatgttggtgaattcacaatgtagtgatgtgatgttttctgaagcaatttgtttggttcatggttttg

SEQ ID NO: 71583 - DNA, 358 bp, Zea mays
  Clone ID: LIB3078-029-Q1-K1-E5
cccacgcgtccgcggacgcgtgggctgatatggatccagctcagcgtgctgcctttctggaggaagatgatgagatggaagatgcacattctgttgctgcatctgctggtgacactgatgctaatgttgatgttaatgaacattttgtatgtttctcctgtgttgatggtgaactttatgagcttgatggacgaaaatcacaacccacatcccatggcccttcatcacctgaaaccttgttgcaggatgctgcaaaagtcatcaaagctagaattgcagagaaccctaactcgatgaacttcaacgtcatggctctttcaaagaaatgaaatgtactgtgatggatggattttctttg

SEQ ID NO: 71584 - DNA, 299 bp, Zea mays
  Clone ID: LIB3078-029-Q1-K1-A12
acccttccggaattattagggctggaaaattgacaaacgggccctacacttggtttgatcttaatccactggttaaagctacagctggagagcgacgagcactagtcatatgcaaaggtgacaagcttgtgggggaagttagcacacttgtggtagcagaaacttgtatccaagcgttaaatattgaatccactgaaggacaaatatatgagattaactcagttaagggtgaaaggcccggaactgacccagagaaatgggaggagctattcagatctgctcggtcagactagtggcat

SEQ ID NO: 71585 - DNA, 343 bp, Zea mays
  Clone ID: LIB3078-029-Q1-K1-A3
cggacgcgtgggcggacgcgtgggctggaagaggaagaagacacctcgaagcaaacctgcgacagccaaggtaacctcgtgctaactgggccatcaatggccacctcggcagaaagtccaattgccttcaccttctacctccatgatggcagcccgcaagccggagaagccgctgaggacgacgaggacatcgggaggataatctgcgactgcatcggcgacgacttctccaactacaacagggccatagtcgagactgtccaaatgggctatggcctcgctgaagtgatctatgccgtgctgaacaacggcgtccaaggccgggtcgctgtcaaacttgctc

SEQ ID NO: 71586 - DNA, 396 bp, Zea mays
  Clone ID: LIB3078-029-Q1-K1-A4
gcgccactgtccagtgcgcgcgtcaagcttgcttagctagccgccatggcctggctgggcgccgtctccgtgaagcccggggccatcaagggtctcgccggcagctccatctccagaaggaagctcgccgtcgccaggccgtcggcccgatccatccgcaggccccgctcagccgacgtggtggccaattaccgcgacaagagcgtctactgtgacctcgacgacatcagcaacaccaccgtacagtgggacctctaccggtctgacgcgccctcgccctacaacccgctacagagcaagttcttcgagacgatcgcgggtccgttcaccaagagaggtctgctgctcaagttactgctgctgggcggcggctcacttctggcctacgtcagcgcg

SEQ ID NO: 71587 - DNA, 319 bp, Zea mays
  Clone ID: LIB3078-029-Q1-K1-A5
cggacgcgtgggcgcgccacctgctggccgccgtctgggcgccggctgcgaagccgcggcagctgagctcgcaggtcgcgctgccttcatcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcacgtggaggagttctacgtcatcacgtggacgtcccccatggagcaagtgttcgagatgcccaccggcggtgccgacatcatgcg

SEQ ID NO: 71588 - DNA, 282 bp, Zea mays
  Clone ID: LIB3078-029-Q1-K1-A6
tcgacactttcgcatacaatcttaaagttatcatctatagaccccatgaccgggataggttccttctatgggacggcctgccctataaaacgtcatcccgagcattaaatttcctgaagtactctcttatctgaaacccctattgacctatgactacgtaaataacaacccctaccagtatctcccccgttccataaataaatccattgacactagctctactagacctgtataacaactctacataagaagcattatctttttctacctccctaatcctac

SEQ ID NO: 71589 - DNA, 238 bp, Zea mays
  Clone ID: LIB3078-029-Q1-K1-A9
cggacgcgtgggcgttagcggtatagcttaactacttctacccaccgccttgggacaccatcaagtccacgtcggacagcgcttttagcgtcaacacactgagcaccttcttgtggtgacactaggccgctactacggtgccgcctgacagacaccgacgaatggtgaacctatctttgtcgccaactgcctttgttcgccctgcgtactccccatacggagaatcatgtgcctggct

SEQ ID NO: 71590 - DNA, 343 bp, Zea mays
  unsure at all n locations
  Clone ID: LIB3078-029-Q1-K1-B1
cgcggacgcgtgtggcgctgtcggaggtggtccgtcgtagaacggctaccctctaccatacggtggtncgggctggagaagctggagaaggtcttcgcggacgaggccgtcgccgagttcttcgacaaccccaccgtcccgcgcgaggagaaggccgagctcatcgacgagatcgccaggtcgtccgagctgcagccgcacgtcgtcaacttcctcaacgtcgtcgtcgacaacttccgcgcggccatcgtgccgcagatcgtcgccgagttcgagaacgtctacaactcgctcacgggcaccgaggtcgccaccgtcacctncgtcgtgcagctcgagtcgc

SEQ ID NO: 71591 - DNA, 363 bp, Zea mays
  unsure at all n locations
  Clone ID: LIB3078-029-Q1-K1-B10
cccacgcgtccggggaaatcctcactggcgaagaaccatatgccaatatgcactatggcgcaggtatagggggcatcgtaaacaacacactgaggccacatgtgccagcttcatgtgatccggagtggagaaggctcatggagcagtgctgggctccagatccggcacagcgcccagcgttcacagagatcgctggacggcttcgctccatgtcaagtggcagcaaatcaggcgaaggcaaccaaataagatacaggtggagtactgcctttcaacccccaatcccgtggggggtctcttctccttttttccttttgactggagagtnatacatatacatgcatgttatagagtgctgtaaaa

SEQ ID NO: 71592 - DNA, 415 bp, Zea mays
  unsure at all n locations
  Clone ID: LIB3078-029-Q1-K1-B11
gccaaccatctaccagcgactcagcgagcgagagcagcacacactgcacgcagctagctaggggcatcagcagcggcggcgatggcggcctccatgatctcctcgtcagctctggcggtggcgcctcagggcctgccgcccctcggccgacgcgcctnctacttcgacgtcgtctgctccaagaagaagatcaagaccgacaagccctacgggattgggggtggcctgaccgtcgacgtcgacgccaacggtagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctggga

SEQ ID NO: 71593 - DNA, 98 bp, Zea mays
  Clone ID: LIB3078-029-Q1-K1-B12
atccggcgtagcctcagtcgtacggacccagtcgtcgggcgccctaaatcttctggccggcgcctgtagaacttgttcaagatgatcaacacgtgcct

SEQ ID NO: 71594 - DNA, 341 bp, Zea mays
  Clone ID: LIB3078-029-Q1-K1-B2
gtcgcttcctgcggtacgcactctctgtccgctgcgttcctccagctagcaactggccatcggggctgctatagcagagtaagtggcgatggctccagctcatgataggctccgccgcctggtgctgctcctcgtcgttgccaccgcggcggcggctttgcttctggcgccgacgacggcggatgctgcgctgccgcgggtgcagcacacgcccaccaaggccgacgggtcgctcgccatcctcgtcgtcggcgactggggccgccgtggacagttcaaccagaccttggttgcccagcaaatgggcgtggtggggcagaagctggacatcgacttcgtca

SEQ ID NO: 71595 - DNA, 294 bp, Zea mays
  Clone ID: LIB3078-029-Q1-K1-B3
ctgcctattgttccctccttcgtgataatgaggctgaagtgcggatagcaactgctggaaaagtaactaagttttgccgcatattaaatcctcagctctcagtccaacatattcttccatgcgttaaggaattgtcatcaaattcatcccaacatgttcgttcagctttagcctcagtgattatgggaatggctcctgtactgggaaaggatgctaccattgaacaactttgttcaatttttctctctttgttgaaaaacaaattttctgatgttcgacttaacataatcagca

SEQ ID NO: 71596 - DNA, 340 bp, Zea mays
  Clone ID: LIB3078-029-Q1-K1-B4
acgcgtacgatccaagcgtggagaggataactgctgaaagcatataagtagtaagcccacccgggggggagtgctctctgctccgacttccctagagcctccggtagcacagccgagacagcgacgggttctccacccatacggggatggagcgacagaagtatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatg

SEQ ID NO: 71597 - DNA, 390 bp, Zea mays
  unsure at all n locations
  Clone ID: LIB3078-029-Q1-K1-B5
gaagaatgccctggccgcttcctcgtcgccttcacctttgacgccacggtcgctggcggcatgactgtttacttctttgcaaaggaagagctcaactgcaatctaacaacagtgaaagaagacctaattaagcccattactgttagcttcaaagagggtcttggtcaaaaattcaggcaaccttcaggaacaggaattgacttttcagtgtttgaagaatcagatttattaaagcagggggacatggatgtatatccacttgcagttaaagctgaaacaacattgtctgttgatcacccaccagaaggggatgaccaanagatgataactcctaactcacagatcacccaggcccgtgtttgaaaagaaagaaaatggggattatcaagt

SEQ ID NO: 71598 - DNA, 142 bp, Zea mays
  Clone ID: LIB3078-029-Q1-K1-B6
gccatctgcgtccgtccgtccaacccgctactctgtcccgctcgaaaggtcgtcgtcgggcccatcctcgtcatctcgcggcgcggcgctcaaagtatgcgacgaggcgagcgtgcagccccctctccgccccatgcccgaa

SEQ ID NO: 71599 - DNA, 253 bp, Zea mays
  Clone ID: LIB3078-029-Q1-K1-B8
cacgcaccgggacaccagcatcccccaacagcgccactgtacagtgcgcgcgtcaagcgtgcttagctagccgccatggcctccctcgccgccgtctccgtgaagcccgtggccatcaagggtctcgccggcagctccatctccggaaggaagctcgccgtctccaggccgtctgaccgctccattcgcaggccccgcgcatccgacgtggtggccaagtacggcgacaagagcgtctactttgacctcgacg

SEQ ID NO: 71600 - DNA, 288 bp, Zea mays
  Clone ID: LIB3078-029-Q1-K1-B9
gattccgggtcgagcacgcgtacggtccgcctccccggccttccgcgaccgctggctgctctagtacggctcgctcggcctggtcggcgccgatgacgacctggacgacgacctctacagcttcctccccgtcgacttcttctcggctccggccccgctctacgagagcgagcgggaggacgcctcgggcaggagggcggaccgagggcttgaggtggccgcgtggggcatcgacaggtggaggagggcgcacagtggtccgacggagaccccgaggttctcggagaa

SEQ ID NO: 71601 - DNA, 407 bp, Zea mays
  unsure at all n locations
  Clone ID: LIB3078-029-Q1-K1-A11
ggacgctggaacgggtagtggtgcatcccttggtgctgctcagcatcgtcgaccactagaaccgcgtctcccgcgacacccgcaagcgcgtcgtcggcgtcctcctcggcacctcatcccgcgggtccgtcgatgtcaccaactcctacgccgtgccgtttgaggaggatgacaaggatcctaggatctggttccttgaccacaattaccacgagtcaatgttctccatgttcaagaggattaaatgccaggagcatgttgttggctggtacagcactggcccaaaactaagggagaacgacttggatgtncatgcattattcaacagttatgttcctaatncagtcttggtgattattgatgtccaacccaaggagctgggtataccgaccaaagcgtactacgct

SEQ ID NO: 71602 - DNA, 352 bp, Zea mays
  unsure at all n locations
  Clone ID: LIB3078-029-Q1-K1-C10
cggacgcgtgggcggacgcgtgggttccccggcagcacccctccgccgtggctcgacggcaggcttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcccttctggtacaccgnncgcgagcagcagtacttcaccgacaccaccaccctcttcatcatcgagctcatcctcatcggctgggccgagggccgccgttgggctgacatcatcaagcccggaagcg

SEQ ID NO: 71603 - DNA, 321 bp, Zea mays
  Clone ID: LIB3078-029-Q1-K1-C11
ctggacaagaaggtggtggatgtggccagggaggtggccaaggtggaggtgccatcatgccggcgccatctggacgttgtggtggcctgtgaggatgacgacgacaatgatgtcgacgtcccacttgtgtccatttactttcggtaaagaggggctcaccgcccgtttacatgttgatcctgtgcgatatttgtcaatgtttgtctcagaaggatcaagtgtataatttgcgatagcaaccgtgaactagattgtgtttaagcacatactgatgatttcctgtgctgccatctggttagactcggctgggaattgtcgctg

SEQ ID NO: 71604 - DNA, 269 bp, Zea mays
  Clone ID: LIB3078-029-Q1-K1-C12
gcatcggtcatcttatcaacaaggacatcactttcctcgcacctagcatgatcatgatgaaggtcgttgcaccgactgagaggatgtacatcacctggattggactgtctatcctaaacctgctgagcactttccaacagatggggatatcgtaggacgactaccacgagtctaacccgacgattgtgcaccggaagtgcttctaagttgtcacaagagactatacagtacctactgtgtaagcatgtgccctgcatttctctagatac

SEQ ID NO: 71605 - DNA, 314 bp, Zea mays
  unsure at all n locations
  Clone ID: LIB3078-028-Q1-K1-F6
cggacgcgtgggtttcgagttagttcatgaataaatacctgcaacactgatagcanattctgctgctgctgcgttgatgaaacaagggcatgttcaggctgtcattgttggtgctgatcgaatagcagcaaatggtgacacacccaacatgattggcacatacaacctcgccatcttcgcgaagcatcatagcgtgcagttctatgtggcagcgccggtaacttccattgatctcttccttccatctggggatgagatagtcatagaagaaagatcaccaaaggagttgctgaactcttaaggtggtctgggaa

SEQ ID NO: 71606 - DNA, 303 bp, Zea mays
  Clone ID: LIB3078-028-Q1-K1-F7
cgggcagacccactcgtccgcccacgcatacttttctacatactctattatctaatacctgcaacactgataccagggcgggcttcttttaaaaagatgaaacacaccccaattcagtctaacattatctttgctcatcaaatacctccaaatattaacacacacaacatcatttgcacatacaacctcaccatctacccaaaaaataatatcttccacaactatgtgaaatcacacatccacttacatttatctcttcctctaatctaccatacacatattcatcaaattaagatcttcaaa

SEQ ID NO: 71607 - DNA, 261 bp, Zea mays
  Clone ID: LIB3078-028-Q1-K1-F8
gcaagcagcaaaggaaggggcactggttctctacacccttgccgatccttcaatggccgaggcgactaagaaggcctgcgatttctggggtgttccatgcaccgatgttcttcggcctactgtcgaagccattgcctctcacatcggtgttgctccatctggaattccacgaagctctccgagtcgaaatggtcggctatcagaggattacttccaacggatcgatgctatcgatttcaccatcaaacaagacgacggggc

SEQ ID NO: 71608 - DNA, 276 bp, Zea mays
  Clone ID: LIB3078-028-Q1-K1-F9
gacaagaagaggctgaggaccattggcaccttctttgcgcgcgcctactccatagagttcggcaactgacatttgcattacaacttcactgggtgccaggacctctgcaagcatgaagaaagtccgcttcattagcgacgaccttgatattgagtgcgaggggaaggagaagattaattgcgagcgtccacgctctctggaaatggtggagcatctagcaccgaccgttgatgggaatggaagagatcatcacctgtcgtggcgaacctaaatatg

SEQ ID NO: 71609 - DNA, 436 bp, Zea mays
  unsure at all n locations
  Clone ID: LIB3078-028-Q1-K1-G1
ggcggcgccttcgacccgctgggcctcgccgacaacccggacaccgncgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgngcatacgccacgaacttcgtccccggcaactaactgactgagcaacgccgtacatgtgtactaccatcagatccatccattcgttcgtccgtccgtcgagtgaacagtgtggtcttctctgtactctacttgttcagatcgtaggcgtgtagtagttgcaccagccggcgtatgctcatgatcgatgtgtgctcatcaatcaatgtcaatggctgcctgctgtaagcggtcgatgtaaact

SEQ ID NO: 71610 - DNA, 302 bp, Zea mays
  Clone ID: LIB3078-028-Q1-K1-G10
gtggaggcggcgactgctgctgtatgtaaaggggagccgctgcgtttctaggcgtggactgatcccatgccggagctgccgaaccctgataagaccgacttatgtgatgggcctcagtgtgaggccctcggatctttcgtgcagtacatgtgggcattgggaatgacattccacctcatttgttgtggcgtcgctgaggccacctactacgacagggcaactgattttagagacacgcctgcttacaaggaatacacatcacaggagttacctgaggagtcggaattatcgagcgctgatgt

SEQ ID NO: 71611 - DNA, 147 bp, Zea mays
  Clone ID: LIB3078-028-Q1-K1-G11
gacgcatgctgtgaggatgacgatctattgcatggcaatggcaatgcctatccaacatgagacgttgatgtgattaacctagacgtgatattttcagatcttgtacagatagagaacaaggttgataacctttacatgagttaaacg

SEQ ID NO: 71612 - DNA, 244 bp, Zea mays
  Clone ID: LIB3078-028-Q1-K1-G2
ctcaccaacaagagcgacctgctcctcgccttcaaccccgtccacaagctcgttcccgtcctgctggactgcgacaagcccatctccgagtcactcgtcatcgtggagtacctcgacgacgccttccccggcgctggccaggccgtcctccccgccgacccctatgaacgcgccgtcgctcgcttctgggccaaatacgtcgacggcaagttgcacggcatgatggtgaatgcgctcatggggg

SEQ ID NO: 71613 - DNA, 205 bp, Zea mays
  Clone ID: LIB3078-028-Q1-K1-G4
gattccggtcgaccacgcgtcgcacgcgtcgccaccgtcgccactcgtacggtgggtaagctcctgggcggctgtgctgctgcatgccgctgccgcctccttgctggccatattataagagccggggagatggctagaggaggagccaaggccggggttaactcaggaccacgccacgtaacaagcagaccggcccggccgccgg

SEQ ID NO: 71614 - DNA, 325 bp, Zea mays
  Clone ID: LIB3078-028-Q1-K1-G5
acgcggacgcgtgggcggggaggtgatgccagggcagtgggagttccaagtcgggccttccgtgggtatgtcttcaggcgaccaggtctgggtcgctcgctacattcttgagaggatcacggagatcgccggtgtggtggtgacgttcgacccgaagccgatcccgggcgactggaacggctccggcgcgcacaccaactacagcacggagtctatgaggaaggagggcgggtactaggtgatcaaggcggccatcgaaaagctgaacctgcggcacagggagcacatcgcggcctacggcgagggcaacgagcgccgtctcacc

SEQ ID NO: 71615 - DNA, 339 bp, Zea mays
  unsure at all n locations
  Clone ID: LIB3078-028-Q1-K1-G6
accgcgtgacgcgtggggtgctcggnctcgtcaaaggcgaggctggcaaggtgcctgccgagccatgctgtaccctcatcaaaggccttgcggacttcgaggccgccgtctgcctctgcacggccatcaaggccaacgtgctcggcgtcgtcatcgatgtccccatcaagctcagcgccctcgtcaactaactgggcaagtgggtggcccaaggcttactggtgcgcgtaagcagcttccggcggtcacacgctcgtagctgttcacgtacgagattacatatgcacgcaccctgcatggcacgaatgcatgcattgggtctgctgatatatctctcct

SEQ ID NO: 71616 - DNA, 169 bp, Zea mays
  Clone ID: LIB3078-028-Q1-K1-G8
ggcagcagcacaagcaagaaccacacctccttccttcgcctgcgatcatgtcgtcttgctgcggcggcaagtgcgggtgcggctccagctgctcctgctgcagcggatgcaacggctgcggcatgtaccctgacgtggagaccgccggcaccagcagcgtctagaccac

SEQ ID NO: 71617 - DNA, 378 bp, Zea mays
  unsure at all n locations
  Clone ID: LIB3078-028-Q1-K1-G9
ctgacagcaccacctgctgctgtatctacgagtacgggaagtactgcttcgcctggggctgctgcccgctcgagggcgccacctgctgctacaatcactacagctgctgcccccatgactaccccatctgcaacgtcaggcccggaacctgcctcatgggcaaggacagcccactgtcactgtcagtgaacgctaccaagcgaaccctggccaagccgcactgggctttctccggcaacacagctgacggaatgaagagcagcgcatgagaaaacgcagcgtggcattaggtcgtcagcaacctgggtgatcgattagagccaccgcgtgggaaatggtcaccttgcccccctgattgactacngaagcatggctcgg

SEQ ID NO: 71618 - DNA, 396 bp, Zea mays
  Clone ID: LIB3078-028-Q1-K1-H1
caaggagtttgataatgagactccatacactattatgtttggtccagataagtgtggatcagccaacaaggttcatttcatccttaagcacaagaatcctaagactggaaagtatgttgagcatcatctcaaattcccaccatctgtcccatatgacaagctctctcatgtctacacggctatcttgaagccagacaatgaggtcagaattttggtagatggggaagaaaagaagaaggcgaacttcctttctgctgatgattttgagccagcacttatcccatccaagaccattcctgaccctgatgacaagaagccggaggactgggatgagagagctaaaattcctgatccagatgcagtaaagcctgatgactgggatgaggatgccccgat

SEQ ID NO: 71619 - DNA, 263 bp, Zea mays
  Clone ID: LIB3078-028-Q1-K1-H10
gcggacaacaatggccatggagacctgcttcatagcgtggtctctgcacgcccccgctggcaggggggacgggctcctcgtccgggaacctgcaggtgctgccatcaaagcgggcgctcgcgccgctgtccgtcggccgcgtcgccacgcgccggccgcggcacgtctgccagtccaagaacgcagtggacgaagttgtggtggcggacgagaagaactgggacgggttggtgatggcgtgcgagacgccggtgctggtggag

SEQ ID NO: 71620 - DNA, 331 bp, Zea mays
  unsure at all n locations
  Clone ID: LIB3078-028-Q1-K1-H2
acggctcggcgtacttgcatctgcaggagcccgcccagtccctctctctggcgagcttgacccggcgtcgggccctggctgtcagctgtgtcaccagggttgtcctcctccgctgccactcgttggaccttgcccctgctgcgccgctggtagcttccctcgccctctcctgcctggcgctcgttctcgtctcccatgaacaagctcgtcctggcactagccctctccagctttgtgacactagcgccctcaagtcctatgccaacgcccccatcccctcccatcttcttncccacgctaagtcccatggctgctgtcctccaccccatgc

SEQ ID NO: 71621 - DNA, 281 bp, Zea mays
  Clone ID: LIB3078-028-Q1-K1-H3
ggaattggaggtccggccccgacgtacgcgtcacctaattcccaagggctggtgcgtgttcgtgtacttccggtcggtccacctcgacgacaagcgctactactagccctacaggttcaacccgtggaggtggaaggagaaggacacgagcaccatgggcttcaccccttttggcggtgggcaaaggctgtgcccatgcctggatctggccaggctggaagcttacatctttctccatcacctggtgaccagcttcaagtgggtggcggaggaggaccaca

SEQ ID NO: 71622 - DNA, 374 bp, Zea mays
  unsure at all n locations
  Clone ID: LIB3078-028-Q1-K1-F2
cccacgcgtncgatttgagaagttgaacactgaggttcttggtgtttccattgacagtgtgttctcccaccttgcatgggtgcagacagacaggaagtcgggtgggctcggcgatcttaaatacccacttgtttctgatgtgaccaaatcaatttcaaaggcctttggtgttctgatccctgaccagggtattgctttgagaggactgttcatcattgacaaggagggagtgattcagcactctaccattaacaaccttgccattggtcgtagtgtggatgagaccatgaggacccttcaggcattgcagtacgtccaggagaacccatacgaggtgtgccctgccggatggaaaccaaggggagaggtcgatg

SEQ ID NO: 71623 - DNA, 340 bp, Zea mays
  Clone ID: LIB3078-028-Q1-K1-H7
gcggtgatcatctgggtactgttgcatacaaactgaccgatcttttctagcagcaggctggcgaggtgtcaacatatgaactgaaagtcgcacgcctgaaccagcaaatcttcacatgccaggtctacacagacaaagaaggcctcaggcagcagcagatgatgggagcaaacatcaagcaccacaagcactacatcctaccccccactggttataaaagatccctggcaaatggacacctgcaagcggacactgatcaggaatccaagcctagaccttacccctccgcaaaaaccctttcctggcatctgtcttcggagaacagcaccaaaagcaacgc

SEQ ID NO: 71624 - DNA, 122 bp, Zea mays
  Clone ID: LIB3078-028-Q1-K1-H8
cggacgcgtggtggcggcagctctgctggccttggccctggccgtgtcgaccgccgaggcgaggaacatcaagaccacgacgtctgagtataacgactactcggtggtgcattcgcatacct

SEQ ID NO: 71625 - DNA, 226 bp, Zea mays
  Clone ID: LIB3078-029-Q1-K1-A1
cggatctcctacacaagtacaacgtgcgctccatccctatccgcatggacgaccaggggcatgtcgtgcgcggcagctacaatggccttgaggggaaggtggtgcaagtgtaccgccgccgctatgtcatccacgtcgagcggatcacccgcgagaaagtgaacggctccaccgtgaacgtgggcattcacccctccaaggtgatcgtcaccaagctgaatctcga

SEQ ID NO: 71626 - DNA, 296 bp, Zea mays
  Clone ID: LIB3078-029-Q1-K1-A10
gtccggccacgcgtccgtgcggattgccccactcactccgctgctgatatttcgtttggttcggcttgccgtcttgtccgtcgccgaggccttcttccgctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcaggtggaggacttctcgccgcagtggtgggacctcatca

SEQ ID NO: 71627 - DNA, 446 bp, Zea mays
  Clone ID: LIB3078-028-Q1-K1-C8
cggacgcgtgggccagattctttctgttagaaaatgttcggaactttgtttccttcaacaaagggcagaccttccgtttggcagttgcatctcttctggagatgggataccaggtccggtttggaattctagaagcaggggcttttggtgttgcccagtccaggaaaagggcgtttatttgggctgctgcacctggagagatgcttcctgattggccagagccgatgcatgtgtttgctagccctgagctgaagataacactgcctgatggccaatactatgcagctgcaagaagcactgctggtggagcgcctttccgagcgattactgttagagatacagttggggatctgcctaaagtgggaaatggtgccagcaaactcacgcttgagtatggaggtgagcctgtgtcttggttccagaagaagataagagggaatatgatg

SEQ ID NO: 71628 - DNA, 363 bp, Zea mays
  Clone ID: LIB3078-028-Q1-K1-D10
ctagcaaccagctagctcgggcggttgcattcagccatcatgtcggaggagaagcggcaccacttcttcaaccaccacaagaaggacgaggagcatcccgccggcgagtacgggtactccgagaccgatgtggtcaccgccaccggcgagggcgagtacgagaggtacaagaaggaggagaaggagcacaagcacatgcagcacctcggcgaggccggcgccatcgccgccggcgccttcgcactctacgagaagcacgaggcgaagaaggaccccgagcacgcgcacaggcacaagatcacggaggaggtcgttgccgcgggggccgtcggcgccggcggctacgtattccacgagcaccac

SEQ ID NO: 71629 - DNA, 437 bp, Zea mays
  unsure at all n locations
  Clone ID: LIB3078-028-Q1-K1-D11
gcttggcatctacagcgatgctgggtctctttcgtgcagccagaaaatgccagggtgacttgaccactatgagcaggacgtgaagacattctcgtcctggggtatcgattatctgaaatacgacaactgctactacgccggcaggagcgtcatggagaggtagtaaagcacatgaacggtgcctagcttgaaaccgcactgttgtcgatgcgtcnggcatcgcgcgcgtgccggattgctcggtgacatagaggtgtggccggtgctgttgcaggtatacgaagatgagcaacgctatgaagacgtatgggaagggcatcttcttctcgctgcgcgaatggtggaggcaaaaccctgctacctgggcaagctgcatggggaacagctggagaacgaccgatgatatcgccgacaactggggcatcatgacgtctcgt

SEQ ID NO: 71630 - DNA, 231 bp, Zea mays
  Clone ID: LIB3078-028-Q1-K1-D12
atccactcccggtgggcgatgctggtttctctgggctgcgtgttcccggagatgggggctgataactgcgtcaagtgcggcgaggccatgtggttcaaggccggcgcgcagatcttctcggagggcgggctggactacctggggaaccccaacctggtgcacgcgcagagcatgctggccatctgggcgtgccaagtggtgctcatgggcttcgtcgagggctaccgcgtc

SEQ ID NO: 71631 - DNA, 241 bp, Zea mays
  unsure at all n locations
  Clone ID: LIB3078-028-Q1-K1-D2
ctcgccctcgctgttgccctttttgcctacactgttgctagtggctcggctgttactgctcctcgtccttgaagaggcagtcgcgatgtagtattgacggaaattctgggcaagagccagtctaatgtacattctgtgatcagagtctagaaatgttgctgcatgatttgcaataactatagttgtccctgcgtcaaacttcgtcttgtgttcatcagtccgtgtttaaaaaaaaaanaaa

SEQ ID NO: 71632 - DNA, 161 bp, Zea mays
  Clone ID: LIB3078-028-Q1-K1-D3
ccacgcgtacgctattggttgctgggcattgacagagccagattatgtaagtgatgcaagctccctatggacgtgcagcaaccaatgtacctggtggttggcatttatatggacaaaaacgctggataggtaacagcacttttgcagatgtcctcatcatt

SEQ ID NO: 71633 - DNA, 315 bp, Zea mays
  Clone ID: LIB3078-028-Q1-K1-D4
cagctaggctagcgttccctcttcttcacctttctaacaccagcagctcgatcgctctgtagtgcagtaatggccgctcgctcctcctgccagcagctggtcccggcggcggcggcagcgagcctggcagcggcgctgctgctgctggcggcgggggccgggacggcgtcggccgccgtgagctgctgcaaggtgacgtcgtcggtggcgccgtgcctcgggtacgcgatgggcagcgcggcgtcctcctacgcggcgtgctgcaacacagtgcgctcactcaacaaccgcgcgtcgtcgacggcggaccagcag

SEQ ID NO: 71634 - DNA, 276 bp, Zea mays
  Clone ID: LIB3078-028-Q1-K1-D6
aagatccactcccagttataaagaggggttttttgtggtctgcacaattcacttgacatccgcgggttataacccctagggttgcggggtaagttaatattttaggaccaaaaggactgttgcctaacccaaaagcgggcactgttttttaaaatattactcaggctataaaagagttcaagaaggggaaggtggaatacagggtggataaacaaggaattgttcatattccatttggcaagggggactttccataggaagatctcattgcaaact

SEQ ID NO: 71635 - DNA, 468 bp, Zea mays
  Clone ID: LIB3078-028-Q1-K1-D7
gccggcccacgcccacgcgtgcgcccactcgtccggatttacctgatttatctatggtggtccccaagtttcgtcctggtctgcttccaaagcagacccggagttgtcctacgatgactcttgtacttgatcttgatgagagcacacaatatatgttcgatgccgcccctatctcaaggaattcttggatagggttgccagcgtgtttgagacaattattttcactgctagtcaaagcatttatgcggagcaacttctcaatgttcttgatcccaaaagaaagttgttccgtcatcgtgtttatcgtgaatcttgtgtctatgtggagggaaactacatgaaggatctgacagtacttggacgtgacttaactcgcgtaatgattgttgacaattctccgcatgcctttgggttccagttggacaatggcattcctatagaaagctggtttgatgatcccaatgacat

SEQ ID NO: 71636 - DNA, 402 bp, Zea mays
  Clone ID: LIB3078-028-Q1-K1-D8
gtcaggagtatgcttctcgcttgactcaagtttgagtatgtttgtgcttcttaggcgcagcgtctactagtattagagtgatgcttgcgtacccctctggctgggttttcattcgtttgaactctagcttatattgccaaatttacttatctgcagaatatttgagccctcaatgaaacatctctgtgtaatttactgctactgttttttccatgtgatgcgcatctgtcatgaactcattaaataaatacaaaagaaagttgctccgaaataaaagaaaatcgagaatcttgtgtctatgtggaagggaaactacatgaaggttctgacagtacttggacgtgacttaactcgcgtaatgattgttgacaattctccgcaagcctttagattaaaaggggg

SEQ ID NO: 71637 - DNA, 314 bp, Zea mays
  unsure at all n locations
  Clone ID: LIB3078-028-Q1-K1-E1
cccacgcgtncgcccactcgtccggaggcctgtccgtacgtcgcgccgctcctncccaagacgaggcttactcccgcgcgcaggcgcgtttctgggccgattacatcgacaagaagatctatgacagccagactcggctgtggaagttcgagggcgaggcgcgggagcaggctaataatgacctggtggaggtcctggagaccctggagggggagctcgccgacaagcctctcttcggcggcggcgccctcggcttcgtggacgtggctctggtgcccttcacgtcctggttcctcgcctaccagaagctgggc

SEQ ID NO: 71638 - DNA, 52 bp, Zea mays
  Clone ID: LIB3078-028-Q1-K1-E10
cccacgcgtccggggcgctggaggtgatccatcggccgtgggccattcttgg

SEQ ID NO: 71639 - DNA, 136 bp, Zea mays
  Clone ID: LIB3078-028-Q1-K1-E11
cggacgcgtgggctccaggaaagggttcgtactcatggcgccgccgcagccaaaggcgggcctcttcgttggcatcaacaagggtcatgtcgtcaccaagcgcgagctgcctccccgcccgtgccaccgcaagggg

SEQ ID NO: 71640 - DNA, 178 bp, Zea mays
  Clone ID: LIB3078-028-Q1-K1-E12
gtcaacagacaacctggaaacaggttcatcatcaacttctttatggcctacccaaacagatggacttttgcatcaaggttttcctactaacttcaatcaacaacaaatgttcaaagatgcacttccagatgtgggaatataaaaaatggatccggcttacaatgccctctttgggatc

SEQ ID NO: 71641 - DNA, 92 bp, Zea mays
  Clone ID: LIB3078-028-Q1-K1-E4
cccacgcgtccgcccacgcgtccggtaccagcccaccgccaggagccgtcctacaccgccgacggcttcagatgagcgtcggctaaccacct

SEQ ID NO: 71642 - DNA, 402 bp, Zea mays
  Clone ID: LIB3078-028-Q1-K1-E6
cggacgcgtgggctgatccatccaagacagggatcgccattgtcggactcggaggaacaccgactcgtatcgtaaggccgaccctgggcgtccaaatacctaccgcagcatgctggcaccctccgtaagaacggcttcatcgtcatcaaaaaccgtccctgcaaggttgtggaggtttctacctacaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgat

SEQ ID NO: 71643 - DNA, 333 bp, Zea mays
  Clone ID: LIB3078-028-Q1-K1-C7
gcaagccatggcgccgaaaggatggtgtctacatgtactttgaagacaatgctggagtgattgtgaacccaaagggagagatgaaaggttctgccatcactgggcccatcggaaaggagtgcgctgatctctggcccaggattgctagcgcggcaaatgcgatcgtctaaaggaagcagtttgtcgaagtttcatttaaaatggggacttgagaagggagttcttagttagacgagcttttgattgccctgaatgtgtttccccggctaatgcttgtgctgctggaccgtttcctgatagctttgctttgatgacatcctccccgttatcgat

SEQ ID NO: 71644 - DNA, 416 bp, Zea mays
  unsure at all n locations
  Clone ID: LIB3078-028-Q1-K1-E7
cggacgcgtgggcggacgcgtgggctgaggccttcgcggagctcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgagggggtggaggcgccaccgtccaccggccaccgntgcggatatctaggtgttcggatgcacgtgagcgcgcactggttccagtttgtaccatgatgtaaattacttaccgtaccagggttcaatcggcaaggaaagaattgtgtgttcactgtcttgtgcagtctcttggtccaatatgaatcaacttacacagcatctcc

SEQ ID NO: 71645 - DNA, 325 bp, Zea mays
  Clone ID: LIB3078-028-Q1-K1-E8
gaagacatggcttgttgttcatgccacagacaggatcctaggctggctcgcattcaccatggccgtgcatatcaaggggatgaatgagcccccttacactcccagagtgcacacgggagctcttgcccttgctgtcaatgccgattaaggagctgcatctggtcaaaagcggccaccaaagccttattggaagcacctctgaaggcctgtaaggacgaatgaagaaacttttgacctacttctaaacaaattccatagagaatgacttgacataccgttcgtggcatgctccccatatgcaggcttgctaaaatattatttaccc

SEQ ID NO: 71646 - DNA, 202 bp, Zea mays
  Clone ID: LIB3078-028-Q1-K1-E9
ctacactacaccacaccacacacacccgacgacgatcacacacacgtagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcgccgacgtgctgatcgt

SEQ ID NO: 71647 - DNA, 380 bp, Zea mays
  Clone ID: LIB3078-028-Q1-K1-F10
gcgtgggctgccatgaaggcgggcgctgctgtagttgcgggcaaaaacaccgaggcggtcagtacctagcagagactgccgaccgtgatcactaacccgatgccgggctccgatgagttccgcaggttcgccggcggcgcgcccgaggtcggacgcttcggggacgtcaaaggtatcttgggccacaataagggccaccggcctgcaaaacccatccaagaaaacggagataaactgcgacgccacactcaaaagcttgtttggcgggagggacaaggttgggatgctgaaaatcaacaggctactgaacgctgacttaccgaagaactagcatgcatcaatccgtggggccagtgatcgcgctttggtaaaggactttc

SEQ ID NO: 71648 - DNA, 308 bp, Zea mays
  unsure at all n locations
  Clone ID: LIB3078-028-Q1-K1-A2
gagcgccacgacgtacgcttccgctaggtcgtcgtgccggcgcaggctaccttcggtgagttgaagaggatccttgttcagactactggcttggagcctgagaggcanatgctcttcttccgtgggaaggagaagagtgacagagagttcctgcacacggcaggtgttaaggatggagcaaagctgcttctgctcgagaagcctgcccctgccaacatatagcagaaggttgagcctgtgattatggatgaaagcatgatgaaggcatgtgcggctgttgctcgtgttagagttgaagttgataagct

SEQ ID NO: 71649 - DNA, 269 bp, Zea mays
  Clone ID: LIB3078-028-Q1-K1-A3
ctattgtgctcatcagtcagtatattgccaacatgataaagattctggtggatagctacaacaagccagtccctgctattctggagatcccatccaatgaccatccatatgatccaccgcacgactcggtgctgtctcgagtgaagtatctcttctctgcggaatcggtggcgtctgataggcgatgaaggcatccttgtgtagtagtaccctttggtgtatctggtttggtatgcattgaaaagaagtggcatgcgttcgagcgagac

SEQ ID NO: 71650 - DNA, 204 bp, Zea mays
  Clone ID: LIB3078-028-Q1-K1-A8
gtggaggcggcggctacggcggtggcgggcgccgtgatggcggcggcggctacggcggaggcggcagctacggtggcggcggcggctacggtggtggcggcagcagctaccgcggtggcaaccgtggcggccgctacggcaactccgacgggaactggaggaactgagcggtggggcccgcgcggccaaagtatcctgttcgct

SEQ ID NO: 71651 - DNA, 389 bp, Zea mays
  Clone ID: LIB3078-028-Q1-K1-A9
atgagctcgaggctatgggcagcgacggcgagttcgacggcgacttcgacgacgacttcgacggcgacttcgacgacgaggatctcgatgaattcgaggacgactctgatgatggttctgagcgcgaagccgggccctagcgcggaagacgctgagctgcagagctctgctcgctgcttattgcgttttttggtattttttacggggaattcaaacagaaaaaacagtaagttagaactcaacggatcaatcagtatgtgttgtgctaaaccggttgttgtaatctcctattttgattgggttattcgaaaattgtaccgcgtcaaagaacagatcttggcgtactgtaattcgcagcggtgaaaaatagtatttcatttttttgatgc

SEQ ID NO: 71652 - DNA, 178 bp, Zea mays
  Clone ID: LIB3078-028-Q1-K1-B10
gccgacccggagactttcgccaagatccgctagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgaggggcgggcttgac

SEQ ID NO: 71653 - DNA, 318 bp, Zea mays
  Clone ID: LIB3078-028-Q1-K1-B11
caattccatcctgagttcaagtcaagaccttcaaaaccttctcccctatttgtgggactaattgcagctgcatctgggcagttggatagggtgctgcaagaccgctgcaatggtcatgttggttcagctaaacatgttctgagcaatggctcatatacatccgcagtacaccaaaatgggaacccaaagaagctcaccaatggtctctcaaacggaacatactatgccaatggcaatggtgtgcatgcttagaccatcagatggatggatcaaggattttgcaactttttacttcaattatgcggttcctaatgcatc

SEQ ID NO: 71654 - DNA, 269 bp, Zea mays
  Clone ID: LIB3078-028-Q1-K1-B12
aacagattgaggaagacgttaaagctgtaatggcataagggcctgctctggaaaatggcaaggcgtctaacctgtttctgctgctctattttctcctcctttgttcctacatagtttaaattgtcacaattctttgtgatggaatggaagaccagtaccacttctttcaacagtaatatcaaatgccggaactgtttttttaatacagactctcattagaccatgtttggagtttgtttacttttgatgtaatttaaaataagtgatgc

SEQ ID NO: 71655 - DNA, 446 bp, Zea mays
  Clone ID: LIB3078-028-Q1-K1-B2
agaaatcgcttcaaggcttacacaaagatttgacgatacagaagaaaaggttaagttgaggctggagacttattaccaaaatatcgagtccttgctatcaacatatgagaacattattgtcaaagtgcaaggagatgccacagtggatgctgtctttgctaagatcgacgagctgctgggttctatcctggagaagaaaaatgaaatggtgtccagcacatgagcaaggggaatatatctgaagcacaggacgacacgtacaagtaatgtaagccagtctcacgtaatggaaatttctccatgtggatgtggtcaaagcataggattttttttctccaattgttaactgtacgcgaatggaagcgacagatcattcgtaggttgtgaaggcttcaaagatcatctgctgctgtacatgttttgttgctgtcttgtgaacatacatg

SEQ ID NO: 71656 - DNA, 190 bp, Zea mays
  Clone ID: LIB3078-028-Q1-K1-B4
actagttctaggcgacgtctacagcttcggtgtggtcatgctggagctgatcgtcgcgaagcagccgatcgagaagggcaagtacatcgtccgcgaggcgaagagggtgttcgacgccgacgacgccgagttctgcgggctcaaggacatggtagacgcaaggatcatgagcaccaataaccacctcgcg

SEQ ID NO: 71657 - DNA, 322 bp, Zea mays
  unsure at all n locations
  Clone ID: LIB3078-028-Q1-K1-B5
ccgggcggagcgtcaggttccaggtgaacagcgtgcatacgtgggcgagcgccgcgctgacgaacgacggcatgtgcatggaggggttcaagggccagcccgccgtcgtgagggaggccgtgcggaggaacgtcgccggcgccatgcacctcacggncatcgcgctcgctatcatcaacgccatggccaagcaaatgtagtaggggtacggtatggtgttaccacggacgtgtatagatagcatcgtgtgtggatgccttgtgcatatgtacagtacgtatacgtctctctgtgtgcttgttcttgtctgatgaaatgatca

SEQ ID NO: 71658 - DNA, 330 bp, Zea mays
  Clone ID: LIB3078-028-Q1-K1-B6
ggccaatcaacagaagtgacgcgagcacgatcacacatcccctcccttcttcggttattcctcgccgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggaca

SEQ ID NO: 71659 - DNA, 422 bp, Zea mays
  Clone ID: LIB3078-028-Q1-K1-B7
cccacgcgtccgacgtatatgcccttgtcccggttcctttccccatccccaactccattaggtgcttgatccttgagaagagagaggaagacgagagctagaagcgaaggagaaaagcagttcttcagctaggcaggagggcacaggaaggaggagatggcgtcaaagaggattcagaaggagctcaaggatctgcagaaggaccctcccacctcgtgcagtgcaggtcctgttggtgaagacatgttccactggcaggcaacaataatgggtccatctgatagcccatattctggtggagttttcctagttacaatccattttcctcctgattatcctttcaaaccaccaaaggtggcatttcgcactaaggtgttccatccaaacatcaacagcaacgggagcatttgcctcgacatctt

SEQ ID NO: 71660 - DNA, 436 bp, Zea mays
  Clone ID: LIB3078-028-Q1-K1-B8
cggacgcgtgggcgcctttccttggcctcggcacatggttacagcacgagcgctcagacccgaccctgtttgagatgacgcatgggctcactgcctgggacctgaatgaccacaagccagctttcggcgagctcttcaaccaaggtatggtctgcgacagcagcttcgtcatggacatcgtcgtcaaggagtgcggcgacgtcttccggggtctaagctcccttgtcgacgtcgccggagggcttggcgcggcggcactggctatctcgaccgcgttcccgcatgtccagtgcagtgtcctggatctcccgcatgtcgccgccaatgctcccgctaacaccagtgtcaagtatattgctggcgacatgtttgagagcattccaccggcagacgccgtcttccttaagtgggttttgcatgactggggcgatgctga

SEQ ID NO: 71661 - DNA, 59 bp, Zea mays
  Clone ID: LIB3078-028-Q1-K1-B9
ctctcgcgtacgtagtttttgcgcttgtcttttttcatttcgtcaaacgaaactcggcc

SEQ ID NO: 71662 - DNA, 339 bp, Zea mays
  Clone ID: LIB3078-028-Q1-K1-A12
cgcgccgccgccgccgccgaaacagctcatctctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccggggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcattcacct

SEQ ID NO: 71663 - DNA, 144 bp, Zea mays
  Clone ID: LIB3078-028-Q1-K1-C10
caagactgctgatcttggtggaaagtcatctacatgaccatgtacaaattccctctggggtgacatattacaatcgggtggcggtcttttcttcctattgttccgccatcccaatatcattttgtcgcatatggggacggactt

SEQ ID NO: 71664 - DNA, 443 bp, Zea mays
  unsure at all n locations
  Clone ID: LIB3078-028-Q1-K1-C11
gccgatcggagaggtggtcgacccgctgttccctggcggcagcttcgacccgctcgggctggccgactacccggaggcgttcgccgagctcaaggtgaaggagatcaagaacggccgcctcgccatgttctccatgttcggcttcttcgtgcaggctatcgtcaccggcaagggccccctcgagaacctcgccgaccacatcggcgaccccgtcaacaacaacgcctgggcttacgccaccaacttcgttcccggctagtgagcgagggcatgatgcttgcatgcgtgtaccgtagacgtacgtattgctacgtactgcatgttgcaccagtatttgtgaagggagctctgggagccagagactgtaccgctagtgtatctgtatgcatgctgtggagctgaacaataaaatatgctgntgatatattatgtcttcatttaaa

SEQ ID NO: 71665 - DNA, 285 bp, Zea mays
  Clone ID: LIB3078-028-Q1-K1-C12
cccgtatcaaggtgcacgagctcctgtggaagagcaagacggacctgcaggcgcaggtcaaggagctgaagtctgagctctccctcctccgcgtagccaaggtcaccggcggcgcacccaacaagctctccaagatcaaggtggtgcgcacctagatcgcgcgcgtgctcacagtgatctcgcagaagcagaaatcggcgttgcgggaggcgtacaagaagaagaacctgctccccctcgacctccgccctaagaagacccgtgccatccgccgccgtttgacca

SEQ ID NO: 71666 - DNA, 437 bp, Zea mays
  unsure at all n locations
  Clone ID: LIB3078-028-Q1-K1-C2
ctccggngttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacagtggtggccgtggaggcggcggctaccgcggtggcgggcgccgtgatggcggtggcggctacagcggtggcggcggctactgtggcggcggcggctacagtggtggtggc

SEQ ID NO: 71667 - DNA, 345 bp, Zea mays
  unsure at all n locations
  Clone ID: LIB3078-028-Q1-K1-C3
gcgaccacgctcgctgtgcttcttcttttctcttttgtcgtcagtctggagacaagctggatacgaatctagctgcagtcccaagacctaacctctatgctgagagaccgctgaaggaggggtctcattcttgggagaggaaagcacccgtggaccactgaaacacacactgatcaaaccgaaaggatgtcttcggcggggcatttgagagtttggtcacgggggctatcttcagcgtttattttatttttaacgcaagccttcgcactgaaaaaacaagggtgtccaacncttgcactgtatctgtagcagagccctcctgtcggctatatatatatatgataa

SEQ ID NO: 71668 - DNA, 443 bp, Zea mays
  Clone ID: LIB3078-031-Q1-K1-F11
gacccacgcgtccggccgcccaagctcgacccgtcgcaggtggtggaggtcttcgtccgggtgacgggcggcgaggtcggcgcggcgtcgtccctggcgcccaagatcggcccgctcggtctctccccgaagaagatcggcgaggacattgccaaggagacggccaaggactggaagggcctgcgcgtcaccgtcaagctcactgtccagaaccgccaggccaaggtctccgtcgtcccctccgccgccgcgctcgtcatcaaagcgctcaaggagcccgagagggacaggaagaaggtcaagaacatcaagcacagcggcaacatcggcctcgacgacgtcgtcgagatcgccaggaccatgaggaacaggtccatggccaaggagttggccggcaccgtcaaagagatcctcggcacctgcgtcagcgtcgggtgcaccgt

SEQ ID NO: 71669 - DNA, 382 bp, Zea mays
  Clone ID: LIB3078-031-Q1-K1-F12
tctctctctcgcccccccccccccctgctcgcggcgcagcggagccgacgcgatgccggggaggaggaaacggcgagcaccaccggccaagtcgcagaggcagacggagccggatccgcaaccgcaagtgccccctggcgccgacgcgccgctggaagagcggctgatatggggcagccaacaagaaagcgagcgccggattactgccatcaaagccataaaagacgcggaggctgggaacatacattaccagttgcaattggcacggtcctattattccgaggagcaattggagggaaacgccatgcagtattttcaggagaacttgcacaatctgtcggttgttccgaacgaagaatatgatgtgcttgagctgaaatgg

SEQ ID NO: 71670 - DNA, 311 bp, Zea mays
  Clone ID: LIB3078-031-Q1-K1-F2
ctcgagaacctcgccgaccacatcgccgaccccgtcaacaacaacgcctgggcttacgcgaccaacttcgtccccggcaagtgaacgaaggcatgatgcttgcatgcgtgtacccgagacgtacgtattcctacgtacttgaagttgcaccagtatttgggaaaggagctttgggagccagaaattggaccggtaggggatttggatgcatgctggggaacttaacaattaaatatgctggaaatataatatggcttcaattattcctaccgatgatcaaggtgggagccaaaaaaaaaaaaaagggccgg

SEQ ID NO: 71671 - DNA, 447 bp, Zea mays
  Clone ID: LIB3078-031-Q1-K1-F3
gcctgtgatcacagaggtcgaggaggatggtggagagaacgcagagcatggtaaccagcagcctaaccaagatccgtatgttgaggagccagacgatgggattgatgagacagaaggtggccaagtcgagctgcacagggatctcagtagggctaatagtggagggcagccgcaggctcgtactttcacatatcagagctcttccgtgacgtttggtggtattaatggagcttactacaccacttcaaagtctcggcggactggtagtgacgggatcactgtggaagaaagcaaggaagctgatacaacaactaaagaagctactcatagaatctcccgtggaatccatgacaagggacattccctgacaaggaaactgaattcggatgggaaggttgacaccacacagacactgcacaaccttgatgaagatgaactagctggatt

SEQ ID NO: 71672 - DNA, 254 bp, Zea mays
  Clone ID: LIB3078-031-Q1-K1-F4
gttctgatcgggccggcttccctaatcggccactctaaaccaaccagcccgactaatcagtgactaatcgcgattagtcggacgacttgaaaatagagttactgcagcttgagcacaatgtttccttcgtactaggctactggcatatttaacacacttattcttctggatttgacataattgttcagttggctgaatcatttggtcttttttatcaatagttgacatttcttgtacagtattggtagtagtgt

SEQ ID NO: 71673 - DNA, 383 bp, Zea mays
  unsure at all n locations
  Clone ID: LIB3078-031-Q1-K1-F5
cgccgccgtcgtcgtcgtccacgccgtgccctcccccgccctactcgccgtcgccgtccgggccgacgggtaagtgccccgtgaacacgctcaagctgctcgcgtgcgtggacgcgctcaacggcctcgtgcacgccgtcatcgggaccaaggccagcgacacctgctgcccgctgctctccggcgtggccgacctcgacgccgcgctctgcctctgcaccaccatcaaggccaaggcgctcagcgtcagcctcgtgctccccgtcgccatctcggtgctcgttaacgagtgcggcaagcatgtgccctncagctttcagtgcccgtaatcacatcagctgcatatatgtgctactatgatgtatcaccaccactaatctata

SEQ ID NO: 71674 - DNA, 383 bp, Zea mays
  Clone ID: LIB3078-031-Q1-K1-F6
ccgcggccgaatcgtgacgttctcttcgtcgggagttgggtctctgcgccctggctactgggcataggcagcaagcaaggccgcggtggaggtgatgactaagatcctggcgcgcgagctgcgcggcacggggatcacggccaacgtggtggcgccagggtccacggggacacccatgatgtacaccggcaagacggaggatgacatggagcgatacatcgccgaagcgccgctgggccggctcggcatgcccgaggacatcgcgccgctcgtcagcgttctcgctagtgatgctggccactgggtcaacgcgcaggtcctgcgctgcaacggtggcaccatctagctagtactgcgtgcctactttttatggttgattagat

SEQ ID NO: 71675 - DNA, 380 bp, Zea mays
  Clone ID: LIB3078-031-Q1-K1-F7
gtttctcccggccacgcacttccgggaccccaacgacccccagcgcaactggatcccctgcgacggctcgcggaatccaacgggttctttaaatgatgttggaagtgtagatgtcttctcttggataagctgtttggatcttcgcactctcgctgtgctgacaaattccaccctgtccagctcaagtgatccacataatatatctttccattacttaatacctgaaggaggcaacgattaattgtcctaccttaagctaaaagtcttgctacctgattcagatctcactgttactagtcagaagcaaatcaaggacaagctaaacgttgccactccagaaagaaattttctttggttattccacactgaattgtcaccct

SEQ ID NO: 71676 - DNA, 286 bp, Zea mays
  Clone ID: LIB3078-031-Q1-K1-F8
gcagctgccagttcccctacaacttcactgggtgccaggacctcgccaagcagaagaaagtcccctgcatcagcgacgacctcgagattgagtgcgaggggaaggagaagttcaagtgcggctccaacgttttctggaagtggtgaagcagctagcagcagcgtctgatgggaatggaggagatcatcacctgtcttgtcgaccctagatatgtccaaactgcagggaaattaaatcttcatgtgtaattgtgctcattctgtttcaatcatctcaacatccgatc

SEQ ID NO: 71677 - DNA, 392 bp, Zea mays
  Clone ID: LIB3078-031-Q1-K1-F9
ctctcggccgcgctgatgatattgatgactggtcgcgcgacaagaagccgctcccgtcgggctaccccagccttggttctgcaggtggcttccgtgactcgccgggcttccgcgattcatcagcttcttctgatgctgaccgttgggtccgtggagccacccctatgccacacaacggccagggggcgggggagaggccacgcatcgtccttaatccacctaaacgtgacccgtcagctgcctctaccccatctgctgaggtggctcgcaaccggccaagcccttttggggctgcaaggccccgggaggatgtgctagctgagaagggggtggattggaagaagtttgagaatgagattgagcagaagaccaggccgcctaccagttcgcac

SEQ ID NO: 71678 - DNA, 319 bp, Zea mays
  Clone ID: LIB3078-031-Q1-K1-G1
cccacgcgtccgcggacgcgtgggcagggacgagacgaggggtgcagccgctgcacaagagctcagggaatctgggctctccgatgtcatcttccatcagctggacatcaccgacgctgcgagcgtcagtcggctggctgagttcctcaaggctcgttttggaaagctagatatcctggtaaataatgccgcagttggtgctgttgagtacgtccaagatcctgctgacagttcaacgagcgatggagagctgagtggcatggatatggtccaaaagcttcagtgcatgcttaagaaagtccgggagacctacgacgct

SEQ ID NO: 71679 - DNA, 411 bp, Zea mays
  Clone ID: LIB3078-031-Q1-K1-G11
cccacgcgtccggcacaaccgtctgtacatggaagcgcgccccttggaggagggtctcgcgtgaggccatcgatgacggccgtattggcccacgtgatgatccgaaggtgcgctcccagatcctctctcaggagtttgggtgggacaaggacctggccaagaagatttggtgttttggacctgagaccactggcccgaacatggttgtagatatgtgcaagggagtgcagtatctcaatgaaatcaaggattctgttgtggctggtttccagtgggcatcaaaggagggtgcactggctgaggagaacatgcgtggaatttgctttgaagtatgtgatgtcgttcttcatgctgatgctatccacaggggtggtggtcaagtcattcccactgccaagaaggtcatctatg

SEQ ID NO: 71680 - DNA, 445 bp, Zea mays
  unsure at all n locations
  Clone ID: LIB3078-031-Q1-K1-G12
tttagaggttttagaatcccatcaagctggcaagctggatacatctggtacagctaaagacgtgattgcttgttttgagaaactaggtgtgtcatatgatatgaaccggatggttaagattagagatccagaacagcagcttgagatggtgggtgtccctgaagaacacatccaagggcatgcattccatctgtatcatctcacttctcctgatgacagtgtttcatttgagttccagcacaatgtttgtggccgttcaatctatgccgaaggaactattgacgcggcaatgtttctgcataggaaggtgcaatcaaaggattctaagagaatatataatatggatgatgtcctgcgagaagaaacttgccataaagcctactgattagctgctgataaataatactcccttcggtcttttntatttttcgctgtttagttcaaa

SEQ ID NO: 71681 - DNA, 374 bp, Zea mays
  Clone ID: LIB3078-031-Q1-K1-G2
gaatgatgaaacagtttatcagttgtgcaaacaggctgtttcacaggctcgtgccggtgctgatgttgtcagccctagtgacatgatggatggccggattggagcacttcgctctgctctggacgccgagggcttccatgatgtctccattatgtcctacaccgcaaagtatgccagttcattttatggccctttccgagaagctttagattcaaatccaagatttggagataagaagacgtaccagatgaacccagctaactacagagaagccctcatagaaaccgcagcggacgaggcagaaggagccgacattctgctagtgaaaccgggattgccgtacttggacattatccgactgcttcgggatcatt

SEQ ID NO: 71682 - DNA, 297 bp, Zea mays
  Clone ID: LIB3078-031-Q1-K1-G3
cagttgcagtgccggctgcctccctctcgcgtgcgctcgccctgtgcctctcgcgtgcggaagctgggcaaaccgccggcgccctagctaggtgcccaggccatcgtcggtcccttcgccaagccatcgtcggggtctcggggattagcacccgcacccacaagatggccacaccgaacggtccttctgcttctccgatggtgtaccctgtctacctttctggggtatttccccagcaaggcggggatgatcaggctcaaggtccagggatatatgccatacaacagaaccagttag

SEQ ID NO: 71683 - DNA, 353 bp, Zea mays
  Clone ID: LIB3078-031-Q1-K1-G4
aaaaaggaaaacttctaggtagcggcacatttggttgtgtgtatgaagctacgaatagggacactggagctctctgtgcaatgaaagaagttaacataattcctgatgatgctaaatctgctgagtccttgaagcaattagagcaggaagtaaagttcctaagccaatttaagcatgaaaacatagtgcagtattatggcagtgatattattgaagatcgtttttacatttacctggaatacgttcacccaggttcaattaataagtatgtcaaacaacattatggagcaatgacagaatcagttattcgcaacttcacccgccacattcttaagggtctagcatttttgcat

SEQ ID NO: 71684 - DNA, 141 bp, Zea mays
  Clone ID: LIB3078-031-Q1-K1-G5
gcgctgacccgatgcgtggctctggtctgcactaggggtgcgcctgttgcgcacgggagctgggcaaaccgtctgtgcgctagctaggtgcccaggccatacatcagtccactctgcgagccatcgtcggggggtcgagga

SEQ ID NO: 71685 - DNA, 407 bp, Zea mays
  unsure at all n locations
  Clone ID: LIB3078-031-Q1-K1-F10
cccacgcgtccgcccacgcgtccggagaggaagagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtctaggttgccaaggaaccgcaggactgtgaaccgtccatatggtggtgttctgtctggtaccgcagtcagagagaggatcatccgtgcctttttggtcgaggagcanaagatcgtgaagaaggttttgaagatc

SEQ ID NO: 71686 - DNA, 364 bp, Zea mays
  Clone ID: LIB3078-031-Q1-K1-D12
gggaaagacgatggcggcggcggcttgtcccgagaggatctggaacgcctggtcgggagggacgaagatgccaagttcaatgggttggatcttgcaaacctcatcaggaagaagtacggtagatcgtacgatgtgacgctgataaagaaagagttcatggggaggaatctgctggccatgaatgtgatgtggaagtacagggagcaaagatcgttcccgctgagcgaggaggagtacctgctgcggctggacgatgtcgccaacacgctcaagtgctggggagccgtggcgcacgtgcgcaacacgctggagaagctcaaggagaggccgcgcattggcaaggccgtcagcatcttcatcgaca

SEQ ID NO: 71687 - DNA, 324 bp, Zea mays
  Clone ID: LIB3078-031-Q1-K1-D2
cagactgcctgtccactgttggcttggcgacttccttcgctccgatcccctccgctcccgaacgggcgatctttgcatggcagcagcagctggctccaaggggcgggcgatcgctggaagcttcgtcagccgcgtactcgccggcaaggccgtctagccgaggagggccgcgcacgcctcggcgtacgacaagaacctggatgaccaggtgcgcccggcgttcgagccagacgatgtgatctgcagcgccctgagcccggacaagtactggagccctgaccccaagaccggcgtgttcggtccggcagctgtggaccccaagct

SEQ ID NO: 71688 - DNA, 394 bp, Zea mays
  unsure at all n locations
  Clone ID: LIB3078-031-Q1-K1-D3
ctcgtgcagggcggcctcgccgaggtcgagaagaagaacgcgcgcaaggccggcgccctgtacgacgccatcgatgccagcggagggtactacgtctgccccgtcgacaagtccgtgcgctcgcacatgaacgtgcccttcaccctggccaagggcccggacttcgagaagcagttcatcgccgaggcggccaaggagggcatggtgcagctcaaggggcacaggtctgtcggcggtgtccgcgcctgcatctacaatgccatgccgctcgccggcgtcgagaagctcgtcgccttcatgaaggacttccaagccaggaaccctngattgccttgtgcttatgatcatttggtattgctactcagtctttctttctagcataagtgagctcgtg

SEQ ID NO: 71689 - DNA, 257 bp, Zea mays
  Clone ID: LIB3078-031-Q1-K1-D4
acccactcgtccgagccacctagcacccaatctgttttacctgatgccacatctctggtaggtacaagcctacaatctttgacagatgatgctataattactccgatacaaaatcgtctctgcttatatatctctgtgtcatactagcacttattatgttgcaactctatcgattaaatactatatttgatctaattgataattaccataatcacagatgcactcatataaagttgattttgtagacctaaatttta

SEQ ID NO: 71690 - DNA, 419 bp, Zea mays
  Clone ID: LIB3078-031-Q1-K1-D6
gcgcgaggaggtcggcaccgagtacctgaccggcgagaggaccaggtcccccggcgaggagctcaacaaggtgctcgtggccatcaaccagcgcaagcacatcgacccgctgctcgagtgcctcaaggagtggaacggcgcgcccctgccgctctgctgagctcagctgagctgcacgcacctgctccgcacaaagaaggaaaaacaaaagtatagcggctcaagacagcgtttcaagatcgtttatttacaaccagactagcagaagatgctctctatatctaccgtcgccttgtattattagtagctgaagtaagttcatgtgaatgttgtcgtgttcccgcagctgcgacgccatggcgtgcgacgtgcgcgttcttggcttgcgcagctgctgaaacttttgatgtttttaacct

SEQ ID NO: 71691 - DNA, 227 bp, Zea mays
  Clone ID: LIB3078-031-Q1-K1-D7
cccacgcgtccggcgaggcggtgctggtcgccggagcttcaccggctgtttgttgccgcgttgcatcaactcggcggccctcaagttgctactccgaagcagatcagggaggtgatgaaggtggacgggcttacaaacgatgaagtgaaaagccatctccagaagtaccggctgcacaacagaagatcccccggcgtcgtggctccggtgagccagtcggtcatgct

SEQ ID NO: 71692 - DNA, 389 bp, Zea mays
  Clone ID: LIB3078-031-Q1-K1-D8
gcggcattgaaatgatgtgcatatgatatgaattgatacatatccttggttgaagtccagatcattcaaatgggatgctcaagcaagaactcctgagcctgcagaacttcccaaaaaatattgggggaagaaaaaggagaagttttcctggagatgaatctcacaaggagatggaatcattgctacaaacgatgactcttgtgaacagagagtgctgcatatatatcttaatgtgtagatctaagccttcaagtatgagcacatgtacatgctcatgtacattcgattgttagatgcaatagtatactatcaatgtgaaatgtaaatccaaatgcttcagcaggtcatgaccaagctaatgatctaactagggatggacatcttgactc

SEQ ID NO: 71693 - DNA, 357 bp, Zea mays
  Clone ID: LIB3078-031-Q1-K1-D9
gctgaacggagagttcgacctagcacgctcggccgccgccgcagcccgcaatggcgtccgttttcaaggaccccagcaagctctcggcgtacagggaccgccggttcaaggggacgcaggaggagtatgaggcggcgctgcttgcgtcgacaacgctgtacatcggtaatatgtccttctacaccacggaagagcaggcctacgagctcttctcccgcgccggcgagatcaagaagatcatcatggggctcgacaagaactccaagaccccatgcggtttctgctttgtactgtactactctagggaggatgctgaaaatgctggcaaatacattagtggaacgatgcttgacgatc

SEQ ID NO: 71694 - DNA, 351 bp, Zea mays
  Clone ID: LIB3078-031-Q1-K1-E1
gggaagcaaaacgagcaacagaattagctgatgtagctcgtgtagaagcttctgctgctcaaaagggtaaggtggaagctcaacggctcgcaatggagaggtttgcactgatagaaagaatggagcgacaggttgaagctctagaaagggacaaggctaagttggtagaagagattgagagacttcatcagtcagagaaggatgctgtgtccaaggtcgcattgcttgaaagaaatgtccgtgagcgggaaaaagaaattgatgagatgttgaagcagaataaccagcaaaggtccagcacagttcaagtgcttgagagtctgctggcaacagaacgtgaagcacgtgctg

SEQ ID NO: 71695 - DNA, 273 bp, Zea mays
  Clone ID: LIB3078-031-Q1-K1-E10
cgctgttggagattcagtcagtcatatcaaagttggcactcctgtggcacttatgacttgtgggagctatgctgaattcacggaggttccagccaaacatcttcttccagtgccaagaccagaccctgaggttgttgcaatgttgacatcaggactgactgcatcaattagtcttgaaaaggcaggacaaatgacatctgggcaagttggtttagttacagcaactgctggtggaacaagacagttcgcaattcaacttgccagattagcaag

SEQ ID NO: 71696 - DNA, 395 bp, Zea mays
  Clone ID: LIB3078-031-Q1-K1-E11
gacaagctctaccactgaagaagcgacagaggacggtttaatttgcacctactgcttccggacgcttgcggtgccaaaagctgcctggatggaacttttactgacctgcacgagtggtgtgtgtgtgtgtatcccagctgctgatacacaggagcttcgatcttctgtgactgtgactgaaggaaaataaacccagtgttggaatgatcttgatttgtaatagcttcacgtcatgggattttaattatgtcataacacagaagatgctcaatttcacgttcgttacgggtcagttatgacactaagcatattgtcaatgatgtttgcttatatagacacaataaataagccctgggcacatcacctaatggtactctatatcgacatctattgat

SEQ ID NO: 71697 - DNA, 316 bp, Zea mays
  Clone ID: LIB3078-031-Q1-K1-E12
gagctgttgtgatcggacgaagcaatattgttggaacgcctgctgcattgttgttgcagaaagcaaatgcaactgtcagcattgttcattcacaaaccaagaaccctgagcaaataacgagacaggcagatatagtcatcgcagctgttggagtcgccaacttggtcagaggggattggataaagcctggagctactattattgatgttggcatcaatccagttgatgacccagagagcccccgcgggtacaggctcgtcggggacgtctgctacgaggaagccttcaaggtcgccggagccatcacgccggtccc

SEQ ID NO: 71698 - DNA, 227 bp, Zea mays
  Clone ID: LIB3078-031-Q1-K1-E2
gctacaacagcacctagattggccgcgcatctatcatcagcgtgcggagcgtctaatgcggatccagggaaccattgctcatccaggatgctgagtgttgctaataaagctaacgttaactctactgtcaggagtaactgcatcttgatgcataactacagtttacagacgttactcacttcattgtggagagcgatctgatccatagatcgtgcaggctgtgcttg

SEQ ID NO: 71699 - DNA, 324 bp, Zea mays
  Clone ID: LIB3078-031-Q1-K1-E3
attccagctaggcaaatggcttcttcaaggatacttgctcagcaactgcaccagtctctcggacgtggaggcggcggtggacgtggaggtcgacgaggagcaggacttctcttcagcggagaagactacgacgaccccggcagacggctccttaactctgccagctctggcgaccctgaacctttcttgcctgccctcttctctcttttgatcgatgggttgccagctctggatctgaaattctgaacgcatgggacgcgagctgtgtgtagcatgaataactgcgctagttgttggatggacgaactcaatcgcgctcgcatg

SEQ ID NO: 71700 - DNA, 185 bp, Zea mays
  Clone ID: LIB3078-031-Q1-K1-E4
tccaccccgttccagccctacagtaaggtgttcggcctccagcggtgcctcgggggcaatctaatccacggccgatgggccatgctcgccaccctcggggccctaaccgtcgagtggctaaccggcgtaacctggcaggacgctggcaaggtggagctgatggatgggtcctcctacctgggcca

SEQ ID NO: 71701 - DNA, 313 bp, Zea mays
  Clone ID: LIB3078-031-Q1-K1-E5
caaaaacgggaggacctcaccgtgcaatggaaatgctttccaacatgaaacagtctacaggaagacctgatgttgtctcctatagtactgtccttggtgccttgagtcatgctggcatgtttgaggaggcatcaaagctgatgaaagagatgaatacattggggtttgagtacgatcttattacatattcatctatacttgaggctattggaaaggttgatcatgaatgtgacccttaaggttggaagtgtatcatgtgcaatcactcatttggtgcaagcagagcattcaatctaaatctagcaatttcata

SEQ ID NO: 71702 - DNA, 379 bp, Zea mays
  Clone ID: LIB3078-031-Q1-K1-E8
cggtcgaccacgcgtcgtccacgtaagtccaccccgctccagccctacagcgaggtgttcggcctcagcgggtgccagggcaagctcatccacggccgatgggccatgctcgcaccctcgggccctaccgtcagtggctcaccggcgtcacctggcaggacgctggcaaggtggagctggggatgggtcctctacctgggccagccgctgccgtaccatctcgacgctcatctggattaagtgcttggatcggctcatcgagttcagcgcaacgccgagctcacccggagaaaagctgtccccggcggctctactttgaccgctcccctggggccgacccggaaagagggacggctgagctgcggagatcaacacgcgc

SEQ ID NO: 71703 - DNA, 393 bp, Zea mays
  Clone ID: LIB3078-031-Q1-K1-E9
cccacgcgtccgcagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatct

SEQ ID NO: 71704 - DNA, 333 bp, Zea mays
  Clone ID: LIB3078-031-Q1-K1-F1
ggcgtggatcaagattttcctctaactcaacgtcctcttcatcaacctggagccgttcacggaactgatcctatgctgcaggacttttttctagccatgtgtcgacctccgtgcacaatgtctaatcgtacctttccaggcactgcactacatgcatattattgctgttttgtacttttgtagtaatactctacaatccatgattattgtccctgtttgttagtaatgctgttttgtctgtgcatgaaacactctatacctacatatagccaagaattgcaggactatgtatgcatgtaaaactcttgcaagattatcaattttatgaactat

SEQ ID NO: 71705 - DNA, 402 bp, Zea mays
  Clone ID: LIB3078-031-Q1-K1-D11
aatacaataaaaatgctagcatctcacaagcttcagtcaacgctggcagtcagtctgcatgccccaaatcagaagctgcgggagacgattgttcctagcgccaagtcttaccccttgggagcactaatggatgactgcaagagttacttccttgaaactgggcgcagggtatccttcgagtacactctgctagctgggattaacgatgaaaaggagcatgccgaagagctagcagaactacttcgtatgtgtggaggtggttaccatgtgaacctgattccctataacccaattgaaggctccgagtacaagagaccttacagaaaagtggtccaagcctttggtgatgctttagaagcacgcaagataaccgttagcgttcgacggacccgtgggcttgac

SEQ ID NO: 71706 - DNA, 402 bp, Zea mays
  Clone ID: LIB3078-031-Q1-K1-B7
cgcatgtgtcgcccgcatcggcgcagggttcgcaaagatggcagtgccgctgctgacgcggaacatcgtgaagaagcggctcaagcagctcatgaggccacacctagaccggtacaagtgcctgaagccaagctggcactatgcccaagggtatcgactcccgcagtcacgcggaagttcaagggatgcaccttgatgcccaacattgcatacagctctgacaagaagacgaggcactacctttccaacaagttcaagaaggatgtcgttcacaacgactctgagctggagctgctgctgatgcacaacaggacatactgtgccgagattgcccacaacgtgtacagccggaagcgcaacgagatcgacgaacgtgctgggcaactggacatcgacgtcacc

SEQ ID NO: 71707 - DNA, 375 bp, Zea mays
  Clone ID: LIB3078-031-Q1-K1-B8
cccgttgcagccctacagcgaggtgttcggcctccagcggttccgcgagtgcgagctcagccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcg

SEQ ID NO: 71708 - DNA, 393 bp, Zea mays
  unsure at all n locations
  Clone ID: LIB3078-031-Q1-K1-B9
cccgtccgcttcaggggccagttttggcaccccattanntgatgggcntncaaagttnctcgccttggagcctcgtccatcggcgggagaccatnntgtcactggctagaaacctatgcnngggaagggaaggggcatctgagcctnngtcgaggagggtggtgnnngtggttggccttggtgaggccttcnttagtaaataccccaatnncatctttgggtatggttttgggtggaaatggtggtnntggcaaccgtnntgtttaatttaatgccgcaangncctgctggtgnnngtttcgggaatggaaaggaaaggactcnntggtccctgggaaacaaagctnnngcggagaagggannngcctgtcangnntgtattggggtgtctgg

SEQ ID NO: 71709 - DNA, 324 bp, Zea mays
  Clone ID: LIB3078-031-Q1-K1-C1
acgcgtacacacccgtttcgtacgcgtatccgtcggcatggcgacatggctgggtgcctggggacgcgtactatcctcactatgctcagcaggccccttcgctcgcctaatctctcgccgtggccttgccggtgccgcacacgggcatgggtctgcgaatgtgccctcgcggaaagatccagtgagccgcaagcacgtggaatgacgagcacttagacctgtctagcctcacaatgaggggcgacctctctaatgggggtaacaagcttgttagtggcaagaaggctgccctgactcaggtggcgttgcaccacgcgtcatact

SEQ ID NO: 71710 - DNA, 456 bp, Zea mays
  Clone ID: LIB3078-031-Q1-K1-C10
cccacgcgtccgcaaagatttgttgggtgatgactggattcaaaggcaccgaaggattgtgacaacaaaatgccaatcagtatagaaggattgcttgggcgaaggtgttgcaatgcctctctggtcaaggtttgacttcatcaggtggtagtggtcatgtaggaagtgatggtggcaatagcagtggagcttcaagaacagctgtgaaggagagattcaggtctttcaatgtgttgttcgaagagatctaccacaagcaatgtggctggtccgttccagacactgagctgcgcgagtcactaagactcgcggtcgctgaaatcctgttgcctgcctaccgatcattcataaaacgttttgggcctctcattgagaatagcaaagcacctgggaaatacgtgaagcacactcccgagcaactcgagctgctgctaggcaatttattcgaggggaaac

SEQ ID NO: 71711 - DNA, 401 bp, Zea mays
  Clone ID: LIB3078-031-Q1-K1-C11
gccaaggcagctcctcctctcctcgccgccggcagccgcactgccatcacagcgcagcagccatcgtcgaggaaaggcgccgctggcgccggtttgttctgcagtcgcgtcatcgtcagcaagcgcgccagggtaacagcgaagctcggagacggagagctgaagcctgcaggcaagcggaagttcatcaccaaggaagaggagccagaacagtactggcagaccgcgggggagagggagggcgagaaccccatgatgacacccctgccctacatcatcatcttcggcatgtccacccccttcgtcatcctcgccatcgccttcgccaatggctggatcaaggtccctgtgcgatgaccgtaacgcgatcagccagcctggatcatagatgctgactcgtc

SEQ ID NO: 71712 - DNA, 454 bp, Zea mays
  Clone ID: LIB3078-031-Q1-K1-C12
cccacgcgtccgtggactacagcagtgttgcatcagcaattgccggctgtgagggtgtcgtccatgtagctagccctgtcccttccggtcggtcctccaaccctgaggtggaggtcataggtcctgctgtaacaggtacaatcaatgtgttaaaggcttgctatgaggcaaaagttgggcgagttgtggtggtctcttcatgtgcagctgtctatgctaatcctaattatccaaagggtaaggtctttgacgaagactgctggtcagatgaagcttactgcaggaagaacgaggattggtattttgtttccaagacactggcggaacgagaggcttttgtttatgcagcaaaaacagggctggatgttgtaactatttgcccgtcgttagtatttggacccttgatgcagcctacagtaaattcgagcagcaaaatcatccttaaatatttcac

SEQ ID NO: 71713 - DNA, 326 bp, Zea mays
  Clone ID: LIB3078-031-Q1-K1-C2
gcgtgcccctaatattgctcttagcgcagtcattgactaatgctataatgcaagaatatttcggtccttggcgggccatgtcctaattgcggtactgaaaacctttccctttttgggactatactgccagtctacattggcggaccaccaaacaaagtgaattgtgcacattgccattcacatctggaatatgactcagaatctatgtagaccactcatctcaaacgcatcactcgcttacacatacgtcactatacatttacgcgagtaactataaacggacactatgcggtatatatgccaaatgtacgacaactcactcggtc

SEQ ID NO: 71714 - DNA, 398 bp, Zea mays
  Clone ID: LIB3078-031-Q1-K1-C3
cccacgcgtccgcccacgcgtccggagcccttctcgtcctcagatctagcgccgcctccgtcaccctgctgctggccgcctggccggcgagctcctcagcgtgcttgtgatgataatgccacaacatcttctacaagcaagatcaggaagaagacaaaaaacgttatagtgaagaggaggggttgattgctgcattcaaaagtgtcggggataccttatccaatgctactgagaaggttgccacaggggacactgatgtgccagatgatctttttatagtttgataaacctttcacgttttgagcagacccacatatctctgcatttcaattatctggtggcgcaccctgacattgctagagccttcaacaagttgtcattcgaccacaagttaatct

SEQ ID NO: 71715 - DNA, 309 bp, Zea mays
  Clone ID: LIB3078-031-Q1-K1-C4
gtcgatgctaaggttgcctacgacagacaaactgggcgctcacgaggattcggttttgtgtcaatcgtgtcaaaggaggaactcaatgatgctatttcggccctagatggacaggaattggacggacgtcctcttcgagtgaatgttgcagcagagcggccacagaggggcttttgatgcggatgtatgagagagatgactggttgtttgtaatgagcatggtgacacatagacacaatgtacgagcaatggtgcaaattaacggaagctgatgctgtcacaagttgctagatctttctcccttagctt

SEQ ID NO: 71716 - DNA, 416 bp, Zea mays
  Clone ID: LIB3078-031-Q1-K1-C5
gcgcccacgcgtccgcccacgcgtccggagcccttctcgtcctgagatctagcgccgcctgcggcacccggctgctggccgcctggccggggagctcctcagcgtgcttgtgatgataatgccacaacatcttctacaagcaagatcaggatgaagacaaaaaacgttatagtgaagaggaggggttgattgctgcattcaaaagtgtcggggataccttatccaatgctactgagaaggttgccacaggggacactgatgtgccagatgatctttttatagttagataaacctttcaggttttgagcagacccacatatctctggatttcaattatctggtggcgcaccctcacattggtagagccttcaacaaagttgcaattcgaccacatgttaattttggctcgcaatttc

SEQ ID NO: 71717 - DNA, 249 bp, Zea mays
  unsure at all n locations
  Clone ID: LIB3078-031-Q1-K1-C6
ctagcacaagcatagtgcaggggcttgccacctaagtaaggcccgcctgagagccatggggtccaaggccgtcctcttcttggctctcaacctcctgttcttcacggtggccaacgcctgcggcaactgcccgaccccaacgcccccggtcgagccaccgtcgncgacttctgctgctaccccacccccttcgttcagcggcaagtgcccgctgaacgcgctcaagttcggcgtgtgcgccgatgtgct

SEQ ID NO: 71718 - DNA, 456 bp, Zea mays
  unsure at all n locations
  Clone ID: LIB3078-031-Q1-K1-C7
cccacgcgtccgcagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcngcggcggcgcccttctcgtctacaacaccagcgccc

SEQ ID NO: 71719 - DNA, 271 bp, Zea mays
  Clone ID: LIB3078-031-Q1-K1-C8
gaaacgaacaaggccttactgatttttcatccctgctgacggaagcttgatttctccgtgggtgatgctatggatgtgatcagatcagccatttgcaagctgattgcagccacggatgagtattgtggcagtgggcaatcccaaaatatagctctcttgttataggttagtttattatgagtagcattcggcttatgtttttctggaccgtccccattatgcattagcttgggctgcttggctgtatgtaataataagcaacattctgctt

SEQ ID NO: 71720 - DNA, 381 bp, Zea mays
  Clone ID: LIB3078-031-Q1-K1-C9
gcaagaccgagaaggagatgaatgagctcaagctcaaggagatcaagaacggcaggctcgccatgctcgccatcctcggttacttcatccaggggctcgtcaccggcgtcggcccgttccagaacctgctcgaccacctcgccgaccccgtcaacaacaacgtgctcaccagcctcaagttccactagaacgtggtgcatcagcatacctgctgctgccgccgccgccgccagttgtttgctgtggaaagctagatgcatgcgtgttgtaaaggaacctgaagcgttgcatcggtcatgattcatgcatggccagcctgctgcctgtaacaacaaactagtattgatcttattgagaccggaaactgtattgcacatgggt

SEQ ID NO: 71721 - DNA, 296 bp, Zea mays
  Clone ID: LIB3078-031-Q1-K1-D1
ctcgcggcagctgtcacccgctgggactggccgacgacctctacgccttctgcgagctgggggcgagggagctcaagaacggtcggcttgtcatgatctgcatgatcagcattgtttgtaaggacatcgccaccggctagggcccgatatggaacctagcttgccacataggtgacccatgcaacaacaacacgtgggcctacgacaccaacttcaggcctggcgactaagcgcaactgctatgctatgcaacctcattgtctgtcctatcacaaagggtgtacgtacttggattg

SEQ ID NO: 71722 - DNA, 420 bp, Zea mays
  unsure at all n locations
  Clone ID: LIB3078-031-Q1-K1-D10
ccgatgtggagcctaaaagcgatgacgagagcgatgaagatgatgatgacgacgacactgaagctctaatggcagagcttgagaggattaagaaagaaagagccgaggagaagcttagaaaggagcggcaacaagcagaagaggaggccaagatgaaggaggctgaactgatgcggggaaacccgttgattaatatcaacaatgctggctccttcagtgttaagagaaggtgggacgacgacgtggtattcaagaatcaagcacgaggagagaccaagacaccgaaacggttcatcaacgacaccatcaggagtgatttccaccgtaaatttcttcagaggtacatgaagtgacgcttncgtcgttcacaattcagcctggagcccctcatcgntatcatgtttgtgtatgagcgaaaga

SEQ ID NO: 71723 - DNA, 274 bp, Zea mays
  Clone ID: LIB3078-031-Q1-K1-B6
ctgaccacctctggactcgtcccgagcggtgacgtaggcagccgctgtgacgggacacctacgggactaacacttgaaaccagtggaaacagcgaccggtgatgttcacgagtggatggatcactgcaactatgatcgtcaggactgtctgtggacctagtagtacagcgtgattaagggccaccagcgcctacaccgacacccactgagcgattcgactacgaagcacgtctagtgctcttgctagaccgttgcagagctgggactatgttac

SEQ ID NO: 71724 - DNA, 349 bp, Zea mays
  Clone ID: LIB3078-031-Q1-K1-A12
cagaaacatgtgccatccaggactgccgccgagctgcgcggtcaggcggcgggagcagcgggcggccgtggcaccgtcgctctcaccgtctgtgccatgggcgcgccacggtgcgccgcaccactactgcgtgtgctcgcccacggcgcaccggggctcgttcaggtgccgatggcaccgcagcggcttcgagtgggggcgccggcggccgttcgcgaacacaccggggcgtgctgaagccgggccggcgatgcacgcgcggatggcggcgccttgacggttctccggacggcgtccggcacgggctgtcagtcccaaactgtatattggtatggtgtgtagaagatgc

SEQ ID NO: 71725 - DNA, 287 bp, Zea mays
  Clone ID: LIB3078-031-Q1-K1-A2
gcgcccgagggaaagaacaccaacgcaacatctaccacccggccacatcgtcacagcatcggggcttctaaagatgccagcagagtacagtgctcgccgaagagcggcgtggcgaccaaaactagatctgtcaagcctgagctgaaggccctctgaagcgcatgcgtagcattcaagtgctgcgattgtctctgtacaaacagaatcgcctgactcttagccgtttccatttgcatgcattttttttggtttgttttggtctatacccagcatctgcaccaaaaaga

SEQ ID NO: 71726 - DNA, 379 bp, Zea mays
  Clone ID: LIB3078-031-Q1-K1-A3
gcgagcttgttaagaggcttgccaagaagtaccatgctttcttggcatcagaggccatcatcaagcagaggccccgtctccttggtcctggtctcaacaaggcaggcaagttcccgaccctggttactcaccaggaatccctcgagtccaaggtgaacgagactaatgcaacagtcaagttccagctcaagaaggtcctttgcatgggtgtcgccgtcggcaacttggcgatggaggagaagcagatccagcagaacatccagatgagcgtcaacttccttggttcccttctgaagaagaactggcagaatgtgagatgcctgtacgtcaagagcaccatggggaagccatacagggtgttctaagtctgctcttttgt

SEQ ID NO: 71727 - DNA, 445 bp, Zea mays
  unsure at all n locations
  Clone ID: LIB3078-031-Q1-K1-A4
cccacgcgtccgggaggatctacctgccggatgggctgttggaccggtcggaggtgccggagtaccgcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacacccttaactacttcggcaacagcatccccatcaacctggtggtggcccgtgatcgcngaggtcatcctcgtcggcgggcgccgagtactaccggatcaccaacggactggacctagagggacagctgcaccccggtgggccctttgaccccctgggc

SEQ ID NO: 71728 - DNA, 364 bp, Zea mays
  Clone ID: LIB3078-031-Q1-K1-A5
ccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcgggctggccgacgaccccgaggccttcgccgagct

SEQ ID NO: 71729 - DNA, 453 bp, Zea mays
  unsure at all n locations
  Clone ID: LIB3078-031-Q1-K1-A7
cccacgcgtccggaagcgaagagcagcggcgcaaaggaaagggagccatgctcgcctcggcggcgctcgccggcgcccactccttcgcggcgtccgtgtatggaaacatcctcgtcccctcgcctcccgtccccgcgccggcacgtcgcgcggcgctgtccgtcgtcgccaaggtcaaggtggccactccccaggacgaccgcatcgcccgccacgtccgcctgcgcaagaaggtaagtggcaccactgagaggccgaagttgagtgttttccgctcaaacaaacatctgtacgctcaagtcatcgacgacacaaagcaatgtactctggcttcagcttcaaccatgcacaaatctctctgcaagggaattgaatactcagctgggccaacgatcgaaatagcacanaagatcggtgaggtgattgccaagtctggcttggagaaagggatca

SEQ ID NO: 71730 - DNA, 381 bp, Zea mays
  Clone ID: LIB3078-031-Q1-K1-A8
gcgacctgcttggtggcgacgcgtgcaacgggcccatgttcccggaggccaagcccgccgcggcggcggcggcggcgagcaggagtgtggtcggggtggacagggactacctgtcctacgacgagccaaagacggtgttcccgggcgaggcgtgcgatgaccttggcggcgagttctgcgaggcgccgtaccaggacggcgtctccaaggagctggcgcacgcctgaagaccctgatccatccatttctgtccaccacgctatgtacgtatgtgtagcagatggtttacatctacgtgttagagcccggagagctggagaagctagctagcgtgcttacagaataacagcagccaagcaaagccaagggtgtgtatataat

SEQ ID NO: 71731 - DNA, 454 bp, Zea mays
  Clone ID: LIB3078-031-Q1-K1-A9
gggcacgccgccgccgccagggggtaccgcgcgcgcgtggaggccgagctctgcgggaggtgcgcggggatcctgcgcctcctcgacgagcgcctcgtgccggcggcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcaggctcggcctcgccctcaacttctccgtcttctactacgagatcctcagctcgccggaccgcgcctgctcgctggccaagcaggccttcgacgaagctatttcagagctggatagtcttggggaagagtcgtacaaggatagcaccctcatcatgcagcttcttcgtgacaacc

SEQ ID NO: 71732 - DNA, 295 bp, Zea mays
  Clone ID: LIB3078-031-Q1-K1-B1
atgcactcaagcgctcacgactgacttgtcaaagagctccgtgaggctgacaaggccatatacaagcatgcgcgtcacttttgcgtgcttactgatgactgtgaccagccatatgaccataagctggcgatggcactctgcgctgagcacaatgctcacctcgtcactgttcctggcgcgaaaactcttggcgagcagtccggactttgccagattgactctgacggcaaggcacggaaggatgtaagctgctcctgtgtcagggccaaggactacggtgaacaatctgacggcc

SEQ ID NO: 71733 - DNA, 328 bp, Zea mays
  Clone ID: LIB3078-031-Q1-K1-B10
agcgtatgtctcgcattaaggacgatccagctatgaagtcaattgttgatgagttagagggtgcgggcccttctgcaatgatgaagtactgtaacgaccctgatactcttcaaaagattggtgaggcaatgggagctagctttccatttggtgaaggttcttctgctgaaccttctggcactgaagaaactgatgaagaaagtggcgatgacgatgaatccatcgttcatgacactgccagtgatggtgatgaagagggtctcaagaaagcactagatggttgagccgacaaggatgaagaagactctgatggaagaacgtgcttaca

SEQ ID NO: 71734 - DNA, 318 bp, Zea mays
  Clone ID: LIB3078-031-Q1-K1-B11
gcggcagcggcgcggccatccaacgccactcttctcgcgcgcctccgggacgggacggcgaagttcgagctgctggatgactctgcgtttgcgcttgcgcacgcgcccccggcctggccccgacttcactgctttggcaggattgccccctcgttgaggggtgggtggtcggcagcgttgaacaaggtggagcattacggggttcagagggttaccggcgatggccggtgcatgtttcgagcgctggctaaaggaatggcaaaaatcaaggggattcctttggccccaaaggaagaagtagaagatgcagatgattta

SEQ ID NO: 71735 - DNA, 454 bp, Zea mays
  unsure at all n locations
  Clone ID: LIB3078-031-Q1-K1-B12
cggacgcgtgggcggacgcgtgggcaagctgtaaatctcgcctagctcgtcgtcggagacgcaaggagaagagcaagggggggcgcagaggcagaggcttgccagcctacctagctcgtcggggccctatggagatccagcaccaccgggggctgggcaactccaaggttgtcaaggtgcagagcgaggaggcgtgggatctgttcaccgatcaagcgagcaacgaaggccggcccgttgttgcccatttcggggcgtcatggtgcgtgacgtccctgtccatgaactacaagtttgaggagctggcgcagacccaccccgaggtcttgttcctctacgtggacgtcgacgatgtccagagtgtttcatccaggtacggagtgaaggccatgccgacgttcttcctcatcaagagccaggangtggtggggaagatcgtcggggcgaacccaga

SEQ ID NO: 71736 - DNA, 358 bp, Zea mays
  Clone ID: LIB3078-031-Q1-K1-B2
cccacgcgtccgctgtcgtgggatcccagccaccgacgctagaagaagagctcggcgatgcccaggtgccgcgagaagatgccgaagcagatccatgagattaaggacttcctcctcaccgcgaggaggaaggatgcccgctcagtgaagatcaagaggagcaaggatgttgtcaagttcaaggtgcactgctccaagtacttgtacacgctctgcgtcttcgatgctgagaaggcacactagttgaagcaatctcttccaccaggcttgaccgtcgaggaggtctgattggatacatggccacgccgggttgaactacgcaagcttatctatcagtagcaggacatgctactcatgt

SEQ ID NO: 71737 - DNA, 408 bp, Zea mays
  Clone ID: LIB3078-031-Q1-K1-B3
ccagagcccacagatgtccatcattagctctatcacaggacttagtaccagtagctcttgtggtccggttcatcgtggatcatggtgtactccaccaagactattagttgaagatcaggatgtttttcatccggatatgccacagaattccactggcaagaaggccaggaaagactaaggaagcaaaaggaaaccaccaggagctgtaaaaatcagcacatggtcactggctcgccttaacgcagatgacgtcacgaaggcagctgttgaggccaagaagagatctaaagtcctacagccgatcacaatgcggtggaatattcttaaacctgacacgagatcagacgaaagcagggtgttcctacctgtacctgaacaatcttcggatcccatggcaagggacattcg

SEQ ID NO: 71738 - DNA, 183 bp, Zea mays
  Clone ID: LIB3078-031-Q1-K1-B4
gcggcgcttgccctagctcaagggatgaggcgtactcgatgctcatgccttgatctttcagccaaagaggcgttaacacaagcaagcgcatgatgaacgccaagatgtccacaagcttgctggtctcagaactgtaactgttctacatgaacactctggtaggagcccacctgccattgatgg

SEQ ID NO: 71739 - DNA, 462 bp, Zea mays
  Clone ID: LIB3078-031-Q1-K1-B5
cccacgcgtccgcccacgcgtccgcgcggctgcgcccaccatggacgaggatgagtttcggcgcatgctcgacctcttcccggtcgtccgctcccgagactactgctgctccgatcttggaacatccagcagaggaaccagacagcgatcacgagttcaggaggcaactaagggcgataataaggactcgtccggtggacgagatatgtttatgcagaaattgaagatggctgcggagaataagattggagcgacaaaggcagagttcttctgcaagacattcgaagaagttcatgagaaacttgttcacagagagctgaatttggatgctgctaagaagttcctgagcgcatatgagagctgatgatgaacaataggtagatgctgcttaaagggtcggaagtgccaatgatctgggaaagtgtgatgcctgtgagatttgatcacaggccaactttaaca

SEQ ID NO: 71740 - DNA, 339 bp, Zea mays
  Clone ID: LIB3078-031-Q1-K1-A11
cgacgacgacgcaggcgccacacatggcatcccagctctccgccgccgtgccgcggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaagcgcgcgacttcggcctgcaaacgggtgaccccgtcgggttcaccctcggcgacacgc

SEQ ID NO: 71741 - DNA, 462 bp, Zea mays
  unsure at all n locations
  Clone ID: LIB3078-030-Q1-K1-G8
ctcggcggccggcctcctcttctcttcacccacacgctggtcatagagatgtgggctggagaggcgaaggcggcggcggtcccggagtctgtgctgcggaagcgcaagcgggaggagcaatgggcagcggacaagaaggagaaggcgctcgcggacaggaagaaggcgctcgagagccgcaagatcatcttcgcccgcgccaagcagtacgccgaggagtaccacgcccaggagaaggagcttgtgcagctcaagcgtgaggcccggttgaagggtgggttctatgtgagcccagaggccaagcttctgtttgtggttcgcatccgtggtatcaatgccatgcaccccaagacccgcaagatcttgcagctcctgcgattgaggcagatcttcaacggtgtcttcctcaggttaacaaggcaaccattaacatgctgcgcanggtggagccatatgttgcgt

SEQ ID NO: 71742 - DNA, 438 bp, Zea mays
  unsure at all n locations
  Clone ID: LIB3078-030-Q1-K1-G9
gtgcgagatcgatgaggagacatctaacaagctcgaggggctccctggtgttctctttgtgctcccgtattcgtatgttgatgctgaatacaaggactacggagctgaactcttcgtcaacggtgagattgttcagaggactcccgagaggcagaggagggtggagcccgtgccacagagggcagcagacaggccgaggtacaatgacagaacccgctacgcacgcaggagggagaaccagcgatgaactgtgcgataaaatcataaaaaagaccacagcaacaagtcccaggtggtttcagctctggaattcaaggatcaccgagtatcacctgtattaaattggcaatctcactttatgtgcagtctagagtatcgtttctatgtgctcagcttggacgtattgtattctttaattacagctacttggagattngg

SEQ ID NO: 71743 - DNA, 451 bp, Zea mays
  Clone ID: LIB3078-030-Q1-K1-H1
cccaaatataagaacttcaatgggttctgctgcatatgctcctgagagagatgcaatggtctggaaagtaaaatcattccctggtggcaaggaatacatgtgcagagcagaatttagtcttcctagcataacagcggaagaaggggccccagaaaagaaggcaccaatacgagtgaaatttgagataccatatttcaccgtatcaggtattcaggtccgttatctgaagataattgaaaagagtggttaccaggcactaccctgggttagatatatcacgatggctggcgaatatgagctgagacttatatgagtgttctcttttctggctgatggaagacatttatgaagctgcaagatacatatttgctcgagacagcaaccgtatgacatatgaatgttagcctggacgtataatgccgaccacacaaagttttccccctgggggctt

SEQ ID NO: 71744 - DNA, 431 bp, Zea mays
  Clone ID: LIB3078-030-Q1-K1-H10
cccacgcgtccgtgtgtcttcaacaagaaggacccaatcgttctgggtgctgatgtccttgaaggaggagccaaggtgggaactcctctctgcatacccagtaaagaatttattgatattgggaagattgcctcagttgaaatcaaccacaagcaagttgatatggctacaaaaggccaaaaggttgctattaagattattgcgaacaattctgatgagcagcagaggagcttcggcagacactttgatatggaagatgagcttgtcagccggatatcaagaagatctattgatattttgaaacagaactacagggaggatttgacaactgaagactggaaacttgttgtaaagttgaaatcaatattgaagatacaatgaaaagccccctaccctaacacacctgcccatgaatttgggagttgtggttc

SEQ ID NO: 71745 - DNA, 431 bp, Zea mays
  unsure at all n locations
  Clone ID: LIB3078-030-Q1-K1-H11
aagaaacctgacgcgcagcctgaagaaataattgagatagagaagctgatcgctgaggcatacaaaggcatcgacaagacggtgaaggttggcgccatgcataggaacacggcgaaccatcggaagtctcgactggcaaggaggaagaaggccatcgagatactccgtggttggtatgtcccaaacgctgaacctgtcgctgccacctaggattcttgagaaatcgctatcatgtgtcagcttttcatttttgggcgactatgctattcacgggtctcaacagcttgccaggttctctattgaaatggtctgttcataccttttctgctatgcgtttgctctgtactagcagtttgactactggctagaatgggcagctcttcntccctggttctggtggtattcgcctcaacgttgtaaactgatttcag

SEQ ID NO: 71746 - DNA, 250 bp, Zea mays
  Clone ID: LIB3078-030-Q1-K1-H12
actcagctttttcaatactgcatcacctactctctcactgtcaaattctaaatcttctcgcggtcccccatcttcaagaatgccaactacgcctacagctactatctattcctagctcatcatcagcgtataacgtactcactcatatttatttatatatttacatacctatatagatctccatagtccataccaaccatctgtgtcacttcatctcctccttcaattctatctcctcctcccatgcata

SEQ ID NO: 71747 - DNA, 363 bp, Zea mays
  Clone ID: LIB3078-030-Q1-K1-H2
gggagattagcgactggtaactacaaccggattacacaaggttctttgctgctattcaataaatgcctcttgcttaacgttgaggcagttaggaagtacaattcattctctgagatgctgaaaggagagaaaatctcaaatgttcttcctggtatttcatcaattgtagaaggtgtgaaagtatataggaaattctatgcagaggaaaaggagaactcttatggagttttagcgatatcagtttcaaagccaacatctcaaccttacataaccatgaataatatccttgctggattggggtatgatggactgggtagactccttggtatggcgaaaacaactggaactgttccagatggacta

SEQ ID NO: 71748 - DNA, 464 bp, Zea mays
  unsure at all n locations
  Clone ID: LIB3078-030-Q1-K1-H3
cccacgcgtccgcccacgcgtccggattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtatngtgtggtgtgtgtgagagagagagaaacagagttcttcaatttgctatccttctctgcatgt

SEQ ID NO: 71749 - DNA, 445 bp, Zea mays
  unsure at all n locations
  Clone ID: LIB3078-030-Q1-K1-H4
cggacgcgtgggtgcagccaaaacaaaatcagcatccggatctccacattccccaccaaaaatcatcctccggacgaaatcagcggcggcggagatgggagcggagtgccggtacgaggtggcgcaggcggcgtacatcaagctggcgctgcacgcactgaagcacccggcgaccgccgtcaacggcctcctcgtcggtcgcctcgtcgagccttcgtcctcaccggccgtcgtctcggtcattgacgccgtgccgctttctcaccacccgcaccatctgccgctgctccccacgctcgagctcgcgctcaccctcgtcgaggaccacttcgcaacccagggcgaaggcctcgccgtcgtcgggtactatcacgccaacccgcgctgcgacgacaccgagcttccgncagtcgccaagcgcgtcggagaccacatcttccgatac

SEQ ID NO: 71750 - DNA, 453 bp, Zea mays
  Clone ID: LIB3078-030-Q1-K1-H5
gccgaagtaaaggcacggcgtttcgccttggggctgtactcaaggatgtccttgttgagggtctcccagatgatcttcacattagatgcaatggaagaattcgtgttgctattactcagctatcctggaggcctaggggcttgctggtggaccaatttgactccaaagaagatgtcattaatgcagtaattacatcctcctttattcctggatacttagcacccaggccagctaccttcttccgtaataggctctgcattgatgggggccttacattgtttatgccgcccacttctgctgcagaaacagtccgaatatgtgcttttccagccagccgtttgggattgcaagatattgggatcagtcccgattgcaatccagagaacagggctagcccaagacagctgtttaactgggctctggaacctgctgctgatgaaactctagacaaat

SEQ ID NO: 71751 - DNA, 439 bp, Zea mays
  Clone ID: LIB3078-030-Q1-K1-H6
cccacgcgtccgcacggaatatcaccatcagtaccatttcatcttggtttaaactatagagtacagtcgcagctgacacaacccaaggcatgcctattatatacacacccttggctttgcttggctgctgttattctgtaagcacgctagctagcttctccagctctccgggctctaacacgtagatgtaaaccatctgctacacatacgtacatagcgtggtggacagaaatggatggatcagggtcttcaggcgtgcgccagctccttggagacgccgtcctggtacggcgcctcgcagaactcgccgtcaaagtcatcgcacgcctcgcccgggaacaccgtctttggctcgtcgtaggacaggtagttcctgtccaccccgaccacacttctgccccacgcgttcgcggacgcgtgggcggacgcgtgggccgac

SEQ ID NO: 71752 - DNA, 357 bp, Zea mays
  Clone ID: LIB3078-030-Q1-K1-H7
tcgacgcacgcgtcacgccacccgcaaaacacactcgaacggagactgaaggagctccctatcatatgcctcgaccgggtctacggctgatgcataacttcattcatgccttcgatcatttcaactgctttctgcacttctatatctttcattataaggtgatcaactgattctgacgtcatgcggcattgaaccttgctgtcgcacaccttcagttagcctctaccactgctccatcgctcggaggcactttcttgtacttctttctgtgttgcaatgtgcatatgcacgagctgacctatcatacttactatttaatggttaactcgtaatgctcacttgtgattacagactgac

SEQ ID NO: 71753 - DNA, 461 bp, Zea mays
  Clone ID: LIB3078-030-Q1-K1-H8
cccacgcgtccgcccacgcgtccggttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctgagggaactgttagcgcaccattcaagtccacgcacgggtatcactt

SEQ ID NO: 71754 - DNA, 432 bp, Zea mays
  unsure at all n locations
  Clone ID: LIB3078-030-Q1-K1-H9
gatgacaccacctgtgttgtagttgacattatcccatccgatcatttgacatcaccacagttgtctgcaaagaaaaatcataacaagttgaagtcactttttcgtagaaggtcgcatagttctgttggaaagctcgggggcaagtctgcctccattggttctgtggaggagttatttgaagaaggctctgcaatgttagaagaaaggttgggcaggaatttgtctttgaaagcagtttcagcaccttttcgctgtgcaatctgccaagtggaccaagagcccttcgaagatttgatgagagataatggaggtggttactgctcttccccatgcgctccatggggtggtccatatctctgtttggactgtcggaaaaagaaagatgcaatggaagggtaaagatctagctgctncacagcatgcaagtgaaac

SEQ ID NO: 71755 - DNA, 272 bp, Zea mays
  Clone ID: LIB3078-031-Q1-K1-A1
tcgacgagaccttcaccaagaaccgcgagctgtaggtgatccactcccgctgttccatgctgagcgcgctcagctgcgtcttccccgagctgatctcccgcaacggtctcaacttcggcgaggccgtctgattcaaggccggcttccagatcttcaacgagggcgggctggactacctcagcaaccctagtctgatcgcacagctcagagcatgctcgtcatctgagcctgccaagtcgttctcatgggtactcgcgagggctaccggattg

SEQ ID NO: 71756 - DNA, 166 bp, Zea mays
  Clone ID: LIB3078-031-Q1-K1-A10
cttcgccagcaggaagaagcagcggacctgctccctcacattctccgaggtgtatggcggcgtgacgatgaacaacacgctgtgcctcggcgtgttcctggcgctcatctacttcaagaacctgacgtgggacttctcgtcggaagtgctcatcatcctgctcgtc

SEQ ID NO: 71757 - DNA, 327 bp, Zea mays
  Clone ID: LIB3078-030-Q1-K1-G7
cctagttatcacccatgcacgttcaggaagcatatttgagactctgcgactcgggataccgctaatccttgttgtggatgaagacgtgatggacaatcaccacagcgaattaccagaagaattggctgccaggaagcatgtcttctgtgcacgcgcacggccattagcagagacaattcgggccatggacctatagacactgcttccttatcagccacgggatgccaacccagtcgtctccctgatcaacagagttcttggctatccagatgatcgacgaatctattcggatgctcttcaatccatgtggattagatagtcttgcgt

SEQ ID NO: 71758 - DNA, 378 bp, Zea mays
  Clone ID: LIB3078-030-Q1-K1-F4
ggcgggtatgggcgatatgccgatgaggcctgcgcggccgggcccgccgatgcagcagggtggtccgcccccgatggcgcgcctccgccccgaaccaatcgaccgcgagaagacctgtcctctgctgctcagggttttcacaagggttgctggtcaccaccaaaatgaagagtttgcagtgagagggaaggaaccaaaggatgaagttcagatttacacatggaaggatgcgaccctccgcgagctcactgatcttgtgaaagaggttgctcttccagcaagaaaaaggaatgcaaggctttcttttgcatttgtatacccagacaagaatggtcgttttgttgtcagacaggtgggttcgaccttcgcttacggtca

SEQ ID NO: 71759 - DNA, 444 bp, Zea mays
  unsure at all n locations
  Clone ID: LIB3078-030-Q1-K1-F5
aaaaaactctgcggagattgaccgaccactaccaccgcctgcgttcccgcgccggcaccggcatggctgccgctgccccccatgcatactcctccctcgtgcctgtttcggctgcgcggcctctctccggaagcacagtttctttcggtgcttcgtgccacaagtggaggaaggttccggcatggcgactccactgtgttgctgaagacgaagaggaagtcaaagattttggagtcaatatggcactatccatgctaaaattttacaaacgagaaatatcacctttactaccttcaagctgccgatatgtaccaactngcagtgagtactctatgcaggcgtacaaacgatatggtgttgtaaagggttccatcttgactgcttggcgcctttgcccgtgtaatcctcttggtggatatgggtatgatcctccaaaatggtttg

SEQ ID NO: 71760 - DNA, 375 bp, Zea mays
  Clone ID: LIB3078-030-Q1-K1-F7
cgcggctcctccttcctcgaccccaagggccagcggcggctacaccggatacgacggcgcggtcgcgctccccgccggaggcagaggcgacgaggaggagctccagaaggagaacatcaagaacgccgcctagtccacgggcaacatcacgctgagcgtcaccaagagcaacccggacaccggcgaggtcattggcgtattcgagagcgtgcaaccgtcggacaccgacctcggggctaaggcgcccaaggatgtcaagatccagggggtctggtacgcgcagctcgagtgattcgttttaactgttaaaggcgtcggaccgtcatggagaacttttgagagaggaagatgaatcgcgtatgtaactattaatgc

SEQ ID NO: 71761 - DNA, 445 bp, Zea mays
  Clone ID: LIB3078-030-Q1-K1-F8
ctcaacctcccaccacaggactctgccgatgcctcaacagtttcattgatcgggccagatcgtttgcagctttgttaaccgaacaacaagtgtacagagaggaagcagggtagcagtctatgcatccgttcttttatatttgtcgcagtttaattcaaaaataaactagcggacggcaaattttcgagaactgtagtatttgataagttgttactagatcacagagttttatttcgactatagtcgtaagtgataagccacatctgtagctaaagggagctctaattttaactcacccgacattaattgttttcagatccagctgatcgccacactgtagtgtagtgggtttagatggattctattcatgttattacgctcgattaggcgaataaatgttacatgtgaagatctgaaattatgagaaattaaaccgttatttctg

SEQ ID NO: 71762 - DNA, 440 bp, Zea mays
  Clone ID: LIB3078-030-Q1-K1-F9
gcggcaaaggaaggggcactggttctctacacccttgcctatccttcaatggccgaggcgactgataatgcctgctatttctggggtgttccatgcaccgatgttcttcggcctactgtcgaagccattgcctctcacatcggtgttgctccatctggaattccacgaagctctccgagtcgaaatggtcggctatcagaggattacttccaacggatcgatgctatcgatttcaccatcaaacaagacgacggggctctgccacagaacctctaccgcgcagacatcgtgcttgccggcgtttcgcgtacagggaagacgccactgtcgatatacctagctcaaaagggatacaaggtggcaaatgtcccaatcgtgatgggagtggaccttccaaagtccctttttgagatcaaccaggacaaggtttttggactgac

SEQ ID NO: 71763 - DNA, 461 bp, Zea mays
  Clone ID: LIB3078-030-Q1-K1-G1
cccacgcgtccgagaaaagcttctactagctacatatatatatatataccagccgatgaaccatgcatgcagtcacatgcggcatagaattagcagctagcgacggtgaggaggatcgaaaggaagaagacgtacgagatgaaaagagagcgaggcttacatggcgatgagagtggtagctctggtagccaaggatgacttgcctgtgtgctggccacgctcccctcatgcaaggaccatctcgtgtcgaccgacgagcgagcgagcgatcgatcgatgacaggatgacgaagcttggggtgtacgttggtctctcacgggcagtctccttggctagccctgactcactcttaccgaccatgctagcctctgcatatgtcgtgttgctgtacagattactggtcagtgacctagctagtatgcaagacaatgcgcttcgtcagcatgtcacgagcgatgca

SEQ ID NO: 71764 - DNA, 391 bp, Zea mays
  Clone ID: LIB3078-030-Q1-K1-G10
tgcgctgcagcccagagttggaacccaagcgcacgcagcatcgtctgtcaactcttcccttttgggccgcgttggatatcgcggcgaatctagacgacctgccgtctctggatctgatgcacgaactgctccgtcagatgaagtgcagctccaagcccgacaagcacctcatcctcatcggcccacctggctctggaaagggtactcagtctacccttattaaagatgaatattgcctgtgccatttagccactggtgatatgttgagggctgctgcggcagccaagacaactctacgtatcaaagctaaagaagctatggattatggagagcttgtttcagataacttggttgtcgcgattattgatgaagctatgattaaaccgtaatg

SEQ ID NO: 71765 - DNA, 339 bp, Zea mays
  Clone ID: LIB3078-030-Q1-K1-G11
acccacgcgtacggccacgcgtccgaaccaaatgctttcaatggtcttgatttggaaaaatactcattgactcaacagatgcctgagggtaacatcactattcctgttcctcaaggaacaaaatcaagatttgtggtcgatgatataaagaagaaccatctgaaggttgttctgaatggccaaccacctatcattgatggtgagctctataagccagttaaggctgatgattgcttctggagcatagaagatggaaaaactctttccatattgcttacaaagcacaaccaaatggagtggtggaagtctgttataaagggtggccctgaagttgatacc

SEQ ID NO: 71766 - DNA, 275 bp, Zea mays
  Clone ID: LIB3078-030-Q1-K1-G12
aatcgacccacgcacccactcatacatcgagagtctatactatcccattaccctttccagctggatacatccatcacagctcctggcgaaattccatatatcgaggctcaccatctttcatatgatattaacctaaacttaaccttagatatccaacaaaccagaacaagattatcaacttcttcatagaccacatgccaagccatgccttcaaacaagatcaactaaatcacttctaacacagatattactatgattatccttacaaaattcta

SEQ ID NO: 71767 - DNA, 368 bp, Zea mays
  Clone ID: LIB3078-030-Q1-K1-G2
tgtacttcgaagatatagctggagtgattgtgaatcccaatggtcagaagaaaggtcggtgtctgggtgtacctatggaccgggagggtgctgacctttgtcctactatcgatcgtggatcacatgctatcgttcgagaactagccgtaattgagctagacttgcatgtgcatcatgtcaaatgtgtgaagcagctgctgtcacggtgctctcggactcgttggattctttgacgtctagacacttaatttcggagagaacacaaatacggcttccgtgattaggatccgtgatgtagctcagatgggtgtagttgacgctgagtacgttgtggagtccaccggcgtcttcactgacaaggacaaggc

SEQ ID NO: 71768 - DNA, 466 bp, Zea mays
  Clone ID: LIB3078-030-Q1-K1-G3
ggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtaccttcaccccaaggacggcgtctacccggagaaggtcaaccccggcagggagggcgtcggccagaacttccgcagcatcggcaagaacgtcaaccccatcgacgtcaagttcaccggcaaggccaccttcgactaatcacacttcacgtacgccgcacgccccagccgggatccaaattaa

SEQ ID NO: 71769 - DNA, 421 bp, Zea mays
  unsure at all n locations
  Clone ID: LIB3078-030-Q1-K1-G4
cccacgcgtccggagaacttcgagcggttcaaggagtcagaggtgtaccactgccgctgggccatgcttgccgtccccgggatcctggtgccggaagctctgggcctgggcaactgggtgaaggcgcaggagtgggcggccgtccccggcgggcaggccacgtacctgggcgccccggtgccgtggggcacgctgccgaccatcctggtgatcgagttcgtggccatcgccttcgccgagcaccagcgcaccatggagaaggaccccgagaagaagaagtaccccggcggcgccttcgacccgctcggcttctccaaggaccccgccaagttcgaggagtacaagctcaaggagatcaagaacgggcgnctcgccatgctggccttcgtcggcttctgcgtccagcagtcggcgtaccccg

SEQ ID NO: 71770 - DNA, 451 bp, Zea mays
  Clone ID: LIB3078-030-Q1-K1-G5
cggacgcgtgggcttctacgccgtcgtcgaggccgctgcagttcgcgcagacggcagccggcttggctggttggcgaggtatccggtctctgcaactcttccacagattggatccagattattccttacatggggtgtcttctggagttttcctgaggtgattgactgactcgagaatttgccgacgcttgaagaacgacctaatgtgagcttttacatacttgatgaacagcttgagctcttgagcaaggtgctgaatgcaagggatgacatgattggtgttgagcgcttagaagaagattgtgatggcaaggttctatctgtttgaggttgcttcaccattcctcaaagcacattgcatcttgctttagcgcttttttgattgccgtcgtcgaggccgctgcagttcgcgcagacaacagccatcttggaggtatctaattccaatatt

SEQ ID NO: 71771 - DNA, 444 bp, Zea mays
  unsure at all n locations
  Clone ID: LIB3078-030-Q1-K1-G6
atcgccagtgaaggcccgcgcgcgccgtcgtttgaatcctggttttctccctgctcgctgcgctcacgtcgtcgtcttcctgctcgttccgcgacgtcgctcccagtccacagctcgttggcttccctgtgcgcggttgcggatgccgtcgcccgatccttgtgccttggcccgatccttgtgccttgccgagctcatcaccgccgcgagactctgcatcgctgtgctcagccacgcctccctagtcgtcttgcacatactcatctccaaacaggaccacgctgccgactattgaccccgtcgttgcctcgcagcgctcgaacactatcgttgtcactcgacaacgtgtntgcccgtcaccacgttaccttcagcaacacggctctactggactccgtgcgctcgtcgacacctggttatcgatcttcgncacgccgtgccccc

SEQ ID NO: 71772 - DNA, 463 bp, Zea mays
  Clone ID: LIB3078-030-Q1-K1-F3
cggacgcgtgggttctttcgttgctgtagggagcataacacgccgcagaaacgttatatgtgcttggctgtttggagttggagctcccgaagcactggtcattggagtagtcgccttgttggtattcggccccaagggtctagcagaggtagccaggaatttggggaagactttgcgtgctttccaaccaaccattagagagctacaggatgtatcaagggagttcaggagcactcttgaacgagaaatcggaattgatgaggtttcccaatcaacgaactataggcccacaaccatgaataacaaccaacaacctgctgccgacccaaatgtcaagcctgaaccagcaccttatactagcgaggaactaatgaaagtaactgaagaacaaattgctgcatcagctgctgctgcttggaatccacaacagcctgccacgtcgcaacagcaagaaagagcgccc

SEQ ID NO: 71773 - DNA, 392 bp, Zea mays
  Clone ID: LIB3078-030-Q1-K1-D9
agcgtttcttgctcgtcaacagcgcagcagttgcatgcgggcgtcggcaagttcgccggggccgcgggctggatctggaagaagaagcgcgaggagctcccctgcttcagggccagactggccggcaagccgccgcgcgcctcaccggcgaagggcggcattgtcccggccagcgacgatgacgacggcgttagcctcggcaccgtgaagctgccgggcaacatcgacaccgctcggttggagtccttgctcttccagtgggggaacagcctctgccaaggcgccaacctgccacttccggtgcctctcaaggtggacaaggttgagggcgggatcaggctagggttcgtcgcggtcgatgacggcgcgacgcggacgctggtgtacatcga

SEQ ID NO: 71774 - DNA, 366 bp, Zea mays
  Clone ID: LIB3078-030-Q1-K1-E1
agcgagtgctacaactgcggccaggagggccacatctcccgcgactgccccaacaaaaggcgttaggcgcggcgccaccgtcgcgtcggatccggcggagtcccatgtcgcctctcgccgcttccctacccctccaaaggtatcgctcggctgactcttgcgtgaagtcgtcggagcaaactatctatcagtagtactagcagtgtcgtttcgttttggtctgtcgtggcgtggtagtaagaaatgcaagtgagcagcaccagtatctttccgtttgaatcagttgtaaggcagtcatggtcatggttggctctgccggatctatctgtcatgaactatctatattatatcattatcaatgttatg

SEQ ID NO: 71775 - DNA, 438 bp, Zea mays
  unsure at all n locations
  Clone ID: LIB3078-030-Q1-K1-E10
atccaatgtttgtaagttaccagacatcaaaaagtgaagtaatatatttatctgaagaagcaactgaccctagtaaataccttgatggtactcgggtgtatgtgcaaggatcaatgtgggatggttttgcgaatggtaaaggggacttcactgatggtccatatgagattcagtatccagagagttttttcaaggacagcttctacaaatatgggttcaaccctgaagttgggtctgtaggggttccagttgccgcaacaattagggccacaatgcctccagtaggatggagcattccgattttaaagaaaagaattgatgggtacatcgaagaagtaccaaatccaatatgggactaccacaagtatattccatactcaaaaccagggaaggtccatgatncagatgaactatatggagccccaaaagacctggatg

SEQ ID NO: 71776 - DNA, 396 bp, Zea mays
  Clone ID: LIB3078-030-Q1-K1-E11
gggctagcccgccgcgcagcgcagccacaaattaaacggagcccggcctgggcatccatgattcggggcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatc

SEQ ID NO: 71777 - DNA, 371 bp, Zea mays
  unsure at all n locations
  Clone ID: LIB3078-030-Q1-K1-E2
gaaggactccatcaagcccttcgacgcctgctgcctctgcctcaagccgctcatcgacgcgctctgctgccccaagggccataccttctgcaaggagtgcatccttgagtgcctcctcgcccagaagaaggacatcaagtgtaagctagcagctcacgaggcccagaagaagcaagagaaggaagaggaggaggaaaagctaattctgcagaaggctaaggagttggatgcctttgatcagcagaatcatggggctgttccccagtaccatgatcgcagtggttcccaaggcaagaatgggtttcatggagcgaacagtgtgaaggtcacttcttttgaagaggaagccctncgtaacatgaangcattct

SEQ ID NO: 71778 - DNA, 440 bp, Zea mays
  Clone ID: LIB3078-030-Q1-K1-E3
gccggccgccgaggcgcaggctgctgctcctgaggagcccgagaaggccagcgagtgaggccgtgcgcacgcagcggcggccagggcccaggggatcggcgtgcgcgcgtggcggggtagtcgctcgcgcgcgtacatggcagtatgacacgggattttgctgttcagtacgctacggttattactggcgtctctctgtgtgtgtgtgtgtcgtacgtagcccggtacgtagctagcagtgactgtcgcgtggacgtgtcccgtgcgggctgcgagtgacgtgggctaaataaagtgtgcgtcgggtggtaatggtggtggggcccggtgtcagtgcgcgcggtgccccatgcctgccgcggctgcagcttggtgtgtctggtgttggttgagttcctggtctttctgtctatctattctcacgcatggcaatttgggta

SEQ ID NO: 71779 - DNA, 463 bp, Zea mays
  Clone ID: LIB3078-030-Q1-K1-E4
cccacgcgtccggtcagcctatgcctaccaccggaagtcagacaactcagacagagagctccaacaggagctggaaaaggaccgcatgcagtaccagccagcacagcggttcatggacgccaaggtagtatcacagatgtcccctgacttgaggtcttcctactacataccaaaaggtgtcccaaaggctgatcccgcagatagaaccgctctgcattctagcatgattcatgggatcgcccctttcagtggcattgcagctgttggaggtggctacaacaaggtcaatgcagttcagtatggagtttctaggatgtactagttctagttgcattggccatctccgaattcctcagctgatgagttgaagtaataacatggcgaagaccagatgtaagtacccgaaaactgccataccggctctgagccaaagatagaaaacatggaatacggatctcggatc

SEQ ID NO: 71780 - DNA, 392 bp, Zea mays
  Clone ID: LIB3078-030-Q1-K1-E5
gcccaagctacctacatggaaggttagggcgatctaccaattcgacatggccgggtacacgaagatcttcctcaagttccccaggaagttctggcctgaagggaaaggaagggagttcttcctctacgccagcagcaggagaggttactacggagtgtggcaggagttcgagaagcagtaccctgacgccaatgtcctcctggtcaccgtgaccgacgaggagtcgaggcgcatcgagcagcagtcggacgagcagaccaaggcggagatcatgcaggtgctgcggaagatgttccccggcaaggacgtcccggacgccaccgacatccttgtcccgagatggtggtccgacaggttctacaagggcaccttcttcaactggccagttggcg

SEQ ID NO: 71781 - DNA, 301 bp, Zea mays
  Clone ID: LIB3078-030-Q1-K1-E7
gcggaaacacaagtctggccgctcctcgaaacaaccagcaaccgaccgtgctaggggatggacatcatgccatgcttagtccaaaccaaatcttcaatacctcccaaagaaataccttgcagtggttcctacaaactgggatacctgatactgaatcaagagctacagcaatgaactgctttctagtcctcatatccattcatgtgcgcataagagttcctgaccatcgagcaatgtataggctggagatggagctggattagtcagttatgtacattaggttctctttaacattcttaca

SEQ ID NO: 71782 - DNA, 410 bp, Zea mays
  Clone ID: LIB3078-030-Q1-K1-E9
cccacgcgtccgcagcgctccgcgtcggctaccgccacctggactgcgccgctgactacgagaacgaggctgaagttggtgacgcgctcgcagaggcattccagaccggactcgtcaagcgggaggacctgttcatcacaaccaagctgtggaactcagaccatgggcatgtgcttgaagcctgcaaggacagcctgaagaagctgcagctagactatctcgacctctacctcatccatttcccagtagccactcggcacaccggagtcggcacgacttctagcgctctgggtgacgatggcgtgctggacatcgacaccactatctccctggaaacgacatggcacgcgatggaagagcttgtttccatggggctggtgcgcagcattggaatcagcaactacgacatc

SEQ ID NO: 71783 - DNA, 416 bp, Zea mays
  Clone ID: LIB3078-030-Q1-K1-F1
cggacgcgtgggctgtcagtgtgaatggtaagctctacactgctaagcacatactagttagtgttggtggccgaccatcgatgccagatatccctggtatagagcatgttatagattcggatgctgcgctggatttgccttcaaaacctgagaaaattgcaatagtgggaggtgggtatattgctttggagtttgctggcattttcaatggcttaaagagtgaagtccatgtgtttattcgtcagaagaaagttttaagaggatttgatgaagaggttagagattttgtcgctgaacaaatgtctttaaggggcatcacgtttcatacagaacagagccctcaagctataactaaatcaaatgatggtctggtatctttgaagaccaataaagaaaatttttgtgggttctcacat

SEQ ID NO: 71784 - DNA, 380 bp, Zea mays
  Clone ID: LIB3078-030-Q1-K1-F10
gcgcaccactccgcgctagctgaggacggtacagcggcacagaggtgcgacgtacgacgacggcgacgcgggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtccgcgaaccgcaaggcgacggcggggctgaagctggaggcgcgcgactccggcctgcagacgggtgaccccgccgggttc

SEQ ID NO: 71785 - DNA, 411 bp, Zea mays
  Clone ID: LIB3078-030-Q1-K1-F11
gtcacgcgagaagagacgcattgacacactcgcacacgaacttgttagcgatagctgtggtggtgtggatcttcacgatcaacttaacgtcgacaggaccgtgtcatttatcgccagcgctgactcacaacatataagcgcaaaatggtgaacacagcatgcacacggcaatcagaagatcatgaaccacatgacctgtataaaagatatagtgcgccgctaatgcaacatgaactatgacaacgtcgacttcgacacgtacactaacgccggcgagcaaacacctgaagagctgtatctcatgcagacagaagctgtcatccataagctgatcacagtgtctgactagatcctcaacaggtataaggattacgaggacagaatgatgtcacatgtcaggtccaacatcct

SEQ ID NO: 71786 - DNA, 350 bp, Zea mays
  Clone ID: LIB3078-030-Q1-K1-F12
acccacgctgcaccaccctccgctcaccaatcacactaactgcaatactactcacttatactatagcctctaggaacaaactacacacctaaaggcaacaatcgctcacctaccaaaacctccaccactactccacacaatccaataaaaccctcatctacaacacccctacaattatgctctagtaccaatacaccaacaagctcactatctaaccaaaatgcccagtcaccataaagaatatccaatgaattccacaccttataccttcttcatacaacaagtctatgatgacaactaacctcatgacttttaactctccatattataatcgttctgtcttgtacctc

SEQ ID NO: 71787 - DNA, 392 bp, Zea mays
  Clone ID: LIB3078-030-Q1-K1-F2
agaaaataaaagaaatagcaggttattttagaaaaaaatagttggcccatatgtaacgcgcggtagctttaagattattatgtccagcagcttattcatatattatacatatattcaaatttcactctgtgaatagtagtctaaaatacagtagtgttttgagtaaactatggataaactgctggacaaggtctaagataagtgctgcgtggtggcaacaaacgacacttagtcttgtttggtggcaatgatattggaggggctaaagtgttttcgctcctaaacaagctcctaaacaagctcctaagaatcttacgtgttatgttgcattatggaatatctatgtatctgcaaactctctgtagtctgtatgtacctgcgatgtgctctat

SEQ ID NO: 71788 - DNA, 295 bp, Zea mays
  Clone ID: LIB3078-001-Q1-K1-D11
aatccctgaggatgtggctgttaatgttgccctgtcactgagatatgagatcaacaggggggttgctaccttaagggagattgggcatggccgtgatctgaagaaattcctaattgttattgcaggtctctggcttctttcagttctcgggagctgctgcaacttcctgacactgttctatattgtctttgtggcactgtacactgtaccagttctgtatgagaaatatgaggacaaggttgatgcttttggtgagaaagctatgactgaactgaagaagtattatgccattttc

SEQ ID NO: 71789 - DNA, 381 bp, Zea mays
  Clone ID: LIB3078-001-Q1-K1-D12
cccacgcgtccgcaggtgcgcaactcgggcccgctctgccggttcgagctgcccaccgactgcccggagtacgagggctggaaagccggcaggaccgacgccgcgtgaaccggccaaccaggcagtggctgcatgctcttatggtatggttttattgatagtgttgtatgtatgggttgggtttgaatcgggtgctttggttacaaggttgctactcagccgtatcaaaggcaaagtatagaggcagtagatgcagagatggtttatgatcggtttcctttttctccttaaagaggggctcatgaagtttttccaaatgaccgaggtggcatatacttgttagttgttactacgtattcctgctggatttattctaaaaat

SEQ ID NO: 71790 - DNA, 322 bp, Zea mays
  Clone ID: LIB3078-001-Q1-K1-D2
gcgcggacgcgtgggcgaggcccagtcccgcggcggccgtggaggcggcggcggtgggtacgggggtgggcgtggaggcggcggctacggcggtggcgggcgccgtgatggcggtggcggctacggcggtggcggcggctacggtggcggcggcggctatggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcg

SEQ ID NO: 71791 - DNA, 336 bp, Zea mays
  unsure at all n locations
  Clone ID: LIB3078-001-Q1-K1-D3
gggcgcggacggngcangagaggtatcatagcttggcccgcatgtattatangggtgcagccgccgccattggtgtcgatgacatcgcaggtccggcctccttcacccgtgccaagaaatgggttcaagaacttcaagctcaaggaaatccgaatacaatagtggctcttgctggtaacaaggttgatatgctagatgcgaggcacgtggcagtagaggaagcaaagacgtatgcccaggagaacggtctcttcttcatggagacatctgctaaaactgcaatcaatgtgaatgacatattttatgagattgcaaagagattgcttcaagggcaag

SEQ ID NO: 71792 - DNA, 283 bp, Zea mays
  Clone ID: LIB3078-001-Q1-K1-D4
gacgggctgtccgccgaccccgagaccttcgcgaagaaccgcgagctggaggtgatccactcccggtggggcatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgca

SEQ ID NO: 71793 - DNA, 458 bp, Zea mays
  unsure at all n locations
  Clone ID: LIB3078-001-Q1-K1-D5
cacatcgatgaactaactgcaggaggtgctcatcatctggggagagttcgaccagaggttggcggtggacaaagggcacaaggtgaaagagaagctcggggagaaggcgacggtgaaggtgatccccaacgcggggcacctgccgcagcaggaggacagcaagctcttcaaccgagtcctcctcgacttcctgctgcgcccttcgtccaccgccgcctgacctccaacggcagcgcccaagccaaacagcttagcttgctcggctgccttcttctttggttatccattatcatcctgccgcgcgcgtttccggcgttcttgtttgtttgtagagtggacgaggcgctgccgncttctgtttttgtttgagggtggcaatgtgcagatccctacctgtttgttgtgctgtgaaaaaaaagttgcttgtggctgtggaaaaagatttatcattaatttat

SEQ ID NO: 71794 - DNA, 294 bp, Zea mays
  Clone ID: LIB3078-001-Q1-K1-D6
agaggagctagctgccggaacagacagaaactgggatgtgtcctgcagctgacatgagacggttggccaccaaagggcaaaggggaactttttctctgaaattgaggtgcatgatatagcatggcagatccctggttgtgtgttgtcagtctctgtagataatttaagcatttaacctgaggtctttttgtccaatcttttctctgctatctcaatcagtttacccatatctatattcaaactccagtttacaaaaaaaaaaataacttaaaaaaaaaaaaaaaattataaaaa

SEQ ID NO: 71795 - DNA, 413 bp, Zea mays
  Clone ID: LIB3078-001-Q1-K1-D7
ggccatactatcctggtccatgctgctgctggtggtgtcggctcactcctttgtcagtggggaaacgcccttggggccactgtcatcgggactgtttccaatcaagaaaaagccgctcaggcagctcaggatggatgccaccatcccataatttacactagcgaggatgtcgtcgcaagagtcaaggatattacatcaggaaaaggtgtcaatgtcgtctatgattctgttggaaaggatacatacaaggcttccctggagtgcttggcgtcccgcggcttcctggtgtcgtttgggcagtcgtcaggcaaacctgacccaatcccaacgagcgacctggcttccaagtccttgttcctcactcgtcctagcctcatgcattacactgctacccgtgatgagctgctggagtc

SEQ ID NO: 71796 - DNA, 449 bp, Zea mays
  Clone ID: LIB3078-001-Q1-K1-D8
acgagcacttccttgatcacttccagaaagagcatgactgccacgacttttttgaccacgtccagaagaagcctgtgcgaccgaagcctaagccggagcccaagccagagcccaaaccacaacctgagcctgagtaccacccccctacaccgacctatggatcaccgactcctatctaccaccctccggccaagcattgatcgatggagttgaatggtggtcagtgatcgacgtcgctagctaagagttgcatgtgtggtctagctagcgtggtttgcagtcccgcctttttgtttctacagaataaattatagctttatttgggtatgtatacttatttgtgtatcggttagtatcatataaatgtatgatttgagtgtgccgtagttttaatatgcatgttctatgatgtactttattccttttaaaatattattatttatatgtag

SEQ ID NO: 71797 - DNA, 455 bp, Zea mays
  unsure at all n locations
  Clone ID: LIB3078-001-Q1-K1-D9
cgttcggcatccggcgtaacgagaagagcgcctgctacgtcacggtcaggggcgacaaggcgatgcagctgcttgagagcggcctcaaggtcaaggagtacgagctgctcaggaggaacttcagcgacaccggctgcttcgggttcggcatccaggagcacatcgaccttggtatcaagtatgatccatcaacaggcatctatgggatggacttctacgtcgtgcttgagcgtgctggctaccgcgtcgcgcgccgcaagaggtgcaagtcccgtgttgggattcagcatagggtgaccaaggaggactccatgaagtggttccaggtcaagtatgaaggtgtcatcctcaacaaggctcangccagcacgatttaaacctcacctgtggggcaaaacagctctcgcttcatctccatgtgaacgcaggatcaccttccaaggtttttgtttgag

SEQ ID NO: 71798 - DNA, 421 bp, Zea mays
  Clone ID: LIB3078-001-Q1-K1-E10
cacatacatagtttcttctactacacgacgacaaacatggggaagcctgcgaagatcggagggtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccacgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcagggactagggcaccccgttcgtgtcaggtgatgaacaacggcacg

SEQ ID NO: 71799 - DNA, 362 bp, Zea mays
  Clone ID: LIB3078-001-Q1-K1-E11
cggacgcgtggggtccgcgcctccatctacaatgccatgccgctcgccggcgtggagaagcgggtcgccttcatgagggacttccaagccaggaacccttgattgccttgtgcttatggtcatttggtattgctactcagtctttcttcctagcataagtgggctcgtgcaagagctgtctcgcgttgcgcactgggatctatctgtagtattagtaccataacgtaacggctactgtattttgcaatgttttttttctctctcgcttttgttaggtgttcatggaatttcatttctatggatcaccattgcagttgtaatgtgtttttgctggaaataaggaataaggtagagattcggtt

SEQ ID NO: 71800 - DNA, 438 bp, Zea mays
  unsure at all n locations
  Clone ID: LIB3078-001-Q1-K1-E12
cccacgcgtccgggcacgtgtccttctgctacgcgcgggcggtgcagaacacctggctcgggacctgnggcggcgagggggacaaggtcaaggcggcgcaggacgcgctgctgctgcgcgccaaggccaactccctggcgcagctcggcaaggacacctccgacggcgaggccgccgaggccaaggagggaatgttcgtcaagaactacagctactaattaatcgcccggccatcacccgggataccggcgcccctccgagagatacgtgtgtactgatcatgggtaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcg

SEQ ID NO: 71801 - DNA, 351 bp, Zea mays
  unsure at all n locations
  Clone ID: LIB3078-001-Q1-K1-E2
cccacgcgtccgcggcggtcggcgcgaaggtggcggcggcggctacggaggcggtggcggcgacnggggtcggcgcgagggtggcggtggcggctacggcggcggtggcggcggcggctggagggactgatgtgtgggcccatcctggcttcggccgagttatcttatctatctatagtatcgtgttaccgttcgcttctgtcaccgtgttagtgtccgttctacctttggattangtgttggtaccctgttgttcgctttgggtgctcccgctatgaaacgagacgagagaagaatgagcagggttttgttcgcagctatttttgtccaatgatattgatatattggtcc

SEQ ID NO: 71802 - DNA, 357 bp, Zea mays
  unsure at all n locations
  Clone ID: LIB3078-001-Q1-K1-E3
gcgctatgatgttaattctatgaaatcgtttgataatcttcacagctggcgtgaagagtttctagttcaggcgagcccgtcagatcctgacaatttcccttttgttctgttgggtaacaaagttgatgtagatggtgggaacagccgtgtggtgtcggagaaaaaggcaaaggcatggtgcgcctctaaagggaacatcccgtactttgagacgtctgctaaggatggaacgaacgtggaagatgccttccagtgtattgtaaagaatgctctgaagaatgaaccggaggaagaattgtatgtgccagataccgtggatgtggtangtggcaaccgggctcagagatcatctggctt

SEQ ID NO: 71803 - DNA, 72 bp, Zea mays
  Clone ID: LIB3078-001-Q1-K1-E4
aaaggagatatcgacgaggtttttaaggtggtggtggtgttgtgaggagctgctgccgctgctctccagtct

SEQ ID NO: 71804 - DNA, 231 bp, Zea mays
  Clone ID: LIB3078-001-Q1-K1-E5
taaaaaaaaaaaaaaaaaaaaaaaagaattagattaaaaaaaaaagaaaaaaaaaaaaaatgtaagtttaaaatcagaagaggtacccaccttacatactcttacatccaaacttcataactcttatataccaccacttaaatccaatttacttccccccattttacaacatcttttctttcaaaaccctaccattccccccctaaatcttcttttatcccatcctaattt

SEQ ID NO: 71805 - DNA, 317 bp, Zea mays
  Clone ID: LIB3078-001-Q1-K1-D10
ggaggcgtccaagtctctgcctgatttgaaaaaggatgaccagaaggccgtggatgctgctgtgatcaaggctatggaggctatcccagagctgaaagcctatcttggcgctcggttctcccttaaggatggtgacaagccccacgagatggtcttctaaaccgagttttggagttcggaagaagtcgctttggctgtgctctcttgtgacaagccccacgagatggtctcccaaagctgaaagcctacacttgttcattctgcttgaagtctgtcaaatattatgagaagatctaagaaagttttatcggtattgg

SEQ ID NO: 71806 - DNA, 314 bp, Zea mays
  Clone ID: LIB3078-001-Q1-K1-E6
cctacacccacatccatcacgctgaccatggccgcctccgcatttgccaggctacagtggggaactgtgatgctggtgcaaggacggtgctgcaatgcaatgttggcaacaagattcccatcaaactttgtagtctaaatccgaaattggccgagacatgccatctagaggttgagtttgaggaagttgatgatgttatcttctcagtaattggtcatagttcgatacatctctctggatactatgtctgtgcaagcaacaggtctaatgtgggggatgatgaatcagaatcttatggggaagatattgggcac

SEQ ID NO: 71807 - DNA, 397 bp, Zea mays
  Clone ID: LIB3078-001-Q1-K1-B5
acgggcgtcgctgtcgtgcgcctccacgctggcctggacgcccggctcctacccgcggcgctcggcggagcgctgccgcacggcctctcgccgggctccgtcgctggtcatcgtcgcccaggggaaggtcaagaagtaccgccaggtcatattgacagacgacatagaagaggtggggaagaaaggggatacactgaaggtgcgagctggattctaccgcaacttcctccttcccaagggcaaggctacacttctgaccccagaagtcctcaaggaaatgcagctggagcaggagagaatagaagctgaaaagaagcgggtaaaagaagacgcgcaacaacttgctcgagtttttgaaaccattggcgctttcaaactccctcgcaaaggtggaaaa

SEQ ID NO: 71808 - DNA, 201 bp, Zea mays
  unsure at all n locations
  Clone ID: LIB3078-001-Q1-K1-B6
attcgcaagttgaggacttctacctcatcacntatacttcccccaatgaacacatnttccaaatgcccaccaacctctccagcatcattctagatggccccatccttcttaaagcttgcactcaaataccatttcctgtctctccgcaccatattactctccaagtacaagatcacctaccagttctaccccgtcttcccc

SEQ ID NO: 71809 - DNA, 409 bp, Zea mays
  Clone ID: LIB3078-001-Q1-K1-B7
cccacgcgtccgcccacgcgtccgattagaattgtatctaagtgataacaatctgggggaagagaagggtgttcccgtgcttacttggaataaacctgatgttgaagctttggtagacttattaagttacaagcagaattgggagccatcttatattcgccaaagcatgctccctatgttatcaaccatatacttaagagaggttgcatcatctccatctacaccattgctcctttgtgaccaatatgaatttgattcaattcaacggattaagataaagcacggtcacccgtattacttggtaaaatggaagagagctacccgtggtatgaattctattatgtctagcaacaagccagtaatggagggagagacaagtagcgaggtagtgttgttggatgaagacgac

SEQ ID NO: 71810 - DNA, 311 bp, Zea mays
  unsure at all n locations
  Clone ID: LIB3078-001-Q1-K1-B8
gtgcacgcagttcccggacgacgggtacaagaagctgtacggcacggggtcgctggagcgggcgtccatagagcaggggctgcaggcggaggcgcagagcttcgacgcgccgagctcggagctggcgttccagctggcgttcgcgccgcacctcaaggacgtgcggcccgacgaggcccgcgtcgcggagaacgagaagaagctgcacagcatgctgggcgtctacgacgacatcctctccaagaacgagtacctcgccggcgacgacttcacactggccgacactctccacctgccaaactnccactaca

SEQ ID NO: 71811 - DNA, 458 bp, Zea mays
  unsure at all n locations
  Clone ID: LIB3078-001-Q1-K1-B9
caatactcaggtaatctatcctttgggtgagacggcagcggctatacgaggggaaaatgagctatggcttgctatggttcttaggaacaaggtcctcttggatctaaagccatctcaactggcagcagtttgtggaagtttagtttccgaagggatcaaacttcgtccttggaaaaatagcagctatgtatatgaaccttcttctgttgttactggtgttataagttatttagaagagcagagaaattcgctaatcgatctccaagagagacatagtgttaagataccttgcgaaatagatgcccagtttgctgngatggttgaagcctgngcttcangactgacttgganggagataatgatggactctgcaatggacgatggagaattagcccgtctactcangcgctctatagatttactagctcagattcccaaactgccagacattgatcccg

SEQ ID NO: 71812 - DNA, 316 bp, Zea mays
  Clone ID: LIB3078-001-Q1-K1-C1
caccaacatgtatacttacatctcaatggtcgctctaattggtggcattccacctgcataggtctttgaaaatccgaagctaatgcactatgtatatattgataccattgcaaaagttggattgacaaagtatgtcagcgacctattcttgattggactgatctaccatctgtataaccagattgctacaaacaccttacaacgagtgtctcctcttacacatgctgaccgcaatgcgattaaacgcgtttataccatctgtttctcaatcattgatactggcaacagaattagcacacaaactggaattggcacg

SEQ ID NO: 71813 - DNA, 311 bp, Zea mays
  Clone ID: LIB3078-001-Q1-K1-C10
cggacgcgtgggcggacgcgtgggtgctgggccaacatgtgggagtacagcgtgtgtagcggtaataagaaacacgcaacttgttgtggcaaatgctggtgattcccgatgtgttatttcaaggggtgggaaggcatacaatttatcgagggaccacaaaccagagcttgcagctgagagagaaaggataatgaaagcagggggcttcatccatatgggacgagtaaatggaagtttaaacttgtcaagggcaattggagacgtggaattgaaacagaacaaattcctgccttccgagaagcaaattgtga

SEQ ID NO: 71814 - DNA, 385 bp, Zea mays
  Clone ID: LIB3078-001-Q1-K1-C11
ggagtccgttgcttcgctcggtttataggcgagattgaaaatctgcaggggacaaatagatgcactattcatactggtgctggaaagatcgttcctgaaatacaaagtgatgggcaggtaaaggttgatatgggcgagcctatcctttctggactagacatccccacaaaactgctagctaccaagaacaaagctgttgttcaagctgaattggcagttgagggcttaacatggcatgtcacatgtgttagcatgggaaaccctcactgtgtcacatttggtgcaaatgagttaaaggtattgcaggtcgacgatttaaaacttagcgaaattgggcctaaatttgagcatcatgaaatgtttcctgctcgcacatacacagaat

SEQ ID NO: 71815 - DNA, 432 bp, Zea mays
  unsure at all n locations
  Clone ID: LIB3078-001-Q1-K1-C12
ctctctctggcattattggcacgctgcggaatactagttagcgttggcataggcccagcaggcggaagatggatgcgctgcctctgctgcggtagtttctcgggggcaaaccttccacgcggcatggcatggtattgttgatgtacgattcattcgttggaaaacctggacgtgagtgctggaattgcaccatctggccttttctgtacatgcctgatgtaaacggtggtgttgtgtttccccaccaccaacctctcttttcacgatgatgacgcagtgcatgtataattgtatgggttaatgacgcagtgcatgccttgcggagtgggccggtagacaaacatttcggcggttggtcacttggtcagtgacccgttgatattatnatnataattggatctaatgcaacaaccagttctggtgttggtgtcc

SEQ ID NO: 71816 - DNA, 390 bp, Zea mays
  unsure at all n locations
  Clone ID: LIB3078-001-Q1-K1-C2
agaagaagcacttcatgttcggcccgccggcgccgccgccggcgaggccgacgccgacgcgggcccggacgccgaggtacgggcccccgacgccgacgccgacgcccgtgccggagcccaggcctccggcgcccgaggagcccgagccgttcttcaagaagaagccgaagctcaagttcatgcacaagaagaagccgtgcccgccgctcgtcgacgacgacacgacccggcggcctgcggcagcaggcgggcaggggcaagagaaggttcccatgaaactgaactaggggatcggagctggctcgttcggngacagcagcagagctctaagatgttgcagtgtcagtgacgacgttcgtttcggttcggttcccgtgatgacgttgatgt

SEQ ID NO: 71817 - DNA, 370 bp, Zea mays
  Clone ID: LIB3078-001-Q1-K1-C3
gagacggacgcccacgcgtaccgggtatctcgcccatgtcaaggaaagcaggctcaaggaccatatgcagggagagccaactcaggtgagtcgcaaacctgtcctgcacatgcttccccacatcaaactgcctaatgatacgtatcgccagcttccgatattcttctggaattgagcatccattccatgaccgccctcttgaagctcttgcgatgccaccacgctaactacgggagattccacccattacaaggcacgcaatgttaaggccccacatagaacatcattcaaacaacgccaacgaggaataacatgctaacaatgccacagctgacgtcactgcataggctcctcatgtcaatatcatgat

SEQ ID NO: 71818 - DNA, 350 bp, Zea mays
  unsure at all n locations
  Clone ID: LIB3078-001-Q1-K1-C4
gacgcccacgcgtccgctctcctgatcgtcctgttcctgacagcagcagccatggcggccgagccgganaagcangcgggccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgncagcggcttctccgcgaagctcaccccccagcaggtcaaggatctcaaggagcaaccaggtgttctccaggttgtgccgagccagacttaccagctacatggtcctgggtctggcac

SEQ ID NO: 71819 - DNA, 419 bp, Zea mays
  unsure at all n locations
  Clone ID: LIB3078-001-Q1-K1-C5
acggggggggtcgcctgagatcacagcgacgatggtgaaggcaggtgctgtcctcgccgggacggatgtcaagggcaggatgttcttttcacaggacggggatggtccgaccaccgtgactggaagtatctctggcctcaagccagtgctccatgggttccatgtgcacgcgcttggcgacaccaccaacggctgcatgtcgactgggccacacttcaatcctgttggcaaggagcatggcgcaccggaagatgaggaccgccatgccggtgatcttgggaatgtgacagcgggagaagatggtgttgttaatgtcaatattactgacagccagatacctcttgctggaccccactcgatcattggccgagctgttgntgtccatgctgatccggatgaccttggcaaaagtggacatg

SEQ ID NO: 71820 - DNA, 400 bp, Zea mays
  Clone ID: LIB3078-001-Q1-K1-C6
cggacgcgtgggtcctagcgccggcgccccgcggcggtatggaggctggtggcgaggagttggcgatcggcgtggtgctctccgcgaagaccaccctgggggaggagttcgagggccagatcgtcgccttcgatcgaccctccaacctcctcgttatccaggagggcgtggggagggcggagagcggggagcggcggaacgtgagggtgctgaaggcgaactacattcgggagttctctgtgctcagcaagggagacgaccctctcgatcctgccggttgcatgctggaccttaactccatttatgcccgggaggatgctgcactcaggcaagcagagattgaagctgagagaattggtgttgtgtcaccccagaagctcaaatatattcgatgcgctgt

SEQ ID NO: 71821 - DNA, 441 bp, Zea mays
  Clone ID: LIB3078-001-Q1-K1-C8
cccacgcgtccgcgactccatcgaccagaccgcgcatgcccacggacacccacaccgccactgaccgtcgatccagcacctgatgcaccggagcaaagcacagcgcgccgtcaccgtgctacagcttacaatacaagcctatctccatgattattgcacagaatgacagaaccgaacgccatggcaacaacagttttcctatctaatgttgttgtaaatcgatcgcgacaaaacttagcttctgctaccttccttcctgctgagcctgtatacgtttctattgctaaagaaacgatcaaacgaacgctattgtatatttgatcgaagtggaaacagcatgcagcttatatggtgtaaagtctaagggggtgtttgggaacaaagtttttctgcagtttttggaagaatactgcagtattctcaaatactgcagtattatat

SEQ ID NO: 71822 - DNA, 310 bp, Zea mays
  unsure at all n locations
  Clone ID: LIB3078-001-Q1-K1-C9
tacctctctattttatcctatcttacatacacacacatccaacatcatgtatcttctataaggtcacctatattcaattcactatccaactcaatacaacttcattactaacaaaaccattacattacccaacttaatccccttccaacacatctttctttctacaactctcttaataactaacatacccacacctatcacccttcccaacantttcacaaacttaatcacaaattntactctcactataacatcccattaatcaccacatttatcacaactactctcatctttacctctacacttacca

SEQ ID NO: 71823 - DNA, 167 bp, Zea mays
  Clone ID: LIB3078-001-Q1-K1-D1
gcggacatcttccccaagcctgccaagctgtggaaggttagattggattacttggtcgaggtgagtaatgatgtttgcgagctgcaattactatgtacgagatacaatgagtgaaacatgaaaagcacgttctccgtgggaattcggatatggttgaacttccactt

SEQ ID NO: 71824 - DNA, 392 bp, Zea mays
  unsure at all n locations
  Clone ID: LIB3078-001-Q1-K1-B4
attcccgnntcggccggcgcggacngatcttttcaaggacatgcattgcancgggaagaaaggtttttctgaaaatgtaaagaaagcaattggtgacatgggagcaagggtgacaacaccagttgaggatggacaacaacaaaagtctcctatagaagttgtttctgaagtgctatggggctccagtttatttctacagaatgttggtctgcaagataactccaagaaaagctccacaacaactgtttttgctaaggttcaagaacttcataatcaattggagtctgagaggctagaaaaagatgggcttcaagaagaagtagaaaccttaaaggctcaggcacaggccttaaaggagaccatgggacatatgaagagatcgatggaagaaa

SEQ ID NO: 71825 - DNA, 308 bp, Zea mays
  unsure at all n locations
  Clone ID: LIB3078-001-Q1-K1-A10
cgatggcacgctgcccggcgactatggggtcnacccgctgggcctctcggacccggaggggagcggtggcttcatggaggccaagtggctggcctatggcgaggtgatcaacggccgctacgccatgctgggcgcggtgggcgccatcgccccggagatcttcggcaagatgggcatcatccccccggagaccgcgctgccgtggttcaagacgggcgtcatcccgcccgcgggcacctacaactactgggccgactcctacacgctcttcgtcttcaacatggcgctcatgggcttcgccgagcacc

SEQ ID NO: 71826 - DNA, 295 bp, Zea mays
  unsure at all n locations
  Clone ID: LIB3078-001-Q1-K1-A11
gcagaccttggtccagtgatcagccgaggggcaaaggatcggatctgtaaattagtccaaagtggtgttgacagtggtgctcgtatattgcttgatggaagaaagatagtggttcctcgctatgaagatggaaattttgttggcccaaccattctggctgatgttaaaagtgacatggagtgttacaaggaggaaatatttggtccagtgcttctcttaatgaaagcggagagcctagatgatgccatccaaattatanacagcaacaagtatggcaatggtgcttccatattta

SEQ ID NO: 71827 - DNA, 191 bp, Zea mays
  Clone ID: LIB3078-001-Q1-K1-A12
acggccagtccaaccaagtcagcaccctcgcgcttcaaggagttcacgcccatggcgagcaccaagattgcttcaaacagctggcgggtcatgcttgccgcgggcgttcccactgccaatagctgcagctgccgtgtcaacttcgcctcagcgcccaaccggctttgcaagaatcttgtggtccgggccca

SEQ ID NO: 71828 - DNA, 381 bp, Zea mays
  unsure at all n locations
  Clone ID: LIB3078-001-Q1-K1-A3
tccaattccgcggggagcgcgggcgcacttctccattccattgcggttctgcgagccccgacctccctgtggtgcttggccatgggagactagcacttcgtgtataaggacgtnganggggcgagcacagagtgggacgacatccagcgccgncttcggaacttgcccccgaagccggagcccttcaagccggcgnccttcgccccgaaggttgacgccgacgagcagcccaagtccaaggaatggcttgacgtgcgcgagcccgaagagctcgaggaactagaggacgatctggatgacgaccgcttcctcgagaagtacaggaagatgaggctcgcagagctganggaagccgcaaaagccgcgcgatttggtactata

SEQ ID NO: 71829 - DNA, 399 bp, Zea mays
  unsure at all n locations
  Clone ID: LIB3078-001-Q1-K1-A5
gcattcgtccattccatgcagtggtgtgagggattgatgtgtattgcaagccaaagctcctctgccggggccactaagttgggactgtccagagctgtgtgcgctgtcttcctgtgtttgtgatgaccacagccaccaaattcaccacaccatagctagaacattctagggagttgctggcccgtatgaagcttgttccgtaatcatctcagaacgcgaagaagaagtggaagtcactgaagagaagacaccaccaccctcggattctcgggcaggaaactgcttctactttgatatttgtggatccgagcctgactcacctactaacaaggtgangaagcgacanatttttgttgcttttgctccaaggtggtatcaaatgaagaaaaacaagagtga

SEQ ID NO: 71830 - DNA, 366 bp, Zea mays
  unsure at all n locations
  Clone ID: LIB3078-001-Q1-K1-A6
caaggagcccgaggcggcggcgagaggaggacttanccgatgacaaggccgtcatccggcgggctacccggcgccgccggcgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacanagaaagcaaacatagaagctgaactgaagaagattgangaacaact

SEQ ID NO: 71831 - DNA, 407 bp, Zea mays
  unsure at all n locations
  Clone ID: LIB3078-001-Q1-K1-A7
acggaccgctccatgctcctgcccgactgcgtcttccgcatgggcggccgcgcatgggatgggaacaccgcgggcggaggcgcgcggttccggctcgcccgcgtcgtgcgcacggtggcctccgcgcgggacgccgcctaccggtgcgtgttccaggtggaggacgaggagagcaacacggggatccggctctccaaggacctcgtgcccactgccgcccagaccctgaaaagcaacatcgtcgccttcgggcccctggtcctgcctgcctcggagaagctcctcgtcgctctgtccatcctgaggcggaggctagtacggagcggccgggggagggtgtaccgnccggacttccgcaccgcgttcgagcacttctgcatccacgccggcgggcgcggggtcatcga

SEQ ID NO: 71832 - DNA, 284 bp, Zea mays
  Clone ID: LIB3078-001-Q1-K1-A8
acgggctgtcggcggacccggagaccttcgcgaagaaccgcgagctggaggtgatccagcggccggtgggccatgctcggcgcgctcgggtgcgtgttcccggagctgctcgcccgcaacggcgtcaagttcggcgaggcggtgtggttcaaggcgggctcccagatcttcagcgagggcgggctggactacctcggcaacccgagcctggtccacgcgcatagcatcctggccatctgggcgttccaggtggtgctcatgggcgccgtcgaggggtaccgcgt

SEQ ID NO: 71833 - DNA, 419 bp, Zea mays
  Clone ID: LIB3078-001-Q1-K1-A9
acgcccacgcgtccgataatcttgaaaaggtgcgcagctcaggagtgaagtgccctcttctctggaaggagtttgtcattgacaagtggcaaatctataatgctcgctctaagggtgctgatgcaattctactaattgctgctgtgctaccagatcttgacataaggaaatttcttcagatttgcgaagagttgggaatgacagctcttattgaggttcatgatgaaagagagatggaacgtgtgctgaagataaatggagttaagcttattggtatcaataaccgaagccttgagacatttgttgttgatacttcgaacaccaagatgttgctcgagaaacatggggatatcatcagggagaagggaattttggtttgtggtgaatcaagtctgtttactccggatgatgttgcttat

SEQ ID NO: 71834 - DNA, 408 bp, Zea mays
  Clone ID: LIB3078-001-Q1-K1-B10
tgaaattcttacacgagtcagtaaggggaagattattaatcgaccacttgctggaactgttggaaggggcaagacggagaaggaagatcaaatgcaagagcagcaactgttaagtgatgaaaaacagtgtgccgagcacataatgcttgtggacttgggaaggaatgatgttggcaaggtatccaaaccaggatcagtgaaggtggagaagttgatgaacattgagagatactcccatgttatgcacatcagctcaacggttagtggacagttggatgatcatctccagagttgggatgccttgagagctgccttgcccgttggaacagtcagtggtgcaccaaaggtgaaggccatggagttgattgataagttggaagttacgaggcgaggaccatataatggtgg

SEQ ID NO: 71835 - DNA, 241 bp, Zea mays
  Clone ID: LIB3078-001-Q1-K1-B11
cccacgcgtccgcgaaacggtcgacatggctcgcacgcaatctgccgtagcggtcgccgtggtggccgcggtgctgctgctggcagcggcggcgacgacctcggaagcccgcatcaacttgcggcaagttaacctccgcattgcgcccttgcttttctaacccccgggcaccgggtcccgccccttccggttctgcttgaaccgcctcaaggaacctaaaaagcgccgccagaaccgccgc

SEQ ID NO: 71836 - DNA, 236 bp, Zea mays
  Clone ID: LIB3078-001-Q1-K1-B12
ttgttattgaagcttttcagaagtgggatgtttgttataaaagaaatagaagagacagtggggagagttttgcatatagtgattttgagaatggagaaaataataaacttttgctgaaagctatgtggaaagggactagtatctacccatttgactgttctgttgaaaggcaaaagctcaatgctgatgaaaaccgtaatctctatatttctcagagtgagttgcagactcatgtt

SEQ ID NO: 71837 - DNA, 155 bp, Zea mays
  Clone ID: LIB3078-001-Q1-K1-B2
cccaaaaaattttcattttgcaaagaaaaattagttcatttttccttaaaaaggtagggttcctttgaaaaattggggttttaaacctacccctaaatgtttttttcaataaccaaaacctccggccttaaaaaaaccttaccaggttctttaag

SEQ ID NO: 71838 - DNA, 466 bp, Zea mays
  unsure at all n locations
  Clone ID: LIB3078-002-Q1-K1-A12
gcttctcatctactgcatcctgcccgccatctgtctgctcaccggaaagttcatcattccagagatcagcaacttcgccagcatctggttcatctccctcttcatctcgatcttcgccacgggcatcctggagatgaggtggagcggggtgggcatcgacgagtggtggaggaacgagcagttctgggtgatcgggggcatctccgcgcacctcttcgccgtgttccagggcctgctcaaggtgctggccggcatcgacaccaacttcaccgtcacctncaaggcctcggacgaggacggcgacttcgcggagctgtacatgttcaagtggacgacgctcctgatcccgcccaccaccatcctgatcatcaacctggtcggcgtcgtcgccggcatctnctacgccatcaacagcgggtaccagtcgtggggcccgctcttccgcaagctcttcttcgccttctgg

SEQ ID NO: 71839 - DNA, 442 bp, Zea mays
  Clone ID: LIB3078-002-Q1-K1-A3
tactcgcgccggaatctggtcgaaccaagccttccggaataatcaaagacagtacctaaattagctgaaaatggcaaggttgctataaggaacataagaagagatgcaatcaaagcttatgataaactagagaaggaaaagaagctttctgaggacaatgtgaaagatttatcagctgatctacaaaaagtcacagatgagtacatgaaaaagatcgaatccatccagaagcagaaggaacaggaactgatgaaaatttagacctcaagctgactgtatggctggtgaggagtaaccgtcttcgtgaagcatggacccctgcatatgttggtgtttctgaagcaatttgtttggttcatggctttggcgtctcggcgctgcgccagggatgcacgttttgaatcaggcgctttgctggaacttttgggtgcacacaagttga

SEQ ID NO: 71840 - DNA, 310 bp, Zea mays
  Clone ID: LIB3078-002-Q1-K1-A4
agccttccggccttttaatgcatgggggcggcgtacgggacagccaaaagtggcgttggcgtggcgtccatgggtgtcatgcgcccagagctcgtcatgaagtccatcgtgcccgtggtcatggctggtgtgctcggtatctacggactcatcatcgccgtcatcatcagcactgggatcaaccccaaggccaagccatactacctctttgacggctatgcccacctgtcgtctggccttgcctgtggtcttgctgggcttgctgcaggcatggccattggcatcgatggtgatgctggtgtcagggcca

SEQ ID NO: 71841 - DNA, 419 bp, Zea mays
  Clone ID: LIB3078-002-Q1-K1-A5
acatcgtgggcctcggcctgggcgacgagcgcgacatcactgtgcgggggctcgatgccgtacgcagctgctccaaggtatacatggaggcatacacatccctcctctccctcggcctcgacccggccgcgctcgccaacctggagaagctgtacgggaaggagataacggtcgccgatcgggagatggtggaggagcgtgtcgaccaggtgctaagcgaggctgccgacactgacgtcgccttccttgttgttggcgacccgttcggggcaactacacatactgatctggttgttcgtgccaagaaaatgggagtagaagtgaaggtgatccacaatgcatctgtcatgaatgcaattggagtttgtgggctacaactttaccgctatggagaaactatctcaataccattcttcaca

SEQ ID NO: 71842 - DNA, 355 bp, Zea mays
  Clone ID: LIB3078-002-Q1-K1-A6
ctgggcgtaccagcgccaggaggcggagcgcgcgtccgcgtcggacttcaagaacgaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtagacatcgtgccccgcgaggaggccaaggaggagcccggcagcgccctcggcttcgcggcgcctgggaccggcgtc

SEQ ID NO: 71843 - DNA, 414 bp, Zea mays
  Clone ID: LIB3078-002-Q1-K1-A7
gtcggagtacttcgcgtcgtcgtccacgctgttcgtggtcgagttcatcctgttggactacgtggagatccggcggtggcaggacatcaagaaccccggcagcgtcaaccaggaccccatcttcaagagctacagcctgccgccgcacgagtgcggctacccgggcagcgtcttcaacccgctcaacttcgcgcccacgctcgaggccaaggagaaggagctcgccaacgggaggctggcgatgctggcgttcctgggcttcctgatccagcacaacgtcaccggcaaggggcccttcgacaacctgctgcagcacctgtctgacccatggcacaacaccatcatccagaccttctccggttgagtcgaggtcgaggagggatacgatccatcgctggtgagctgatatggact

SEQ ID NO: 71844 - DNA, 413 bp, Zea mays
  Clone ID: LIB3078-002-Q1-K1-A8
agatgagttacgcagattttatgttgctgcaaatggcgactttcaaagtttactcggttcggttaagaagacaattcattggagggaaacatttcacatacttacattgcaagaacttgatagatggtctcacttagtcttttggcatgggtttgacacgatgcttcggccttgtttagtagttcgtcttggacttgcatgctctagcatacctcctcatgatagaccccgtttcgggcaagcagtagtttctcaaattgaccatggcgttgtaaatttgatcaatgaagaagattcaaggattaccgttttactggattgccatgggatttcgccattcagatttccaatgcaaatgatgaagtcgttcatcactgtggttcaagaaaactacccgaatcgtcttggggtat

SEQ ID NO: 71845 - DNA, 479 bp, Zea mays
  unsure at all n locations
  Clone ID: LIB3078-002-Q1-K1-A9
cggcggctgaggaggacgagcaggaggtgaagagggaggagctcaagcggtgcctggtggagacggtgtacggctccgacctcggcttccgggcgtccacggaggtcagaggtgaggtcgtcgagctagtcacccagctcgaggcggttaaccctactactgctcccgtcgagtcgccggatctcctcgacggcaactggatcctcatatatacagcatattctgagcttctgcctattctagctgctggggcaacacctttggtcaaagtaaagcagatatcccaagaaattgactccaaaatcatgacgatagtcaatgcttcgacccttacgactccattcgcttcattttcattcagcgcaaccgcctctttcgaggttcaaagcccatcaaggatagaggtccaatttaaggaggggagctttcagcctncgacaatatcatcatccgtggatctacctcaacaagttgatata

SEQ ID NO: 71846 - DNA, 374 bp, Zea mays
  Clone ID: LIB3078-002-Q1-K1-B1
atctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcg

SEQ ID NO: 71847 - DNA, 443 bp, Zea mays
  Clone ID: LIB3078-002-Q1-K1-B11
gataaaccctcaggtggcctcccgcatggtttcagcattttctcggtggaggcggttcgaggggaccagacaagctcttgctaaggtgacgtgttcgtctgcagtctttgtagagtccaattgatcgatcattttttttttcagaaaagaaagaagaagatagtgcaatagtagtaacactaacaccttgcttcatttatggcatatgcccagctggagatgatcgtgtcggccaatgggctctccgaaaacgtgttcgagattgcttcaaaaagcttggcggattagcttgggcggttccgaggaattgcgagtgggagtgcttaactgaatctctcttttgttggtaaaatgacaagtatagataataaacaggcggtccgaatttgcatgaactgataaaatataagtgtgatgatgcccgctttgtggggtgtttggag

SEQ ID NO: 71848 - DNA, 456 bp, Zea mays
  unsure at all n locations
  Clone ID: LIB3078-002-Q1-K1-B12
cgccggagggggaggtggagctgcaggtgcccgacgacgtctacatcctggacttcgccgaggaggaaggcatcgacctgcccttctcctgccgtgcggggtcctgctcctcctgcgccggcaaggtcgtctctggctccgtcgaccagtccgaccagagcttcctcaacgacaaccaggtcgccgacggttgggtgctcacctgcgctgcgtaccccacctccgacgtcgtcatcgagacgcacaaggaggatgacctcctataattctagctagctatacaccgtcagggcccgtcgtcttgtgccaccacatgcagtaccgcccgcgcaggagatgagacgtgtcgtctcaataattctagctatatatatatatatgcatgcatgcatgtacttntccctgttccaaactgagtatattctaaaatacaagatttaatcacatggtttagag

SEQ ID NO: 71849 - DNA, 425 bp, Zea mays
  Clone ID: LIB3078-002-Q1-K1-B2
agccttccaaaacctgcctaaggtttggttccaacctttggagacattgtgtccagtggaggaaactggtgtccgtgataaagcagttgaatctctgtcccgtattggtgcacaaatgaatgaaactgacattgtcgactggttcattccagtagtaaagaggctagcagctggagagtggtttacagctcgcgtatcgtcctgtggtcttttgcacatagcctatccaagtgcgtcggaccaattgaaaacagaattgaggactatctatggtcagctatgtcacgatgacatgcctatggtcagaagagcaacagcatcaaatcttggaaagtttgcagctacagttgaacagaatcatttgaagacagaaataatgtcaatatttgatgatttaacccaagatgatcaagattcagtgcgtc

SEQ ID NO: 71850 - DNA, 431 bp, Zea mays
  Clone ID: LIB3078-002-Q1-K1-B3
ggggccaatccttccggttgaaggagccgcagggcgagagctcttaggaggagaagaagaagaagccggaggaggatctggaggacggggccgcagataataagcagcccgaagcagagtcaaaggaggtggataaagtggaggcgaagactgacggcggtgacagcgagggagctgatacgaagcaggccaagggctcatcatcagagccgtcaaaggaagcccctgccgtctctgccaatgacgaggacgaggcaaagaagagcgacaaggccaatgacgccggcacggcagagcctgccgccgttactactgagaggtccctgcctttggcgccggcgccatagcacgcgtactagcatgagtaccggccgacctactactcctggcccgctcagacgatgctgagctaccacgcggcgcatcgcagc

SEQ ID NO: 71851 - DNA, 436 bp, Zea mays
  Clone ID: LIB3078-002-Q1-K1-B4
gggcgcaagcctcccgctcccggctagctgaggacggtacacttgctcagaggtgcgacgtacgacgtcgacgacgcatgcgccacacaggggatcccagctctccgccgccgtgccccggatccacggcctccggggctacgccgcgcccagagtccgcggtgacagcgcttacgtccgtgagggtgggcaggaagaggtcgacgactcatggcatccgatgcacactgcatgtctaactgcagcaacctgatctggatgacgactaggacactatatatggtcagctatgagaagatgacttgcctatcgtcagaagagcatgtgcactaaaatcccggagcgtttgcaagtacagttgaacaaagtcatccggagacacaactactgtcactatcagatgatttaacgctagatgatcacgattcagagcgtg

SEQ ID NO: 71852 - DNA, 404 bp, Zea mays
  Clone ID: LIB3078-002-Q1-K1-A11
gtatctctaaggatggccagacccgtgagcatgctctccttgctttcacccttggggtcaagcagatgatttgctgctgcaacaagatggatgcgaccactcccaagtattccaaggcccgttacgatgagattgtgaaggaagtttcatcctacctcaagaaggttggatacaaccctgacaagattgcctttgtccctatctctggttttgagggtgacaacatgattgagaggtccaccaaccttgactggtacaagggtccaaccctgcttgaggctcttgaccagatcaccgagcccaagaggccttcagacaagcccctgcgtctgcccctccaggatgtgtacaagattggtggtattggaactgttccggttggtcgtgtggagactggtgtcatc

SEQ ID NO: 71853 - DNA, 312 bp, Zea mays
  Clone ID: LIB3078-001-Q1-K1-G4
acggttccatcgtgctactcctggtggtactggtggtgtgaagaccataggaaattatgcttcggtgttgatggcacggaaaggtgcaaaggaaaagggttattctgatgtcctctacttggacgctgttcacaagaagtaccttgaagaagtttcttcatgcaatgtttttgttgtcaaggacaatgttatttctaccccagcaataaaaggaacaatattacctggtatcacaaggaaaagtataattgacgttgctttgagtaaaggcttccaggttgaggagcggcttgtttcagtggatgaactgct

SEQ ID NO: 71854 - DNA, 365 bp, Zea mays
  Clone ID: LIB3078-001-Q1-K1-G5
gaaattgatagagttgtccatgaggagacaattgctagaggtggatacccatctccggtgagttaccatttgttgggcaagtcatgttgcacgtctgtcaatgaagtcatttgccatggaattccagatgccaggaaacttgaagatggtgacattgtaaatgttgatgtaactgtatactataaaagtgttcatggtgatttaaatgagacatattttgttggaaatgtcgatgaagcttccaaacagcttgtacgttgtacctatgagtgctttgagaaagctattgcaataattaaacctggagatcggttcctagaggtctcggaaatcataaatagacatgcttccatgtcagggttatc

SEQ ID NO: 71855 - DNA, 382 bp, Zea mays
  Clone ID: LIB3078-001-Q1-K1-G6
agatgatgtgctttcatctctgaatgacatgctcgcatgtgatgctgcggtccctgcatcacgacccttgtcatggcccacaccaggagagctagatgatctatttgccatctacctgaagagcattcctaagcctgagaagctatcaaggttgcagtacctgctcggcattagcaacgagaaggctaacgagatgcaggacgcagcctcggagggatcgctgccggttgcagctgaagagaaagaggagttggcgttctaggaaggggtacagttttgttagggtagccaccggagttgaggtcccttgccaaggaacgaacgaacttggtgccttgtgcggacagctgctattgtagctaggcgcatacatgttttggga

SEQ ID NO: 71856 - DNA, 238 bp, Zea mays
  Clone ID: LIB3078-001-Q1-K1-G7
gtcctatcacaaataatagctgtagcttatgaacaactgtgagaaggcctttaaatgttaaggagaatcatacacggaagccagaggtagttgtcaccaaaagccgatctgagcgcttgaagttaacaagtgttgatgctcttcaagactgtgacttgaacgtaataccttaataagtctgggattgttgcacctcgataccaatactttacattaactacaactgtatcaaaggaat

SEQ ID NO: 71857 - DNA, 280 bp, Zea mays
  unsure at all n locations
  Clone ID: LIB3078-001-Q1-K1-G8
ggcgaccgtcacaccccccctatgtgctaggtgccagggtccgtcgggtccttcggtggcggcnagcaactaccaggcgacccagtggtgtgttcgggaacgtttccgcgggcgggcggcggcccccagtggcgaagatgatctgactaccgacgtacgcagcacgaggcgttcgttgccatcttcttctcctttgagtatatgatactagcaacatccacggtatcaacattcgtgaagtatatattctatgttagtgacatgctaatggaaggtcaat

SEQ ID NO: 71858 - DNA, 274 bp, Zea mays
  Clone ID: LIB3078-001-Q1-K1-G9
ctcgcccgcaacggcgtcaagttcggcgaggccgtgtggttcaaggccgggtcgcagatctgcagcgagggtgggctggactacctcggcaacccgagcctgatccacgcgcagagcatcctcgccatctgggcctgccaggtcgtgctcatgggcgccatcgaggggtaccgcgtcgccggcggcccgctcggagaggtcgtcgacccgctctaccccggcggcagcttcgacccgctcggcctcgccgacgaccctgaggccttcgcggagc

SEQ ID NO: 71859 - DNA, 463 bp, Zea mays
  Clone ID: LIB3078-001-Q1-K1-H10
gtttgagatggctctgcgagcagcctgggggaggctgaagaagctgaagatgctctgcgtgctgaagaccgtgcgtgtcgcctgagctcctccagatgctgcaggcttgtggctgccgaataagatgggtcaacaagcctcttgtctacaaggactagacagactcgtgttcctcattgtgtgtgcagtgtcagcatcagcatgtattgtcaagatcttgcaggtttgccctggctcacgttgtgagtccgcaataatcgttgggggcgtaagctcccgtcccccagatgtggttatggtgcctttggggcacttcttgcgccatttgtcactctctgctccggtgtatctgtgtatgcaaacggaggcaccggtaatgttcatgtgtatatagcgtgcagtagaatgatcccattttatgggattagctagtgtgtaattgttacctcatttcgcatgattc

SEQ ID NO: 71860 - DNA, 181 bp, Zea mays
  Clone ID: LIB3078-001-Q1-K1-H11
attaatgataattttgaagaaattggccgatgactccgacactgtactcatgaaagattaggggatgggctgtgtgcaccgcctgtgttgggcgtggattgttgtagacttgcagtgatcttgctcgataagcttgtacagttcagtacagacacacattgaaaccatatagatacaggat

SEQ ID NO: 71861 - DNA, 330 bp, Zea mays
  Clone ID: LIB3078-001-Q1-K1-H12
ggacaagctgcaccccggtgggcccttcgaccccctgggcctggccagcgaccccgaccaggccgccatcctcaaggtgaaggagatcaagaacggccggctggccatgttctccatgttcgccttcttcatccaggcctacgtcaccggcgaaggccccgtggagaacctcgccaagcacctcagcgaccccttcggcaacaacctgctcaccgtcatctccggcgccgccgagaggactcctagcctgtaaggactgacgccacgccgtcgagcaatgccaagtcatgcgctgctgcatgccgtctttgattttaccgggataaaaag

SEQ ID NO: 71862 - DNA, 51 bp, Zea mays
  Clone ID: LIB3078-001-Q1-K1-H2
attcccggtcgaccgcgcggcctcccacgcgtccgcccacgcgtcctccca

SEQ ID NO: 71863 - DNA, 249 bp, Zea mays
  Clone ID: LIB3078-001-Q1-K1-H3
actcttactcttgggaaaaaaaaaaaaaaaagaatatgataaaaagaaaaaaaaaaaaaaaaaactgaaaagtttaaaaaaaaaagggtagccaatctaaaaaaatccaaacttacatacccatacatacaacaacataactcttttatatttccacctaaatacaattcattcaccttttttttacaacttcctttacttcaaaaacccttaccttacccaacttaatttcctttcaaaacatacccc

SEQ ID NO: 71864 - DNA, 365 bp, Zea mays
  unsure at all n locations
  Clone ID: LIB3078-001-Q1-K1-H4
taccggtctctgaattcgagcggcgcggactcngactcgtgggtcgcggcggggaggccgataggtggccgtggtgggctgcggcgagcgcggcacaggcctctggcgggagcgcgttgttccgacggggcaggagcggagcggcagtggcgatgccgttcaaggcattcggcatcgnctccctcttcgtcggctccggcgccaccgccgtcgccgctggggtgcttgccgcgggcgtctgatcggtggaggagatgaagggcgtgggcgctagcattcggcggtggatgggagctcctcctcgccgagcgggaggtagtgactaaccatcgcactgcaactgtggtggtctgtatgaacctctg

SEQ ID NO: 71865 - DNA, 345 bp, Zea mays
  unsure at all n locations
  Clone ID: LIB3078-001-Q1-K1-H5
gcggcgtgtgcgtcccctcatgtgtgatgatgccagatgaatacaacaacgtccccggtccgggaggcaaaccaggcaccagtcccaccaccaccaccctctgtcttcgcctccgctgccgattcgaaagcacccgtcctgtcccctcgcaaaaccctagctccagccaccatgaagggcaaggctgacacctccaagaaagacgagggcaagctccgggcgggcggcgccgccggaaagcgcaagaaggccgccgcgagcggcaagcccaagcgcccggccttcggcttcttcgtcttcatgtctgaattcangcangagtatcangcgctgcaccctggcaac

SEQ ID NO: 71866 - DNA, 436 bp, Zea mays
  unsure at all n locations
  Clone ID: LIB3078-001-Q1-K1-H6
acggctggccaaggtcactgtccagcacttgcatggaaacaatgtggaccttggaactggctggggtaaatactttcgggtgtgctgcctcagcattattgatcctggtgattctgatatcatcaagactacaccgggtgagcagtaaagaagcccctgcagtagggggatcttactgcatttgttcttctgtcttgttaaacagcatttacctgctagtaaactgagttattcggaacattgtcttgaattgaatttttgctccggtgttttgacacttaaatagagctttagcttataccgntgttcaagtcgcagctgtatgttgtcactatcaaaccgtcaaacgaatgctccaccaatggaggtatctcctataataaagattcattggttgtagtaattggatgatatctncggtacgatcctttttcac

SEQ ID NO: 71867 - DNA, 237 bp, Zea mays
  Clone ID: LIB3078-001-Q1-K1-H7
tcttcctaaaaaaaaaaaaaaataaaaaaaaaaaaaaattaaaacaaaaagaaaaaaaaaaaaaagcaaagttaaatacaaaaacgaagaaaaaactataacctctcttatcctcccctccttactttcccctacattccacctcatacttcttctataatgtcccctcctttcaattctcttactccattatttccatccatcttccttctacaacccttcccactacccacctta

SEQ ID NO: 71868 - DNA, 299 bp, Zea mays
  Clone ID: LIB3078-001-Q1-K1-H8
ggaacatttcaaaataaaatattctccagtgtggttaaatggtggtgggcactgcgacctcgagctatatccagagtacattaagcacttgaagcagtttgtgtcaagcgttagcaaaaaaacatcaaagccggaccagaaagagataatggcaaaggatggcactaccagtaaagaaagagaggaagcatactcggagaaacctcagccggcagctaagtgctcacagtcacagatctcacgtaagagcatagatagccgagttgggaaatccaaaacagtggatgttcctgataaat

SEQ ID NO: 71869 - DNA, 320 bp, Zea mays
  unsure at all n locations
  Clone ID: LIB3078-001-Q1-K1-H9
acgctgcggtagcgaaaacgctagcgctgcggaacaacgatggcggacgatgtctcttgcgcgcgaggtcacccctcagcgcgcggtccccgcggcatcgccgctcacgctccttgcgcggcattcctgtccatccgcttaggtggcgcgacagcgacgcggctcgctggactggctgtggcctcgcagccagcggatcgtcgcgcctcggcgatggtcgcgatggcgaagagggagcangagctggacgagatccgggccatgacgactgaacagatggaataggangtggtagacctcatgggggagcttttcctgct

SEQ ID NO: 71870 - DNA, 355 bp, Zea mays
  Clone ID: LIB3078-001-Q1-K1-G3
gcgagagcttgttgagttaggaagcgcggatgacaacttaaacaccaccaatgtggaaactacaggatacgtcatgttgccacgtgacagagaactgtcggctaatgattacatggaactaaacgatctccttgctcctgacccaagcttccccagtgaattttctgctcaggacaatcaatatatgcagcattctcttgctcagtacaatggacattatgatctgtcaggtccttcggagccaacaatgcctagcattttcgatgtttttcctcccaataatggagtcctcttaacagatgatccagccaactacttggacccagccatgcagttccctttctcatgattggtc

SEQ ID NO: 71871 - DNA, 419 bp, Zea mays
  Clone ID: LIB3078-002-Q1-K1-A1
ggcggtggcgcctcagggcctgccgcccctcggccgccgcgcctcctccttcggcgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctactcgtctacaacaccagcgccctctccggctaaggatatccaatgcatgcgcttcttgcgattcgtcatgtaaaatcagggtgtctgtctataatct

SEQ ID NO: 71872 - DNA, 455 bp, Zea mays
  Clone ID: LIB3078-002-Q1-K1-A10
cccacgcgtccgctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtctacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataaatttgatgctatatatatata

SEQ ID NO: 71873 - DNA, 437 bp, Zea mays
  unsure at all n locations
  Clone ID: LIB3078-001-Q1-K1-E9
cggacgcgtgggcaacatggcgctcatgggcttcgccgagcaccgccgcctccaggactggtacaacccgggctccatgggcaagcagtacttcctcggcctcgagaagttcctcgccggctccggcgacccgtcctaccccggcgggcccctcttcaacccgctcggcttcggcaagaccgagaaggagatgaatgagctcaagctcaaggagatcaagaacggcaggctcgccatgctcgccatcctcggttacttcatccaggggctcgtcaccggcgtcggcccgttccagaacctgctcgaccacctcgccgaccccgtcaacaacaacgtgctcaccagcctcaagttccactagaacgtggtgcatcagcatacctgctgctgccgccgncgncgccagttgtttgctgtggaaagctagatgcatgcgt

SEQ ID NO: 71874 - DNA, 343 bp, Zea mays
  Clone ID: LIB3078-001-Q1-K1-F1
cccacgcgtccgcccacgcgtccgcccacgcgtccgcccacgcgtccgcggacgcgtgggtgcgcgcgagctgaggacgggacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggct

SEQ ID NO: 71875 - DNA, 432 bp, Zea mays
  unsure at all n locations
  Clone ID: LIB3078-001-Q1-K1-F10
ggcgcgtccgggaataccctgggaccgaagaagagaagatgcgagctgctgttggcaggtttggcctatcgggaaaggcgcaggtgatgccaatgaggaatctttctgatgggcaaaggagccgtgtcatctttgcatggttggcatataggcagccgcaactgctactgctcgatgagccgacaaatcatttggacattgagaccattgactccctggcggaggcactgaatgagtgggatggtggtttggtcttggtgagccatgatttcaggctgatcaaccaagttgctcaagagatttgggtgtgtgagaatcangcggtgacaagggtgggaaggtgatatcatggatttcaaggcacacttgaagagcaaggctggtttatctgattagaggggcttttncagcaaccatgagctttttaactct

SEQ ID NO: 71876 - DNA, 304 bp, Zea mays
  Clone ID: LIB3078-001-Q1-K1-F11
gcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggacgctggcgaggaggggcggcgtgaagcgcatctcggggctcatctacgaggagacccgcggcgtgctcaagatcttcctcgagaacgtcatccgcgacgccgtaacctacactgagcacgcccgccggaagaccgtcaccgccatggacgtcgtctacgccc

SEQ ID NO: 71877 - DNA, 340 bp, Zea mays
  Clone ID: LIB3078-001-Q1-K1-F12
cccacgcgtccgattcgtttctcgcgagccatcgcttctggatccggaagaaatggccaagggggaagaaccacacggcgcacaaccagtcgttcaaggcgcacaagaacggcattaagaaacccaagcgccaccgccagacctccaccaaggggatggaccccaagttcctgatgaacctgaggtattctaggaagggcaacaaaaagagtggtgaggctgaagctgaggagtacgaaggaaagcatggctttgtttcctctggttttagctcagttccacctttatgaacctgggttttgctaaagatggaacttaaatggtgttactgtatgatggc

SEQ ID NO: 71878 - DNA, 249 bp, Zea mays
  unsure at all n locations
  Clone ID: LIB3078-001-Q1-K1-F2
acgcgcccaagctcgacccgtcgcaggtggtggaggtgttcgtccgtgtgaccggctgctaggtgggcgcagcntcttggctggcccccaagatcggcccgctcggtctttcccccaagaagatcggacaggacatcgccaaggagactgccaaggactggaagggcctccacgtcaccgtcaagctcaccgtccataaccggcaggccaaggtctccgtcgtcccctccgacgctgcgctcgtcatca

SEQ ID NO: 71879 - DNA, 370 bp, Zea mays
  unsure at all n locations
  Clone ID: LIB3078-001-Q1-K1-F4
aaanctgactcatagcctctcctctggactcggcctctggcancaaggacaggctcctggtcngggaacctatgctgcggtggaagcgggcgctcgcgccgctgtccgtgggccgcgtcgccacgcgccggccgcggcacgtctgccagtccaagaacgcagtggacgaagttgtggtggccgacgagaagaactgggacgggttggtgatggcgtgcgagacgccggtgctggtggagttctgggcgccgtggtgccggccgtgccggatgatctcgccggtgatcgactagctggccaaggactacacccgcaagatcacgtgctgcaaagtgaacacggacgacaaccccaacgtggcgtctaccta

SEQ ID NO: 71880 - DNA, 389 bp, Zea mays
  unsure at all n locations
  Clone ID: LIB3078-001-Q1-K1-F5
cccacgcgtccgcccacgcgtccggcgcgtcgactggtagcccgaaccctagctaggaggggggangcgagagagcggccatggcgcggtgcctcgcgctcgtctccttccttctcctcggcctcgcctccgccgcctccgctgccgatgcgccctttgtcgtcgcgcacaagaaggtttcgctctcccgccccaagccgggcgtcgagcgcgtcgccgtctccctcgacctctacaaccagggatccgcgactgcctatgatgtgtcacttaatgacgactcttggccaacacaagcatttgagcttgtcactggagagaaatcgaagacattggaaggcttgaccctggtgcactgctacacacacatatgtcctggagaccaaaca

SEQ ID NO: 71881 - DNA, 349 bp, Zea mays
  unsure at all n locations
  Clone ID: LIB3078-001-Q1-K1-F6
ggcgcgtccgcacacacagagagagacaagtggtttccgaagccaagtgtggactagcagtctagcgaccaggtagctcgggcgggagcaggcagccatcatgtcggaggagaagcaccaccacttcttcaaccaccacaagaaggacgaggagcagcccgccggcgagtacgggtactccgagaccgaagtggtcaccggcaccggcgagggcgagtacgagaggtacaagaaggaggagaaggagcacaagcacaagcagcacctcggcgaggccggcgccatcgncgacggcgccttcgcactctacgagaagcacgangcgaaaaaagacctcgagcacgcgcac

SEQ ID NO: 71882 - DNA, 324 bp, Zea mays
  unsure at all n locations
  Clone ID: LIB3078-001-Q1-K1-F7
cacccagcccctacccgcttccgctcgcgccggcctttggggctctcaccctgagcggtaggaatccgcagggctccggttgggtgccagaagcatccaagtcgttggcgggagaccgggaaatggcggaaaaagagggggcgaaggttggggcggaagagatggaagagcgggagcaggaaggggaggcggaagaagtggaggtgaagtttcgtctcttcgacggctccgacatcggccccgtgcgctgcaacgccgncaccaccaccgtcgccgctctcaaggatcgcgtcgtcgccgactggcccaaaagataacaaatta

SEQ ID NO: 71883 - DNA, 278 bp, Zea mays
  unsure at all n locations
  Clone ID: LIB3078-001-Q1-K1-F8
cggacgcgtgggcgctgctgcttactgggggtctttggatctttggangcatgctgaatggggatncnggttctggggcaattcttggcctagcagtcctcttaatctcaagggttgtcacattgaaagaagtgtttggcaaaatctgtggcctgggatacccttacatggtttgcaacacttataacaatggcttgctacctcaacaaattcggctgatctcttggtcagtgagacttgtgtgaagttttgttgaaggcttggcatgtcatggcaac

SEQ ID NO: 71884 - DNA, 458 bp, Zea mays
  unsure at all n locations
  Clone ID: LIB3078-001-Q1-K1-F9
acgggcaacgctgtctacgccgccgtcaaggggggttaccgacatatcgattgtgccagagtttgcgggcaacgaaaaggagattggtttggcgctgaagaagctatttgaagagggtgtagtgaagcgagaagatctgtttatcacctctaagctatggaatgatcatcatgctcctgaagatgtgcctgaggcactaaatgacagcctgaatgatttgcatcttgagtacctggatctttatcttatgcattggccatttagagtcaagacgggaacaaataccaaccctgaaaattttgttacacctgacttacctgctacttggggggcaatgcgaaacagttatatgatgctggcaaagctcgcgctattggtgtgagtaacttctnctcaaagaaattgggtgacttgcttgctgtagctcgtgtacctgcagctgttgatcaggtggaatg

SEQ ID NO: 71885 - DNA, 408 bp, Zea mays
  Clone ID: LIB3078-001-Q1-K1-G1
gcgcttgcctgcagaacgaggtgtcggtgctgtcccctcgcgtggcgtttctggaccagcagcggaccatactgagcgtcggcaacagccacctcaagcagcggatcgcagctcttgcccaggacaagattttcaaggacgctcatcaagaggagctgaagaaggagatccagaggctgcgccgggtctacgaccagcagaacctcaggatgtcagccggcggcgccgccgcttctgaccatgggccgccaccaccggtggtgcgcgctgagaaggagctcatgagctagccagccagtccatgcgtgcccgatgtgcagtccgccttatcattaacatggaaggaacattgcatcatgattttttttttcagattctgtgaatggtttcttccttcctttttttggg

SEQ ID NO: 71886 - DNA, 233 bp, Zea mays
  Clone ID: LIB3078-001-Q1-K1-G10
ctcacgcgtacggccacgcatccgcccacgcgtccgtccacgcatgcgcccacgcgtacgtgcacgcatgctgcgcgtgcaatgagtccaaggcgttcgccttttgcaagaacaactcgatcaagaagcttaccgcttccatgaagaactactcgcccgacagcacccgtacgctcgccatcaacgccaccatcgagaagaccaagcaccggttctagaactacggcaagttc

SEQ ID NO: 71887 - DNA, 450 bp, Zea mays
  Clone ID: LIB3078-001-Q1-K1-G11
cggacgcgtgggtcaagccacaccaaagcacactgcgacacacagtaggcgaggcgaaggagaggcaaggctgcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttttgcccatgttttaatctgctgaattagtaaatcctggagaattcaaaagcgttttcaagtactgcagttggtggttggttctggtcctagtgtatgcatgccagaatcttatgaat

SEQ ID NO: 71888 - DNA, 422 bp, Zea mays
  Clone ID: LIB3078-001-Q1-K1-G12
ccagagaatcatcactgagtccttgaggaagaaaatcaaaggcactcgctaccagagcacggtgtacacgatgcactatggtgaatatgttgcgtacctcaagaagaacagaggtgcagccccgtcaattagtggggctcctcctgtagttaatggcttcaagccaagccattgatttatcagtataaaaaaaagctcaaagaacatattactataatttatctgcgagcaatttggggggtgtagtgtaaccaccccccacagctcattgatctagcatcattcccttccaaggaaaaggccaaataggggcgtcatgacaagcgcccagaataataatgccttcctggatggatcatggatgatgcttatgtatcttgaaaacacatgtgcttcaagaagttcaaattgtgtggtgaaaa

SEQ ID NO: 71889 - DNA, 300 bp, Zea mays
  unsure at all n locations
  Clone ID: LIB3078-001-Q1-K1-G2
tgcgtctcgtgcgcgatccactctcacatcttccgcgtccgatcccgtgagaagctcaagggccggaggccntcggagcggttcaggctcangtaggataggccttctgatgtacaaggaggcccccgacctggtcctagtgctactgctacagctccatctccagcatctattgcttctcgcccatatgctttatcttttccaccgtgttaagtcttctggccactcactttctgagttatcccctgtgcgtatctgaagctcctatattagaggtacttattatctaaagtctcaaca

SEQ ID NO: 71890 - DNA, 464 bp, Zea mays
  unsure at all n locations
  Clone ID: LIB3078-001-Q1-K1-E7
cgaggtaaagtccgtcgtttgaagtacacctggaaatctgcaggttacaatttcaagaggaggaccnaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcagaaactgttgggttgggtgtggtgatggtacattgggagttccaaaccagagaggagataattatgaatgcncgaacatgaaactgcttcttaaacaacaacaaanggtcttactttgaagatcagatgtctctggctggngagcattcctcaagaatagtgttagcaaaca

SEQ ID NO: 71891 - DNA, 456 bp, Zea mays
  Clone ID: LIB3078-003-Q1-K1-F4
gacctcccgggtttgactcacgcgtccgggagatcatgaagatcgtggagaaggcgcggacgccgccttcttcctccacccccgtgggtggcttcgggggggcggaggaggacgagcaggaggacagcaaggatccagacgaggaacacgaggacggcgaggacgagtactagaagcaggtgaagcaagtccacgccagcggggagtttcatctcagctgctgagggttttcgccggcctgctagtctgtggtaccagccgatgatggacctgctagtctgtggtcttgcgtttaagttttctctcatagttttctttcttttgctgtggtgccgcatgactgcaacagttgtgaattattgaagggggtttcagcgttgcccttgtattgactcattcaagctagcatggggaacataatgatggaatattacaggtcggtgtgcacaaaacaaa

SEQ ID NO: 71892 - DNA, 379 bp, Zea mays
  Clone ID: LIB3078-003-Q1-K1-F5
ctcagggagagacgagagaagtggacacctcgcctgcctggactcggctactctagtatgcagaaaaaagcagaagagatacggggatgtctaagacggcgggcgtcggcagactcggaggagccggggcggcggacgcggcgcagcagcagcagctggcggcgggtgatgctgcggtggcgcgggcggcgcggcccatcgagacgctgctgcgcgcggcgccgctggtgctgtgcgtggccgccatgaccctcatgctccgtgaccagcagagcaatgagtacggcaccgtcggctactccgacctggggggcttcaaatacctcgactacgccaacggcctgtgcgccggctactcgctggcgtccgggttctacac

SEQ ID NO: 71893 - DNA, 420 bp, Zea mays
  Clone ID: LIB3078-003-Q1-K1-F6
aacgaagtgcgagcgacccacgtccacacgacacgaaccaccaccaccaaccagcaggggcaccacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgccaaggtctgccacaactgagcacgcccgcgttgcatgcagc

SEQ ID NO: 71894 - DNA, 379 bp, Zea mays
  Clone ID: LIB3078-003-Q1-K1-F7
gagatctacactcaaacccgggattaggtcaccatcgacggggtaccctccacggttgacgagaacgaagtcgggtcactacgcgcgtaaaccgaacgcctccatgctgctctcaagatcgagaatggccatcaccagctgaacaatcagagacaccagaaggtccccaaggaagcggatgccgtaccccaacagaatctcaagctacaggaacagatcagacccctgaaggcttccgacaccgacgccgccaccaccaacgagaggcaagctcaacctgcttctgaagccccgaaagaatgggaagtctcataactggaaattgcaatcgctgcagctgcccgcgccaacctcacggatgccatcatactactatatc

SEQ ID NO: 71895 - DNA, 421 bp, Zea mays
  Clone ID: LIB3078-003-Q1-K1-F8
ccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgttacaacaagaagcccaccatcacctcccgggagatccagacctccgtccgcctcgttctacccggcgagctcgccaagcacgccgtctcggagggcaccaaggccgtcaccaagttcacctcgtcctaagctcctttcgagtaggtccttaagcgccgtggcgccttttgactgtatggaatgtttgtcatctgaaagttgatctgagcagtgcaata

SEQ ID NO: 71896 - DNA, 303 bp, Zea mays
  unsure at all n locations
  Clone ID: LIB3078-003-Q1-K1-F9
gcaagtacagctaccgtggcgtcgacctagatgcgcttctcgacatgtccactgacgaccggcntccagctcatcgccgcgcgcgccaggagtttgttcagaggggtctgaagaggaagcccatggcgctcatcaagaaactgcgcaaggcgaaaaaggatgctcctgctggtgagaagcctgagccagtcaagacacatctccgtaacatgagcatagtccctgagatgatcggaagcattcgtggcgcctactatggcgagacctaccaccaggctgagatctagcctgtgacgaacgggg

SEQ ID NO: 71897 - DNA, 424 bp, Zea mays
  Clone ID: LIB3078-003-Q1-K1-G1
gcagttcctaggactcgacaagatgctacccaagtccggcgacccgtgctaccccggcgggcccctcttgggcccgctcggcttcggcaagaccgagaaggagatgaatgagcttaagctcaccgagatcacgaacgggacgctcgacatgctcgccatcctcgggtacttcatacaggggctcgtcaccggcgtcggcccgttccagaacctgctcgaccacctggccgaccccgtcaacaacaacctgctcaccagcctcaagttccactagaacgtggtgcatcaacatacctgctgctgccgccgtcgccgacagttgttcgctgtggaaagctagatgcatgcgtgctgtaaaggaacctgaagcgctgcatcggtcatgattcatgcctggccagcctgctgactgtaacaacaaact

SEQ ID NO: 71898 - DNA, 396 bp, Zea mays
  unsure at all n locations
  Clone ID: LIB3078-003-Q1-K1-G11
cccacgcgtccgcccacgcgtccgctgccgtgtagggaccgtagactcagcgactgcgagaganggataaggngatggccgggatcggaccgatcaagcaggactgggagccggtcgttgtgcggaagaaggcacccaccgtcgtcgccaagaaggatgagaaggccgtcaacgccgcgcgccgcgccggtgcggagatcgataccatgaagaagtacaacgctggtacgaacaaagcggcatccagcggtacatacctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgaga

SEQ ID NO: 71899 - DNA, 455 bp, Zea mays
  Clone ID: LIB3078-003-Q1-K1-G12
gctgcgaccgacgcgtccggttgcgcctcttcttattgcagcttcatttgctggagcactgcagagtttgttgtcagtcagaagatattcggcatggataaacccaatcagtggtgcattgttacttggcggaggtgtttataccctactggacagggtgtttccagcaacatcaatggtcatgtagaccatggatggacaagaattgctaggcaccagtctgtttggcgtgcgaatgatatttggatgtgaagtagtgaaatgatggcaacaaagtttagccagatctctcagcgttgtatatgcacgcacgacattttgatcgggacaagcaaagcaccttgacctaagtacagtagtctgcatcactgcatatgtatgggcctcgatacttggaggcagtgtaccctactaaaatgtatttctgggacagattgaacgagtatgaaatttat

SEQ ID NO: 71900 - DNA, 433 bp, Zea mays
  Clone ID: LIB3078-003-Q1-K1-G2
ctgcgggttgcttcaagattgagaagtttggtgatctgatactgaatgcaactgaaccacagggggttctttatgggtatatgatgattggttgaaaagtatctcatcatacacagcattctctcacattgtgcttattctacgtgcacttcatgtgaataatgataaggcaaagatgttgctcaaacctgacaaaacaattgttactgaaccacattatatatggccaactctgaatgatgaacagtggatgaaggttgaatgtgcactaatggacctcattctttccgattatgctaagaaaaacaatgttaatacttctgcactcacacaatctgaaatgcgagatatcatccttggtgctgaaattgctccaccatcacagcagaggcaacagattgctgaaattgagaaacagtcaagagagacgact

SEQ ID NO: 71901 - DNA, 425 bp, Zea mays
  Clone ID: LIB3078-003-Q1-K1-G3
agacattcagatgatttcaaactgtgatggttcatctagaccacttgaccatcctgcgggtttgtatgatgtccatgtctatactgattctaagactttgtttaacatgaggagcacatttgacagaacatctcgtagtggacctaaggggttcctggcattcacttgggatgttctttgggtagtatataaaaaaatgggtcctttgatgctttgcaaaatccttaagagatggagggtacaattctccgaggtgttgtgattctgaataacgatgaggaatactcataaggagcttatgtgacgtgtggttctatttgcatgtttctctgaagaccctgaaactccagcttttgtgagcgagtacgctgtctggagaagtgacgcgggtagaggcagtcttcttgcttcgttggctgaagctg

SEQ ID NO: 71902 - DNA, 337 bp, Zea mays
  Clone ID: LIB3078-003-Q1-K1-G5
cccacgcgtccgaccactcccttgagcttaccttctatctctgcacgtgaccgtaccggagcatagatcgccagaactaccgacgcgacatcatggcgcatgcctgagacaaggtatactacatattcaaggcggtgctgacctaagacttcattgcgggcaacatgcagatcctcgcacggtaaaaccgcaacaaggtcaacctatactccaacgccaccatcggagtatagatgcaaatgcgcaccatctttatcaagcacaggagcgtgcaggctcatacctggaacacctgatgccacaacaggtacaaacccgtgactagtgctgagtatag

SEQ ID NO: 71903 - DNA, 362 bp, Zea mays
  unsure at all n locations
  Clone ID: LIB3078-003-Q1-K1-G9
cccacgcgtccggtcgagtgccacttcgaggccgtgtcggggcttccggtcgtcgacagcgggctcagatgcgtcggggtgatcgtcaagaacgaccgggcaagagcctatcatgggtccaagacgaagatatcggaagtgatgacatctccagctatcacactatcgtctgacataaccgtgatggatgctgctgttctcatgctcaagaagaagatccacagattaccagttgtaaaccaggacgaanaagtaataggtatagttacccgcgctgatgttcttcgcgtgtttgaaggcatgttgaagatttacgagcgcagatacccatgctcagaagccacaatcttttggaaatatgt

SEQ ID NO: 71904 - DNA, 144 bp, Zea mays
  Clone ID: LIB3078-003-Q1-K1-H1
gtttacccactcgtccgggcggccgccagaacacttctgacaactttttaaagcactctttcaatccattccactaagactatatacgaggtccattgcaaaacattacgctacacatattcctgttctatctatacataatcc

SEQ ID NO: 71905 - DNA, 394 bp, Zea mays
  Clone ID: LIB3078-003-Q1-K1-H10
gcgcaggagtcatggccaccgtcagcgccgccgtggtgaccaccatcgttgcccgctccggggtggccaggcccaatgctctagggctgcctgcgctgagggcgaggagcgagagggtgcggtgcagctacgccaaggacgcggccccagtcagcaccaagggcgcatgcgcgtcgctgctcgccgcagcgggcgcggtgaccgcgtcagcggggcccgcgctggcgctcgtggacgagcgcatgtccacggagggcaccgggctgagccttgggctcagcaacaacctgctggggtggatcctcctgagggtcttcgggctcatctggtccctctacaccatctacacctctgacctggacgaggacgaggagtccggtggcctctcgctcta

SEQ ID NO: 71906 - DNA, 430 bp, Zea mays
  Clone ID: LIB3078-003-Q1-K1-F3
gagacgcaccgcagcgaggggatcttcacgcaggcccgggaggaggtcaccatcgccgagttcgccgccacctctgccgagaaggaggtcgcctcgctccgcgcggaggtcgaacgcctcgatgctgttctcaggatcgagaagggcgagcacgagctggacaagcagagacacgagaaggtcgccaaggaggtggatgccgtgcgccaggagaagctcaagctagaggaggagatcagagccctgaaggcttccgccaccgccgccgccaccaccaaggagagggaagctgcgccggcttctgaggccccgaaggaaggggaagtcgcgtggctggggatggcggtggctgcggctgccggcgccgccggcacggctgccatcatgctagtttatctccgccttaagaggtaagtgttctggtgctcgg

SEQ ID NO: 71907 - DNA, 417 bp, Zea mays
  Clone ID: LIB3078-003-Q1-K1-D8
gtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgagtccaaggtgaacgagactaaggcaaccgtcaagttccagctcaagaaggtcctttgcatgggtgtcgccgtcggcaacttggcgatggaggagaagcagatccagcagaacatccagatgagcg

SEQ ID NO: 71908 - DNA, 329 bp, Zea mays
  Clone ID: LIB3078-003-Q1-K1-D9
ttcaagaatggtgccctccactatattgatactattcagcaggcactacctgatattgcgatggggcaaacgaagccgtgtcatattggatgttggttgtggagttgccagctttggaggctacatgtttgatagagatgcgcttaccatgtcttttgctccaaaagatgagcatgaagctcaagtacaatttgcattataaaggggaatttcagcaatatcagctgtgatgggcaccaagagactttcgtaccccaccagagtctttgatgtcattcattgcgctcgcttgaaggtcccttggcacattgaaggtggcatgcttttgc

SEQ ID NO: 71909 - DNA, 419 bp, Zea mays
  Clone ID: LIB3078-003-Q1-K1-E1
catgctcgagcccagaagcgtgaacggcgacctcatcttcgccagcatcttgctcaccggcaccctcaccgggtaccctggtggcctctgtgctgacccgttcgtctacggcatcggctcgcccaagaagatcacggagctgagcaccaaggtgatcaacaacggtcgcctcgacatgctcgtcgtcatgctcgcctggattcacgcctagtacaccggcacctgcaccatcgacaacctcttcgaccacctcttcgaccatgtccacgacactatcttccacaccttctcccacaaatgaagagtcgaacttattattagccttattaggagtgctaccacacatgcttcgacacgttcatggccaatatatatgacactttacatgaaacttgacatggaatgactgctgagtagac

SEQ ID NO: 71910 - DNA, 385 bp, Zea mays
  Clone ID: LIB3078-003-Q1-K1-E10
cggacgcgtgggcggacgcgtgggcggacgcgtgggcggacgcgtgggctctccgacggcggcgcggcggcggcggcggcgggcctggaggagtggtgcgtgtcggcgatgtacgcgatgagccgcggcagcctccggttccgcggcctggcgcgcgcggccggcgcggaccgggcgctccggcgcgtggtggccgacgagggcggcggcgtccggcgcgagatggctcggaagaccctccgcgccatgcggggcgacctcgacaacgacgacggcggcaccgagtataacaacgacctgaccggcagcagcgccgagtgcgaggactgcggcgggagcatcgtgtcggacgggctcatgtcgttccggcgccggcagcgcgagc

SEQ ID NO: 71911 - DNA, 197 bp, Zea mays
  Clone ID: LIB3078-003-Q1-K1-E11
atcaccttcaagaacaacgccggcttcccgcacaacgtcgtgttcgacgaagacgaggtgccgagcggcgtcgacgcctccaagatctcgcaggaggagtacctcaacgcgccaggcgagacctactccgtcaccctaaccgtgccgggcacttacggcttctactgcgagccgaaccaaggaccaggattggtcgg

SEQ ID NO: 71912 - DNA, 364 bp, Zea mays
  Clone ID: LIB3078-003-Q1-K1-E12
cgtccggatagttcacctcggaccaggcgctgtacagcgacggcgcgtcgcaaccggcggtgagggacttcgctaagaaccagacccgcttcttcgaggcgttcaaggacgccatggtcaagctgggcagtgttggggtgaataccggccggcacggggagatcaggagtgactgcaccggattcaactagtagatcgaccacccattcttttgaagaaaaaaataacagtcgcgtacctgagcgaactcaaccacgttcacgtgacagcacagaactcaatccttagagctaggatgaaaactgacgaaatcgggctaaaaaaccgctcttccggtttatctttatatggtatctcacgatag

SEQ ID NO: 71913 - DNA, 118 bp, Zea mays
  Clone ID: LIB3078-003-Q1-K1-E2
gcaagatcgatcctttgttaatggagatctcgttaattaggagagctaccgctgggacttggtggtttgtgatatatgatccaaccagtgatgaatcaatgcattcacttgtgtacac

SEQ ID NO: 71914 - DNA, 428 bp, Zea mays
  Clone ID: LIB3078-003-Q1-K1-E3
cccacgcgtccgcagacgcgtgggcggtctcgtggggttcatgaaaggcgttgaacaggtgccgcatattggcgactagcaattcaaaaagatcttgcgctacattaggtatggtgttgacggtggagctacccttgtgacgggtggtgataggttgggtgacaagggtttctacatccagccaacgattttctcagatgtccagtacggtatgaagattgctcaggaggagatatttgggcctgtgcaatcgatcctcaagttcaaagacctcaatgaggttatcaagagggcaaacgcgagccagtatggattggccgacggcgtgttcaccaacagcctggacacggccaacaccctgactcgcgcgctcagggccgggactgtctgggtgaactgcttcgacgtcttcgatgctgcgattccgt

SEQ ID NO: 71915 - DNA, 411 bp, Zea mays
  unsure at all n locations
  Clone ID: LIB3078-003-Q1-K1-E4
cccacgcgtccgagacaatacaaagatgtccaagatggcggaggagaaggcggcggcagggggcggactcggaggagccggggcggcggacgcggcgcaacaacagcagctggcagcaggggaagccgcggcggctcgggtgccgcccgtggaaacgctggttcgcgcggcaccggtggggctctgcgtggccgccatgaccgtcatgctacgtaaccagcagagcaacgagtatggcgccgtcgcctactccgacctgggaagcttcaagtacctcgtctacgccaacggcctctgcgccgnctactcgctggtatccgcgttctacactgccgtgccgaggcctgccaccgtgtcgcgctcctggctcgtcttccttctcgaccaggtgttcacgtacctgatcctggc

SEQ ID NO: 71916 - DNA, 432 bp, Zea mays
  Clone ID: LIB3078-003-Q1-K1-E6
cacgcgtccgggcgggcgtacgcgacagtacatagatgttcaagatggcggttgagaacgcgtcggcagggggcggactggaaggatccggcacggcggacgcggcgcatcagcagcagctggcagcaggggaggccgcggcggctcgggtgctgtccgtggaaacgctgcttctcgcggcacctctggggctctgcgtggccgacatgaccgtcatgctacgtaaccagcagagcaacgagtatggcgccgtcgtctactccgacctgggaggcttcaagtacctcgtctacgccaactgcctctgtgccgactactcgctggtatccgcattctacactggcgtgcccatgcctgccaccgtgtcgcgctcctggctcgtcttactcctcgaccaggtgttcacgtacctgatcctggctgcaggctcat

SEQ ID NO: 71917 - DNA, 448 bp, Zea mays
  Clone ID: LIB3078-003-Q1-K1-E8
accggtcgagacacgcgtgcggacacacgccgcgacaacacatacacgtccgagatcacggatgacaaggcggccgcagggggcggactggggggagccggagcggcggacgcggcgcagcagcagcagctggcagcaggggaggccgcggcggctcgggtgcggcccgtggaaacgctgcttcgcgcggcaccgctggggctctgcgtggccgccatgaccgtcatgctacgtaaccagcagagcaacgagtatggcgccgtcgcctactccgacctgggaggcttcaagtacctcgtctacgccaacggcctctgcgccgactactcgctggtatccgagttctacactgccgtgccgaggcctgccaccgtgtcgcgctcctggctcgtcttcctcctcgaccaggtgttcacgtacctgatcctggcggcgggcgcagcggcgg

SEQ ID NO: 71918 - DNA, 332 bp, Zea mays
  Clone ID: LIB3078-003-Q1-K1-E9
tccttcacccactaatgaccccaatctacctatttatttacacagcgccactccacttacatggagggctcttactcctggggggtgggctccaacaccaccatcctttacctcctccaaccattttactggattaataaaactttcttccacaaaccttaaccataatcattagtctccacgcagaaaaaaactacaaatattcaactttagtacaccacttttgtccctaattatacctcataataactcatcaaataatattacaccccctcttctttcccttccttattttattcatatctacacattcctcttacaaataatattca

SEQ ID NO: 71919 - DNA, 413 bp, Zea mays
  Clone ID: LIB3078-003-Q1-K1-F1
cgcacgcgtgagcagacatcctaaggtgatagatatgcgtgaagttgagactgctgcaggggcactggagggcatccaaagagaacttagagtctccggatgaggacttctccaagtgtaagcttgcattcatatccatgaaccggccagagtacctgcaggacacttatggtgcatcagctcgttttgagaggagagctgtatatagggcttgtgaacaatacctcggcttgtatcactcctataccacatctaaaaggtcctacacatccactaagaattggctcacctatgagcagcccgtgtcaatctataactgagaaaacttaaaggcttaatctaatgacagaggcctcgacaacagtattcccgagacgatgaggcttagaacagatagctcggcacaggcatat

SEQ ID NO: 71920 - DNA, 415 bp, Zea mays
  Clone ID: LIB3078-003-Q1-K1-F10
atcggtctcgtcgccaagaccgtggctgagttccagaagaggggggacaatttcttcagggagattgaagttgtcatatctgatgtggtcatggcgattgttgcggacgtcatgcttgtctatcttcctgctccaactattggtttacagccgccactggcaagaaacgctggagctattgccaactttttctataactgccctgataatactttccaaattgctatggctggaaggtcattctcacttctgcagaggattggagcttttgtgaggaatggtataaagcttttggcagtgggaactactgcttctttgattggcactagtgtcacgaatgcagcgctcaaagcaaagagggctgttgataaggaccttgaggacgaagtcatggaaattccagtcgtctcaacta

SEQ ID NO: 71921 - DNA, 447 bp, Zea mays
  Clone ID: LIB3078-003-Q1-K1-F12
cctccgctgaattcggttatctgccttcacaggcagttcacaagacctcagtgaacttccgtgcggtaccagtgacaccactgaccccgttgtgtagccgcggaatgccagtggcgacaaatcaagagaggcagcagagtcctgccctcttccctaaattaaaacaggcagtgctggtccctgagaccgtatgtgcaggagacaacaccttcaaacagaaaggcgatgacgtagacaggacacccttctccttgttccagttcaacctgccgattgcccctcccaccctggcaacatccaaagagcgaagtggggaactggcaccagctcagatagctcgagtccagccgtgctcgagggaggagaccaacgtcaaggaatacaacattttctctgggtgtgacggggtgatgtttcagctcaactagagacgaagaaaattgagca

SEQ ID NO: 71922 - DNA, 432 bp, Zea mays
  Clone ID: LIB3078-003-Q1-K1-F2
cggacgcgtgggcggacgcgtgggtgcgaattagtgaccagacatctgcaatcaagctggctatatgtgaggatattggagaaaggtcatacgattttgctgatgtggcggcgattcttgtgcagatgttgataagacatcctgcagtaggttctgaagcatttcgaagacgatataagattgatgtagatagtgagtgcggtaaaacgtttgtcacaaagctctctgttcacttgttcaatggagacacaagccaggcagctttccgcatattgtctgactacaggaaaggcaaatttggatgggtagcgctggagagacctccaacatgaacaagcgggatatcatagatccttagataaaagacatgtgcttgttcatgtagtatcacacaatttagtgtcgttcattggaccactctcgacagttttc

SEQ ID NO: 71923 - DNA, 416 bp, Zea mays
  unsure at all n locations
  Clone ID: LIB3078-003-Q1-K1-D7
cccacgcgtccggtgaagccacagggggcggcagtgctcccttggagggtcagatatgggcgggtttctccaagttgatcagcttggaggtgaagaaaggcctccagaagtgtgcgacgttcccaccctcatctggtcagcctcagcaggaggattgttcatgctgccatgtaggtgacgagctcacgtgtgctcctgcctatgggcgatctgtgtccttacctccaactttgaagctggtctctgccatgaaaggaggtcgtgaaaagaacggagtggcatcatcaccaagtgaaaaccgccatgtcaagtgggctcctgatgtgtacgacccccctgtgacatcggtatgccattcagtgaccaacagctatcagcgccggtcaaagcaccgcangaaggagaagaacaaacag

SEQ ID NO: 71924 - DNA, 421 bp, Zea mays
  Clone ID: LIB3078-003-Q1-K1-C3
gtcccgagtggtcaatgtcggttctactccagggattactagatcaatgcatgaagtggggttagacaagagggtaaaggtgttggattgtgctggtgttgttatgctcaaatcttccaacagtggtgtgtctgtagcccttcgaaactgcaaaaaggttgagaaaatagaagatccagtcgctcctgttaaggagatcctaagtatttgcccacatgagaagttgctgtctctatacaaggttccaaactttggttcagttgatgatttccttcagaaagtagcaactgtacgtgggaaattgaaaaagggtggtgtagtggatgttgaagctgcagcgagaattgtgcttcatgactggaatgaaggtaaaataccatattttacactgccgcctaaaagagatgctggggaggactca

SEQ ID NO: 71925 - DNA, 428 bp, Zea mays
  Clone ID: LIB3078-003-Q1-K1-C4
cggacgcgtgggttttttcaagtccagtttcagaatctgtccagattctgtacagattgcgaaaatgaccttgtttgccaaattaaactgagaatcagctcttagtaattataggagaattgtagtactttgcttaagctttccaacaaattttggagcaccctttttggtggcctagagaccaagttacagctgtttgaactgtacagtctgaatctgtccaaatctggacagcaatgtttgtttgtattaactgactttgatacacattgaatcaccctgaaatgtttataaataaattgtagacaattctactagctttctaaaaagtctcggatcacctgatttggatgtctgaaactcaagttatggatttttaaagtaagtagtcgaattctgtccaaatctggatataatttacgtttagc

SEQ ID NO: 71926 - DNA, 412 bp, Zea mays
  Clone ID: LIB3078-003-Q1-K1-C5
cccacgcgtccgaaagaatatgcttgtcaatgagtgactttcatggggaatcttggaatccaatgtggtctgttgcaaggtatgcacatttaactagcatattacttgaatgtaatgtgtttttggaagccatagtgtacctttagtttttcagctactgtacaatgtacatactcaaattactgctagtcaaatcaatgctctggtaatcagcaaccatttcaacttctgttgccaatatgctatgagatggaataactgaaatgatagtctcgctgttagtacttcagttatgctggtctagtgatccttcactatcgagcagtcaatatgcttcagtttaaattgtttgcatttttttcctttgttggtctgacatgtaaaactttattctgcagcattctcactgggc

SEQ ID NO: 71927 - DNA, 411 bp, Zea mays
  Clone ID: LIB3078-003-Q1-K1-C6
agcaactgccacccttgcaagagaaggaccagtcgagaggcaactgtgggggaggaagagttggccatggaggaggccggagattttctggtggtggtggcggcggcagagggttttctggcaggggaggtggcggcagagggttttctggcaggggaggcagcggcagtagatttaacaggaggaattagaagctgctgtaatctttatggacatttcagaattcagagaactatgtttgtgttcgacgtagttttgatgaagagggagggaatcgtctcagttttggctgcaactgtatcgagcttttgtttatttgttagccttcgtcaacgaaggcttattttggtagggctgaaattgtggcatggggaagaaggggaaggtaacagtctcagttttggctgcaaa

SEQ ID NO: 71928 - DNA, 418 bp, Zea mays
  Clone ID: LIB3078-003-Q1-K1-C8
gggaaaggaagggagttcttcctctacgccagcagcaggagaggttactacggagtgtggcaggagttcgagaagcagtaccctgacgccaatgtcctcctggtcaccgtgaccgacgaggagtcgaggcgcatcgagcagcagtcggacgagcagaccaaggcggagatcatgcaagtgctgcggaagatgttccccggcaaggacgtcccggacgccaccgacatccttgtcccgagatggtggtccgacaggttctacaagggcaccttctccaactggccagttggcgtcaaccgctacgaatacgaccagcttagggcaccggttgggagggtatacttcaccggtgagcacaccagcgagcactacaatggctatgtccatggagcctatctttcaggtatcgactccgctg

SEQ ID NO: 71929 - DNA, 408 bp, Zea mays
  Clone ID: LIB3078-003-Q1-K1-C9
cccagccgcacgaaaccctaacgctgccgccgcttcacaggtaagccgccgccatggtggccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtcgggtgggctcgtacgccagaagatgaagtacctccgctttctccgcaagcggatgaacaccaagccatcccatggacccatgcacttccgcgccccgtccaagatcctgtggcgcaccatccgcgggatgattccgcacaagaccaagaggggggaggcggctctggcgaggctcaagacgtacgaaggcgtaccgccgccgtacgaca

SEQ ID NO: 71930 - DNA, 398 bp, Zea mays
  Clone ID: LIB3078-003-Q1-K1-D1
taagaaggttcgcatcagcccttccctttcaggcaaggtggccctaaagtagggtgttttggctgctgaatgggctcgtcagatccaagacaaaaggagaaatcacttaaagctacatcaccatagaaatgccctaaagacggaaatgttgcctgaaccatacttcgatgtacatgtgtgtacaagcttcataagattcttattctgaagcatacaaagcagtgataacgtactatctactgtgcaagattacaactgtcagtactggttgaatgatatgaataatgtaaacttgcattgtatgcctgagttgaagattaaagcgccattgcaagaatggatctcactggaatagttgccaactgcatatctgagacgaaaaattggatcgacacgct

SEQ ID NO: 71931 - DNA, 429 bp, Zea mays
  Clone ID: LIB3078-003-Q1-K1-D10
gtcacaaaacctgaccgatggcggcccggtgctccacagctgcctccgtggtcagaacggggtcgcgagacctctcccgctccttttccttcacagccgcggcgctcccatcggcgcgtctgaggccggtaggagcgtgggtccgcggtggagggtacacctgcaggctccgcgccgtccgcgccatgggctccgcgccgtcgtcgtcccaatccccgtcgccgcacacgccttcaggacaaacccaagggaaagcagattataaatcactgagtgaagaggagtggaagaagcgcctgactgaagagcagtattatgttactcggcagaagggcactgaaagagcattcactgtggaatactggaatactaaaaccccaggcatttatcagtgtgtctgctgcgacacccctctgtttcagtcatcaa

SEQ ID NO: 71932 - DNA, 422 bp, Zea mays
  Clone ID: LIB3078-003-Q1-K1-D11
ggcagggtgcaaagatagacctggagtctccaaccttcacgctgacgtttacagggagtgatagtggaacgctgccaacccccaggaccaatagactagacgtatcagaaagcaactgtgcagtgtggcatcagaggagtgatgagttggaggatgaagaaaacgattggcagatcttcagcaagcaccaattgctggaactcgacagcaaggagagggaagagaacttcattggttgtgaagagccgtggttctcagagatggctggggttggagctggcttcactggcatgctgcttggggtatccaatgagcatgatgcatcagaatgctggggtgagtccaataatggccaaactgagcgcagcaaccaagcatcagatgcggaggacaagaattattggaatggtgtccttgacatg

SEQ ID NO: 71933 - DNA, 431 bp, Zea mays
  unsure at all n locations
  Clone ID: LIB3078-003-Q1-K1-D12
attttggtttgttaatatgttttgggcaagcagtgctatgagatggagatgatggtgaggcgtgatctttctataggttaaatgaacagattatccaacagctgatggaacctgcattagagatattatgttgatgtcacagatttagttgatgctcatgtgaaagcgctcaacaaggcagacactagaaaagtcagtatttacaacgttggaacaggaagagatagagaggcccgcacatagttaatctgggacaacatatctctgtactggccatagaggacaacataaaaaatcaaaagttgaagaatcaccaacggtgcctnctttgcacccttcagctcaagaacctgggcccgagccagttcaacaagtcatgctcacagctgaagtgctgaaccaacagaattactgtatggaatcaatgaatc

SEQ ID NO: 71934 - DNA, 423 bp, Zea mays
  Clone ID: LIB3078-003-Q1-K1-D2
cgcaaccatgtcgaggaggaagaccagggagcccaaggaggagaacgtcacccttggagccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcaaggcgcttgctcgttccgggatgaaaatcggacgcattgaggacgttaccccggtccccactgacagcac

SEQ ID NO: 71935 - DNA, 423 bp, Zea mays
  Clone ID: LIB3078-003-Q1-K1-D3
cccacgcgtccgcccacgcgtgcgcccacgcgtccgcccacgcgtccgggcgacttcgggtttgatccctggggcctcggatctgacccggagagcctgcggtggaacgtgcaggcggagctggtgcactgccggtgggcgatgctcggcgcggcgggtatcttcatcccggagttcctgaccaagatcggcgtcctcaacacgcccttctggtacaccgccggcgagcagcagtacttcaccgacaccaccaccctcttcatcatcgagctcatcctcatcggctgggccgagggccgccgttgggctgacatcatcaagcccggaagcgtcaacaccgatcccatcttccccagcaacaagctcaccggcaccgacgtcgggtaccctggtggcctgtggtttgacccgctcggctggggc

SEQ ID NO: 71936 - DNA, 423 bp, Zea mays
  Clone ID: LIB3078-003-Q1-K1-D4
cccacgcgtccgcgccctttttttttttttttttttttttttttttttttttttttttgtttttttttttggtttttttttttttttttttttatttttttttttttttaaaaacttacttttcaaaaattttgcatttaatttaccccgggacaaatttttccaattttaacccccgttttaattttcttatgcccaaaaatttttccccaaaaccttcttttatttccccgtctttagaaatttcaattttgcaacattttttaaccggaatggtttttttccaaaaaatttttttttttgggatccattaaattcacttaaaaaggtccaattttaaaaaaagccccccttattttaaaactgaaaaaagggaaaaaattaaaccttgttttcgaaaacaaaatttttttttacaaggat

SEQ ID NO: 71937 - DNA, 408 bp, Zea mays
  Clone ID: LIB3078-003-Q1-K1-D5
cccacgcgtccgatgcaaagctgttcttcaattgctggttagtattgccacagttcaggggagctgcacatgtatatgagcattttgtgaggccaatgattgtaaatcagcaagttgtaaacatctggtatattccaaagaaggatgaatcaagtagacctgatgatgtaatttcagctgcacagaggtacattgagcaaaatggatcaaaagcgtttgagaatcttgttaacaagtttaagagttcgaacccaaggcgctcaattctggaggaggtagaggttgaaaggagggccaggattcaactagaatctgaagcgagggaagtgaaccctttcttcaatccagaatatcagtactaggcaaccattttcccttcactggccaggaatgtgctaggatcggttt

SEQ ID NO: 71938 - DNA, 312 bp, Zea mays
  Clone ID: LIB3078-003-Q1-K1-D6
tccacgcgtccggtgcacccctagccattcaagcctcctgctccagaagcagctcaatgatcttgcgaagaatcccgtggatggttactccgcagatcttgtaaacgattgcaacttccttaagtctcacttcaccatcatctgcccgttcaacaccaattattactgatacctcttctatgcattaatgtctttatcccattactataccatcttttcttcatcttcactaccaacttcagttatttagcatactattgtctattcagactgacgtctactcattaatatatgacatgcattattaatatt

SEQ ID NO: 71939 - DNA, 377 bp, Zea mays
  Clone ID: LIB3078-003-Q1-K1-C2
cccacgcgtccggcagccgctcgccgcgctcgtgccccgcgagcagcgcttcatgttcgagggagacgagcgctgcggccccgacatatggaatacaacctggtatcctaaggctgcagatcatgtaactaccgagaagacatggtatgttgttgatgcaacagacaagatcctaggcaggctagcattcaccattgcagtacatatcaggggaaagaatgaacccacttacactcccagtgtagacatgggagcttttggtattgtggtcaatgcagataaggttgctgtttctggtaaaaagcggtcacaaaggcttaataggaggcactccggaaggcctgaagggatgaaagaagaacctttgaaccaacttc

SEQ ID NO: 71940 - DNA, 400 bp, Zea mays
  Clone ID: LIB3078-003-Q1-K1-B1
gacacgatcgcgagcgcacgcacgtaagcacgttgtcggaagctcaagttagaagaaggaccagtgactgagcgatggcggcccaggctctcctctccggccggcagctgctgggccgtcccgtgcagtcggacgtctctaggccgtccgctaggaaggcgcccttcgtcgtcagggccagctgcagccctccaaccaagcaaggtgccgacaggcagctgtggttcgcgtccaagccgtccctctgctacctcgatggcactctgcccggagactatggcttctacccactgggcctatcggacccggagggcaccggaggcttcatcgagcccaagtggctggcctaccgctaggtgatcaacggacgctaccccatgctaagcgcagtgggcgccat

SEQ ID NO: 71941 - DNA, 418 bp, Zea mays
  Clone ID: LIB3078-003-Q1-K1-B10
cccacgcgtccggagaagctgaagctgcggtacagggagcacatcgcggcctacggcgagggcaacgagcgccggctcaccggcaggcacgagaccgccgacatcaacacgttcagctggggcgtggccaaccgcggcgcgtctgtgcgcgtgggccgggagacggagcagaacggctagggctacttcgaggaccgccgtccggcgttcaacatggacccctacgtggtcacctccatgatcgccgagaccaccatcatctggaagccctgagcgccgcggccgctgcgttgcacggtccccgaagcgattgcaaagccattgttccttacgttccgattgcttattattggtattatctagctagatcatctgggggtcaggtcgacgtggtgtgccaaaacagaacacagaaaga

SEQ ID NO: 71942 - DNA, 431 bp, Zea mays
  unsure at all n locations
  Clone ID: LIB3078-003-Q1-K1-B11
gacacttttaagatggataccaaaatagaagaccatacaaactttatcacagacataagaggcagaactaattcaactcagttggctacatcatcttctgacggaactgttcgactttggaatgctgctgatgaaagtggcgctttacaaacttttcatgggcataggtctcatgtaacatcagtagattttcacccaagattgacagaggttctttgctcttgcgacgacaatggagaaattctcttctggacagttggtcagactacatctactcatgttttgcgggtgaaacanggtggaactggaagagtcaagtttgaacctcgaagtgggcagctcctcgctgtggcagctggaagcatggtgaacatttttgatgttgaaaagcaatccagcttaccctgccctccaaagggtcacaatagtga

SEQ ID NO: 71943 - DNA, 370 bp, Zea mays
  Clone ID: LIB3078-003-Q1-K1-B12
cagcgccactgtccagtgcgcgcgtcaagcttgcttagctagccgccatggccttcctggccgccgtctccgtgaagcccgtggccatcaagggtctcgccggcagctccatctccggaaggaagctcgccgtcgccaggccgtcggcccgctccatgcgcaagccccgcgcaggcgtcgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcgg

SEQ ID NO: 71944 - DNA, 432 bp, Zea mays
  Clone ID: LIB3078-003-Q1-K1-B3
ggcgaagcaggcgctggacaccgccgagggcctgggcctgtcgcgcgaggaggcctgggacaacctcctcgtcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaagggcgagatgctgttcggctaccagccgtgcgccaccaaggacccccgcgtgttcggcgacaccgccgggga

SEQ ID NO: 71945 - DNA, 419 bp, Zea mays
  Clone ID: LIB3078-003-Q1-K1-B4
ccgatccggaactgtgccggccagccatggcgactagggttttgctcaccgccctcctgctcgccttcctggtcgtcgccacccctttcaccgcccgagttgctagagctgattcggaggaagatgctgctgcagctgaggttgttgaaggggctgatctaggtattgtgggtgatgatacacaggtttccagtgatggacctttaagccctgctcctggtgtagagacagtagttgtattccccaaaaatgctggcaaaattgtactagcaggtgaagaaactgaattactagttggtctgcaaaatgagggtgaatcgactttgaatgttgttgctgttcattcaactctccatcttccttttgaccataatatgtatggccagaaccttactgttcagaatttcttcaacgcatca

SEQ ID NO: 71946 - DNA, 410 bp, Zea mays
  Clone ID: LIB3078-003-Q1-K1-B5
gatgaggccaggctccgggccggcggcggcggcgccggaaagcgcaagaaggccgccgggagcggcaagcccaagcgccctccctccgccttcttcgtcttcatgtctgaattcaggcaggagtaccaggcgcagcaccctggcaacaagagcgttgcggccgtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcgggagtgacgaggataacgacgacgacgagtaaatagtatttccgctgttgtg

SEQ ID NO: 71947 - DNA, 246 bp, Zea mays
  Clone ID: LIB3078-003-Q1-K1-B6
agaagacgaagtccgtcatgcgggtgacctgggaaacattgttgcagatgctgagggcggagccgaggcaaccattgttgatacccagattcctttgactggcccaaattcagttgttgggagagcatttgtggttcatgagcttgaagatgatttggggaaagggggccatgagctcagcctttttactggaaatgctggtggaagactggcatgtggggttgttggcctgactccattgtaggt

SEQ ID NO: 71948 - DNA, 350 bp, Zea mays
  Clone ID: LIB3078-003-Q1-K1-B7
agaaaacgaaccatcacctccaacgtattcgacaaacattcctgcgaaaacttacgcgatagccatagcaaccacagcggatacccaacattacttagactgtcccaaatctacttgtcaacagagcatttcgcgttcatgagcttcaagatcatttgctgaacgagatccatgacctcatcctctatactgtaaatgctggtacaatactggcatctgatattattgacctgactacatcatatgttgcacaccagctgcacctagtccaattcctaaaactccagtacagtcacgccaagaaggaccattaatttcacatccactattcggacattcaccttaattac

SEQ ID NO: 71949 - DNA, 56 bp, Zea mays
  Clone ID: LIB3078-003-Q1-K1-B8
ctcatccacagctctctaccctattcctttctcaaatactctctcgggtcttccaa

SEQ ID NO: 71950 - DNA, 372 bp, Zea mays
  Clone ID: LIB3078-003-Q1-K1-B9
gcggacaacatgcgccggctgcgcctacaccgtctccggcctcggcggcgcctccctggccagccggccggctttcttcaccaggttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggtcactagctggcccacttgcccacgcccccgtccgtgacctaccagttctggctgaggctagtgacgtggcacct

SEQ ID NO: 71951 - DNA, 365 bp, Zea mays
  Clone ID: LIB3078-003-Q1-K1-C1
atcttcaaaggcaatgaggactcgtgccagggactcacatttaactatcatattactcaaatacaactgtgttttaggaagccatagtgtacctttagatcttcaactactgtacaatgcacatacctcaaactactgctagtcacatcaatgctctggtcatcagcaaccatttcaacttctgatggccatatgctactagaaggaataactgctatgataacctgcctggtagaacctcaagcatgctgatactaggatccttcactatcgagcagaccatatgctccaatttaaatagcttgcatttgtatcctttgctggactgacatgtaaaactttaatctgcagaattctcactgggc

SEQ ID NO: 71952 - DNA, 441 bp, Zea mays
  unsure at all n locations
  Clone ID: LIB3078-003-Q1-K1-C10
cccacgcgtccgcccacgcgtccgcgacacgaaccaccaccaccaaccagcagccgcaggacgcacccagcgcaaagcgatggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgncaaggtctgccacaactgagcacgcncgcgttgcagctgcagggccggngggtggtatataattaa

SEQ ID NO: 71953 - DNA, 407 bp, Zea mays
  Clone ID: LIB3078-003-Q1-K1-C11
cccacgcgtccggcgcgccgttcatggtgaacgcgtacccgttctacgcgctcgccaggagcggcagcctcgacttcgcgctgttccgggtgaacgacggcgtcatggaccagggcaccgggctggtgtacggcaacatgctggacgcgcagctcgacgccgtgcactcggccgtcaggcggatgggcttcggggacgtcgacatcgccgtgtcggagaccgggtggccatcggccggggaggactgggaggtcggcgtctgcgcggacctcgcccgggactacaacagcaacgccatccgtcacctcggctccggcgtcggcacgccgctcatgcccaaccgcaccttcgaggtctccatcttctccctcttcgacgagaacctcaagccaaggccggtgtcggag

SEQ ID NO: 71954 - DNA, 423 bp, Zea mays
  Clone ID: LIB3078-003-Q1-K1-C12
gcccaacccgggggtgcgcgaccccagcaccggcctcagctgcgaggacatgctgtacgcccagatcgacgccgtgtacgccgccatgaaggccatggggcacacggacgtgggcgtccggatctcggagaccgggtggccgtccaggggcgacgaggacgagaccggggccacggtgcagaacgccgtcgcgtacaacggcaacctcatgcagagggtcgccatgagccaggggacgccgctcaagcccaacgtgcccgtcgacgtctacgtgttcgcgctcttcaacgagaacatgaagccagggcccacgtcggagcgcaactacgggctgttctaccccaacggctcgccggtgtacgcgctcagcgccggctccggcggcggttcaggtcccggcgggtcgctcaacccgtactacac

SEQ ID NO: 71955 - DNA, 434 bp, Zea mays
  unsure at all n locations
  Clone ID: LIB3078-003-Q1-K1-A9
cccacgcgtccgatccaagtggaaaaatcgtgtatgatgagtataaccatgagcgctacccacctggagaccccagcaagcgtgcatttgcctactttgtgctgagtggtgggaggttcatttacgcatctttgctgcgacttctcgtcttaaaatttgtcctaagcatgtcagcaagtaaggatgttctcgcgcttgcctcacttgaggttgacctctcaagcattgagcctggaaccacggtgacggtgaagtggcgtggcaagccggtcttcataaggcggaggacagaggatgatatcaagttggccaacagtgttgacgtcgcatccctccgncacccagagcaagatgcagagcgcgtcaagaaccccgaatggctggtcgtcattggggtctgcactcacctgggctgcatccccgctcctaatgca

SEQ ID NO: 71956 - DNA, 388 bp, Zea mays
  Clone ID: LIB3078-002-Q1-K1-H5
aaaactactgtgaccgatgaaatcaccaccgttctggttaagacctaccgagacactacgcgggcattttaacagatcgacagcgcgccagaaaaaaaagctatgggaatcaccatctacacttattacgttccatacgactccactaccggtcactacacacacatacactaacagaagcacgcagactatcttaaaaacataatcaccgctgatgactcaaatggactagccacatcatgctactagctgtgactgacggataaacgacgtaaactgttgagcaaatccagctgagtcgtaactcttgccgtcctaacatcatctggatcctaaacaaatgctacatggctgatgacgaataactgatcgaactgattgaaatata

SEQ ID NO: 71957 - DNA, 308 bp, Zea mays
  Clone ID: LIB3078-002-Q1-K1-H6
agccaccattccgctgggctttgcccccaaccaagctaagttattaaactctagacccccgctgtagcgtcgaggacaggatagggtacagtatgataaatgatgctgaacagaacggcttgattactccttgaacgagcgccagggttgtatcatccagccgggcaactggttcaactcctgtcaccataggttcgtggatcaaaggttcactggttccacgcttgacatgaccggtatcgtagttgaatccggggagtgggctattgtagggggcaccgttcagtttgtcatggcaaacggtgtca

SEQ ID NO: 71958 - DNA, 411 bp, Zea mays
  Clone ID: LIB3078-002-Q1-K1-H8
attgttctcaagctcagagcttcgccgaggaggcgacgacgatggcaatcgccgggcagtgctcctcctgctattatacgtcacccaccctgcagctccagctccaacgacggcacagccacctgccgctgcagccccaagccgcacgaagagcgcggcggccgaggttgcaggtggccacagctgccggcagcgggcccatcagggcggccacggacgccgagttcttccagccttccgacaccaggccaatcatgctcttcgacggcgtctgcaacctctgcaacggcggcgtccgcttcgtgcgggagcacgaccccaacaggagcatcaggtacgtgccgctgcagagcgagtccgggaggaagctcctgcagaggtcagggaggtcccctgacgacatcttcagcg

SEQ ID NO: 71959 - DNA, 450 bp, Zea mays
  unsure at all n locations
  Clone ID: LIB3078-002-Q1-K1-H9
cccacgcgtccgcgccgctcacctccaggggctcccagcagtaccgcgccctgacggtgccggagcttacccagcagatgtgggacgccaagaacatgatgtgcgccgcggacccgcgccacggccggtacctgacggcgtccgccatgttccgcggcaagatgagcaccaaggaggtggacgagcagatgctgaacgtgcagaacaagaactccttctacttcgtggagtggatccccaacaacgtcaagtcgacggtgtgcgacattccgcccacggtgctgaagatggcgtccaccttcatcggcaactccaccttcatccaggagatgttccggcgcgtgagcgagcagttcaccgccatgttccgcangaaggccttcttgcactggtacacggnggagggcatggacgagatggagttcaccgaggccgagagcaacatgaacg

SEQ ID NO: 71960 - DNA, 406 bp, Zea mays
  Clone ID: LIB3078-003-Q1-K1-A1
agcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccggcgacgagctcaaggtgaaggagctcaagaacgggcgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagacccatccattcgtccggacgtacgtacgttcgtcg

SEQ ID NO: 71961 - DNA, 429 bp, Zea mays
  Clone ID: LIB3078-003-Q1-K1-A10
gccgtgtgaaccagacctatgtcattgctacatcaaccaaagttgacatctctggtgttgatgtcgccaagtttgatgacaagtactttgccagggagaagaagcagaaggtgaagaagaccgagggcgaactttttgagacagaaaaggaggcatccaagtcactgcctgacttcaagaaggatgaccagaaggctgtggattctgctctgatcaaggctattgaggctgttccggagctgaaaacctatcttggcgcccggttctctctcagggatggtgacaagccccatgagatggtcttctaagctcttagttgtggagttcggaggaaagctgtttgtctgtgttcttgtacttctgagttttgtaccagtagcgaatgtttcattgtgttgaaagcttcctgccaaatattataagatctaa

SEQ ID NO: 71962 - DNA, 428 bp, Zea mays
  Clone ID: LIB3078-003-Q1-K1-A11
cccacgcgtccgcggacgcgtgggcgaaccttagtcaggcagcgtgaggagggagagttgagggaccgaggcggcgtcgggcgagatgaagcttaacgtcaagaccctcaagggcaccaacttcgagatcgaggcgagccccgatgcatcggttgctgatgtgaagaggatcattgagaccactcaaggtcagagtacctaccgggcggaccagcaaatgctcatataccaagggaaaattctcaaggatgaaaccactttggaaagcaacggagttgctgagaacagcttccttgttataatgttgtccaaggctaaggcatcatcgagtggagcttctaccgctactactgcaaaagctcctgcaactctggcccaacctgctgcccctgtggcccctgctgcatcaggtgcaagaacaccaacac

SEQ ID NO: 71963 - DNA, 429 bp, Zea mays
  Clone ID: LIB3078-003-Q1-K1-A12
gcgtgttcccggagctgctcgcccgcaacggcgtcaagttcggcgaggccgtgtggttggaggccgggtcccagatcttcagcgagggcgggcttgactacctcggcaacccgagcctgatccacgcgcagagcatcctgaccatctgggcgtgccaggtggtgctcatgggcgccgtcaaggggtaccgcatcgtcggtggcccgctcggagaggtggtcgacccgctgtaccccggctgcagattcgacccgctcgggctcgccgacgacccggaggcgttcgcggagctcaaggtcaaggagatcaagaacggtcgcctcgccatgtgctgcatgttcggcttgttcgtgcatgccatcgacaccggcaagggtcccgttgagaacctcgccgaccacctcgctgaccctgtcaacaacaacgcct

SEQ ID NO: 71964 - DNA, 344 bp, Zea mays
  Clone ID: LIB3078-003-Q1-K1-A2
aacatgcctgcaacttcgccgtcgaccttccttcacgaatgtggcgttcgcatccggactgtgccccagttcgaatcgccaaagaccgggtacaacccccaaattcttgcgaatcggttggctgcaaaacaccgtgtacattaacttggtcccttaaagcctgccttggggaatcctttcaaacctggccttttgaaaattattaccagtccatagacagtggagccaccaccaggaccacttgaaatggaaaagcttttgcctgaggaaatagtcctcctagaaagaacactacctgatggaagcacaaaccaaattttattttattaacccagagatcttga

SEQ ID NO: 71965 - DNA, 429 bp, Zea mays
  Clone ID: LIB3078-003-Q1-K1-A4
ctgctggcaaaatttatgttgagatagagagagcaagattgatcaaaaggcttgcaaagatcaaagaggagcagggaaagattgacgaggctgctgatttgatgcaagaagttgctgtcgaaacatttggctccatggcaaagacggagaaaattgctttcattcttgagcaggtccggctatgcctagatcgtcaagattatgtccgagcacaaattttatcaaggaaaatcagtactagagtatttgacgcagatccatcaaaggaaaaaaagaaaccaaaggaaggtgacaacattgttcaggatgctcctgcagatattccttccctcctagaattgaagcgtatctactatgaactgatgattcgatattacttgcacaacaatgattacctggaaatctgtcgttgttacaaggctatttatg

SEQ ID NO: 71966 - DNA, 394 bp, Zea mays
  Clone ID: LIB3078-003-Q1-K1-A5
cccacgcgtccggccatggcagaacaagccgctgagcttcttcaacgagggcctggcggacgagctcaacagggagggcgcctgtgacctggccatctacccggacgagaacatcggcatcaccagctgcgccatggacggctacctcgaggaggggggggatcggtgcaaactggacatcgtgagcggatgcacggaccccagcttcgacatgttcgacccgctggccaccgtcgactacggctcctgccccctcgagtctgattccgaggaatgatgatggagctccatctcaatccgatggagggaggcagcaacagcaaacgtgatccacacatacatcatatacaaatgtctgtcaagtttagtataatgtgatacatgaagcatacct

SEQ ID NO: 71967 - DNA, 338 bp, Zea mays
  Clone ID: LIB3078-003-Q1-K1-A7
gccacgctttcctaaaggtcttaatctggatcatgggcacactgggactgcacaaagggctcatatacacctccatgtggagaatgactcacgatcagctcagtgaggaaacacctacaacaggacccactgcacgagtaagatagatcatgattgatcccactgacaagtataaatcgtccagagacacgttcattaacatgactgaattgcttacatgagtgactctggatcagctcactggctgccatatggtgaatgctgatcactacgatatgctttcgtatactgctatgatatatgtccactagctatgacagcgatccatggagctagag

SEQ ID NO: 71968 - DNA, 418 bp, Zea mays
  Clone ID: LIB3078-003-Q1-K1-A8
cccacgcgtccgctgcccttcgccatcgccatggaggggcccaaggtgtgggcggcgggctggcagacagcagtcgccgagatcggtcccaacttcgtctggtgggtggcggcgcagagcgtgttctaccacctgtacaaccaggtgtcctacatgtccctggacgagatctcgccgctcaccttctccatcggcaacaccatgaagcgcatctccgtcatcgtcgcgtccatcatcatcttccagacgcccgtccagcccatcaacgcgctcggggccgccatcgccatcctcggaaccttcatctactcccaggccaagcagtagccggccttggcgcgcgcgtctggctctcaggcctcaggtcagttcaccggcgaatcagctcggcgctcgaagatataacagattatataac

SEQ ID NO: 71969 - DNA, 405 bp, Zea mays
  Clone ID: LIB3078-002-Q1-K1-H3
gcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgccgagaacaagttcatctgcccatgccacggatcccagtacaacaac

SEQ ID NO: 71970 - DNA, 467 bp, Zea mays
  Clone ID: LIB3078-002-Q1-K1-G10
taaatcttttcctgattctcattgcgaacagggactcaaacaagagtagtagcagcgcttgtggtaaaaggggttggtggacacccctgctattgacagctggggttgcctccgctaaatacttcctgcgtcacatagcatggaggaattctgtctcacaaacacgtcaaaacatctctcaacactatgatctgagtaatgaattcttctctcttttcctggatccatcgatgacttactcttgtgccatcttcaagacggaagatcaaagcttagaggcagcccagctacagaaagtttgcctcctaatcgataaggctaaagtggagcgagatcaccatgttcttgagattggctgtggttggggcagcttagcaatccaattggtgaagcacactggttgcaaatacactgggatcacattatcagtggagcaattgaaatatgcacagagaaaggtgaaagaa

SEQ ID NO: 71971 - DNA, 446 bp, Zea mays
  unsure at all n locations
  Clone ID: LIB3078-002-Q1-K1-G11
atgacggatgatgaattcgatcaactaaagctgacactaacgaaagaaggaagcgacattggtgcaggaaggtccaagatgcagcctacggagtcgaaaggtctacagtgacttgactgttgactacttgaagatgttgctcctaaatgttcccgcagctgttgtagctctggcactattcttctttttggatgatttcacgggatttgaaatcacatatcttcttgagttgccggagcctttcagtttcatcttcacatggttcgccgcactgactttaatattttgggtagcgcaggcgatcactaatgtcatagtgaaggacttcctgatcttgaagggtccgtgtccaaactgcgggaatgaaaacctctncttctttcgtaccatactgtcagtgcctaacggtggctcaaaaaacagcgtgaaatgtgcaagttgtggca

SEQ ID NO: 71972 - DNA, 469 bp, Zea mays
  unsure at all n locations
  Clone ID: LIB3078-002-Q1-K1-G12
cccacgcgtccgcccacgcgtccggggtgccgcgcacccgcgcggggtgcggatgaaggagccgcctggggcaccagggacacctgcggggcttggtctacgccttgcgcaggccttcttcgcagccgctgcgctcgccgtcatggcgtccaccaacgacttcccgtccgtctctgccttcagctaccttgtcgcagcagccattttgcagtgcttgtggagccttttgctagcctttgtcgacatttatgcacttcttgtcaagcgatcgttgagaaatgcccgagctgtatgtatatttactatcggagatgggatcacaggtacaataaccttgggcgcggcatgtgcttcagcaggaatcactgttctcatcggtaatgatctcaacatatgtgcagagaatcactgtgcaagtttcgagaccgncacagcattggctnttataagctggtttgcgctggcgcca

SEQ ID NO: 71973 - DNA, 357 bp, Zea mays
  Clone ID: LIB3078-002-Q1-K1-G2
actgaaacagcagacgcttactcaaaatcctatggggcctttcctttcctgcatgcagcaaatgctggcgctttggtcggacatactcacagaactgaagtctcaacggccaaatatttcactccagacaatatattcaatgcaaactattcgaatatcaacgaaacgcttatgaccaacgactttgacatactcactcgacgtggcgcaatgcatctctgactcatgtcatcgggaaacgggacacacctgataatcaataaatacacatcgcatcagatcctccggcatattaacaaactctgactgactagcgattgagcttttatcgagacctaggactcacatcatttgaat

SEQ ID NO: 71974 - DNA, 373 bp, Zea mays
  Clone ID: LIB3078-002-Q1-K1-G3
agccttccgcatggctgttgatgtccttgaagggaggcattatcgcttacaacacccctgggttggaattgtcaatcgctcacaagctgatatcaccaagaatgtcaatatgctctcaacaggacgcaaggaaaaggagtactttgagaatagtcctgaatatggtcacttggcacaataaatgggtgcaaaatatcttgccaagcttttgtcacagcatttaaaggctgtgatcaaggcaaaaattccaagtattatagctatgattaacaaaacaattgatgaaatagaaacccaattggatcgacttggtaagccaattggaagtgacgcttgggctcaattgtacacaatcttggatatgtgtcgggca

SEQ ID NO: 71975 - DNA, 423 bp, Zea mays
  Clone ID: LIB3078-002-Q1-K1-G4
gtgaactcctgtgccgatactctggccagtcttaaactctagggaggagtcaagggaacatggaggggatgatgagatttctgagcagacaagtccacaaaagtcccttgaggaggaatatttggaaactgaaaagaagatcgtgactgccttcagcattgtagatcgcatgaagaagatgttttattctgagcaagcggctaattctaggcaagatgatgcagaggtcaggaccttattttctgagattgagaaactgagggaagtgtttgagtcggtagaaaggccgacactagacattgaagtccgcaaggcaaaggatccaatgaaggacaagtctggatcgaatcgttcagccaaagacaaatctgaatcgagccattcacctgttcaggtgccctcttcacctatagatgtgcccgt

SEQ ID NO: 71976 - DNA, 428 bp, Zea mays
  Clone ID: LIB3078-002-Q1-K1-G5
gggaaaatgatttcttaaaaaagaggagtgacccggtctaccggagcgtacggtgccgatcccgtcgccggcgctacccctcaatcgcgagcaacttcttccggattcgcaccaagctctccacaattctatcgctatgctgcggaaggccgtcgtcgccttcatcgcctgcaccgccttcttcctcgccttctctgcctactcccgtcgccagggcgttgcagaggttcaattaccagcagttactcacagggtctacctagatgtagaaattgatggccaacacataggtagaattgttattggtctctatggggaggtcgttccaaaaacagttgaaaactttagggctctttgtacaggtgaaaaaagtgtcgggtccaatggcaaacctcttcactataaaggaacaccattccatcgtatta

SEQ ID NO: 71977 - DNA, 426 bp, Zea mays
  Clone ID: LIB3078-002-Q1-K1-G6
cccgtctcccttcgggccgctgtcacaggtggcccacggctcgcctcccgtctgcgggtccaccgcgtcggcgccgccgtcgcccagcttcccaccacgaatccggaggtagcttctggggagaagaagatcagatggtcatcaagggctgtgcggtcttttgcgatggcagagctggaggcccggaagatgaggtaccctaccacaggcaccgaggggctcctcatgggcattcttgttgaaggaactagtggcgcagcaaaacttttgcgtgctaatggaaccacacttctcaaagtgcgtgaggaggcagcgaatgttcttgggaaatcagaaatgttttactttagtcccatgcatccaccattgacagaagctgcacaacgagcccttgattgggctgtcaatgaaaaattgaaatcaggt

SEQ ID NO: 71978 - DNA, 345 bp, Zea mays
  Clone ID: LIB3078-002-Q1-K1-G7
ctcaaataaattagaacaagatgtaaacatagaaagaaaaaagataagataaaaaaaagggagtacaactaataaggaagaggagtaaaaaagatttagaacacaaatccagaggtatctattggtgtgaagaagatcagatggtcatcatggactgtgcggtcttttgcgatggtagagctgtatgcctagtagattaggtaccgtaccacaggcgccgaattgctactaatgggcattattgtctaaggaactagtggagctgctggacttttgcgtgctaatggtgccacagttctcaaagtgcgtgtcgaggcaaagactgttcttggctaatcagatatg

SEQ ID NO: 71979 - DNA, 423 bp, Zea mays
  Clone ID: LIB3078-002-Q1-K1-G8
gcgaactcccgtgccgtgacctaccgatctcaggcgatggtcgcgcggcgcctgggatcccccgcctgtaggtggctgcggccgtacgagctgctactactggtcgcttccgctctcctctcggccccgtcgtcggcccgcgcgctgcggttcgacctcgagtccggccacaccaagtgcatctacgacgagatcaaggttaacgccatggccgtcggcaagtaccacatcgtcagccccgaccccaacttccccgatgcccagctccccgaatcgcaccgcatctccctcagggtgacgtagccgtacgggaacagcatgcactacgcggagaacgtgcagtcgggccacttcgccttcacggcggctgaggccggcgactacctggcctgctaatgggcgcccgaccataagccaccggtc

SEQ ID NO: 71980 - DNA, 332 bp, Zea mays
  Clone ID: LIB3078-002-Q1-K1-G9
gttctagatcgcgagcggcctacctttttttttttacttttttgagatattcaattgttcagatattcaaattctttgaaaaactcagcacaaacattcaaatgttcagatattcaaattcttcaaaaatgttcacactttatacaaaaagtaactctaatatagcatcttcacacactctcaggggacaacttcgaaactgactgggcagaagacttaacacggtcgaaaagctaaagcctattggcgagcatcaacccgtgctggagatggagctttatcatcagcaccaggaccagagcaggtgccttcttgtccaccagcatgcctat

SEQ ID NO: 71981 - DNA, 113 bp, Zea mays
  Clone ID: LIB3078-002-Q1-K1-H1
acaacatctccaccaacctctcctcccacatgaagaaccctaaaataatggagcttttaaaaagcggcaccgcctccctacacaacatcaacatcgtcaaccaccacatcacc

SEQ ID NO: 71982 - DNA, 431 bp, Zea mays
  Clone ID: LIB3078-002-Q1-K1-H10
gatgtgcagaagttatctgcagatgaactgctcgagcggcgtcaggagattaaggagttgatggagaagttaaagatgccatcagacgctgacttaatgaaaatcgcaattgatgacttaaataattcttccatttcactggaggatcgccaacgcgcactgcaggaacttttagttcttgttgagcccattgacaatgctaatgatcttgaaaaacttggagggctccttcctgtgattcaagagcttaataatgcaaatgaagaaatacggaccacctctgcatgggtccttggtacagccagtcagaataatgaacttgtacaaaaccagatccttggttatggagctttggcgaggttggtgaagatgggttattccacatctacagaagaagctgcaaaagcattgtatgctatatcatctttgat

SEQ ID NO: 71983 - DNA, 464 bp, Zea mays
  unsure at all n locations
  Clone ID: LIB3078-002-Q1-K1-H11
ctcctaaagctgctcctgccaagaagggtgatgccaagacccaggccttgaaggttgccagaggctgtgaagtctggggcagtcaagaagaagaccaagaagatccgcacgtctgtgacatttcaccgtcccacgaccctgaagaaggctagggaccccaagtacccacgaatcagcactaccggaaggaacaagcttgatcagtaccaaattctcaagtacccccttaccacagaatcagcgatgaacaagattgaagataacaacactctggtcttcattgttgacctcaaggcagacaagaagaagatcaaggctgccgtcaagaagatgtatgacatccaggcaaagaatgtcaacaccttgatcaggcctgatgggaagaagaaggcttacgtgaagctgactcccgactatgatgctctngatgtggccaacaaaatcggaatcatctaagtgctgca

SEQ ID NO: 71984 - DNA, 346 bp, Zea mays
  Clone ID: LIB3078-002-Q1-K1-H12
gcgcccacgcgtccggtttaccccaacgtcaacagcgtcagcgccggcctgttcctgaactagaggttcaaggggccgaccaacaacctcgccgacggcggctaccacatgtacaaggacatgctggagtggattgggcggtcggcgaagaacgtgccccggcagccgacgcaatcgctgcgggtgtccatctccaagaagctacgggcgtacgtggaggacaagtacagccgcgccggcgtggagaagggcaagtacgtagtcgtccactgcatcgcatacgattccgtcgacagcatgccgtacagaggcgacgactactggcttcttcactctagcactgggc

SEQ ID NO: 71985 - DNA, 346 bp, Zea mays
  Clone ID: LIB3078-002-Q1-K1-H2
ctgggcaactgccgtgccgagacctaccgatctcacgcgatggtcgcgattggcatcggatccaccgtctgtaagaggctgccgccgtacgagctgctactgctggtcgcttacgttgttgtctcgtgcacaggggttgcatatcgcaactcggatctagctcaagtcctgtcacaccaagtgcatgtacgacaagatcaaggttaacgccattgacgtcgagcaagtaccacatcggaagccccgacccgaactttcgcgatgcccagctgcccgaatcgcaccgcatatggctcaaggtgacgataacgtactggaacagcatgcactacgcggagaacgtgca

SEQ ID NO: 71986 - DNA, 380 bp, Zea mays
  Clone ID: LIB3078-002-Q1-K1-G1
gaccaagccttccgcggacccttggccggacccgtggggtttttggagacttgcaaagtgcaacaatatggatttacatcaaatcaagtggcgccttctcttgactgggagcaatatgtgtctgaaatagcaactgatatacttacagaacaaagccctaaaaggctatttgctgtacgccagaaattctatgaattactcgtcaattggatcccacccgaaagtattttgaagaagttgttggcagaattactgaggaagttagatgcggatctgaaacatgagatctgtcactgggccggacattatgaacacaagatgcgcctcggatcaaaagctatttttcatctaaaagctttcggggccaaattcatgagcgt

SEQ ID NO: 71987 - DNA, 403 bp, Zea mays
  Clone ID: LIB3078-002-Q1-K1-E6
gcacaagccatggcgtccatgaccggcctctcgcagggcgttctgcccagcaggcgcgccgtcaacagggccaggacggccgccgtcgtcagggcgtccgccgaggcgcaggctcaggctcaggcggtccgtcgcgccgtgctcgggctggtggccactggcatcgtcggcggcgccttgtcgcaggcggtgcacgccgagaccgtcaagaccatcaagatcggagccccgtcgtcgcccttcggtggactccccgggactctgaactctgaccaggcgagggacttcgacctccccttgaaggagcggttctacctgcagccgctgccgtcggcggaggcggtggctagggtgaagacgtctgcgcatgacatcatcaacctcaagccactcatcgacaaga

SEQ ID NO: 71988 - DNA, 348 bp, Zea mays
  Clone ID: LIB3078-002-Q1-K1-E7
gaacgacaagtccgttaaggaccttgtcatgctgctgttcgagacggctctgcgtggcttctggctttagcctcgacgatcccaacacctttggcagccgcatccaccgcatgctcaagctgggcctgagcatcgacgaggacgaggaggctccggaggctgacaccgacatgccccctctggaggatgacgctggcgagagcaagatggaggaggtcgactaagctgggtttattcttatggaggaaagagagagaacatcgggtctgttctgagggtcttaccacttatgctattatgcaatctgctgatggtatgctagtgctactattgtctgtgctggcttct

SEQ ID NO: 71989 - DNA, 322 bp, Zea mays
  Clone ID: LIB3078-002-Q1-K1-E8
cccacgcgtccgctcgccgccggacaagaagtccacctcctctggcgccaccgggcgtcagcgccgcagtgtgggccggcttgggccttgccgggctcgtggccgtgcacctcggcgcgttctaggccagcccgctggcctggccagggaggagacagtgccgtgtgctgttgttaggctgcacgtcatggattggattggtgtattggttgagggacttgactgcttaccagagagagatctcttttggttcagggaactgtgctgtagacctgtagttggataccttggatgttatgctatcagttttgctgttgttatc

SEQ ID NO: 71990 - DNA, 314 bp, Zea mays
  Clone ID: LIB3078-002-Q1-K1-E9
ccggtcccaattcccggtcgcccacgcgttcgacccatcgtttcgattgaagatcctttcgaccagtatgactgggttcactatgctaagacggctgaataaattggacagcaagtgccgattgatcgcgaagaccttctcgtcaccgaccccactagggttgctaaagctatcaaggacaaatcatgcactgcccttctgctcaagggtaaccaaatcggatctgtgaccgatagtattgaggcctgcaagacgccaaagcctgcccactgtggtgatacgactattcataggaaatgggagactgaggacac

SEQ ID NO: 71991 - DNA, 423 bp, Zea mays
  Clone ID: LIB3078-002-Q1-K1-F1
agccttccgcgaacccttggcccgagtactaccggatcatcaacggactggacctcgaggacaagctgcaccccggtggccccttcgaccccctgggcttggccagcgaccccgaccaggccgtcatcctcaaggtgaaggagatcaagaacggccggctcgccatgttctccatgttcgccttcttcatccaggcctacgtcaccggcgaaggccccgtcgagaacctcgccaagcacctcagcgaccccttcggcaacaacctgctcaccgtcatctccggcgccgtcgagaggacgcccagcctgtgaggacgcgccacaagccggcagcgatgccaagtcatgcgctgctgccgtccttgattttaccggggaaagagctgtgtgtgagggtctgaagtgaagaacgtgccatgcccat

SEQ ID NO: 71992 - DNA, 470 bp, Zea mays
  unsure at all n locations
  Clone ID: LIB3078-002-Q1-K1-F10
cgctcactccagccattacccgcagctagcaaacaaatggccaccgtcctgagcagccccggcgcgccggccttctccgtctggctccgcgccgcgccagcgcccactaccgtggccatgacccgtggcggtggcgccagcagcaggctgcgcgcgcaggccacctacaacgtgaagctcatcacgccggagggggaggtggagctgcaggtgcccgacgacgtctacatcctggactacgccgaggaggaaggcatcgacctgccctactcctgccgcgcggtgtcctgctcctcctgcgccggcaaggtcgtgtccggctccgtggaccagtccgaccagagctacctcgacgacggccagatcgccgtcggctgggtgctcacctgcgtggcgtaccccacctccgacgtcgtcatcgagacgcacaaggaggatgtacctatctnctaagcagattaataaagcac

SEQ ID NO: 71993 - DNA, 329 bp, Zea mays
  unsure at all n locations
  Clone ID: LIB3078-002-Q1-K1-F11
ccgagaccttcgccaagaaccgcgagctggaggtgatccactcccgctgggccatgctncggtcgctcggctgcgtcttgcccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgactgctggccgctcggctaggtcgtcgacccgctgtaccctgtcggctgcttctacccgctc

SEQ ID NO: 71994 - DNA, 423 bp, Zea mays
  Clone ID: LIB3078-002-Q1-K1-F2
cgattaaggaattggatggagatcacggtttaggacctacatctagttatttaatactgggaaattcttgacgtaataacaacactaagattcaaccaacatgtgtttattcattttggcaggtgaagcatacaagggtaacgacgatgtcgacatggagggttgatacattctccatgttttaaggaaacacagaaagcacgcagaaatatccaagctgcgatgctagcgaacctgggtcctcaagttttttctgcatcggaactcatatgagccttgtgtatttttctgaagattctgtccgtctcgggtttatgttttgaggtctgtttgatcctgtctcttggccatcgcttggtcctggagtcagtcactcactaccaagtgtttcagaggtctgaactggtgagcatatagatctgt

SEQ ID NO: 71995 - DNA, 426 bp, Zea mays
  Clone ID: LIB3078-002-Q1-K1-F3
agccttcggaccacccatagggggccaggtggtttccaaagccaagtgtgtactaccagtctagcgacgagctagctcgggcggcagcaggcagccatcatgtcggaggagaagcaccaccacttcttcaaccaccacaagaaggacgaggagcagcccgccggcgagtacgggtactccgagaccgaggtggtcaccgacaccggcgagggcgagtacgagaggtacaagaaggaggagaaggagcacaagcacaagcagcacctcggcgaggccggcgccatcgccgtcggcgccttcgcactctacgagaagcacgaggcgaagaaggaccccgagcacgcgcacaggcacaagatcacggaggaagtcgctgccgcggcggccgtcggcgccggcggctacgtattccacgagcaccacgag

SEQ ID NO: 71996 - DNA, 426 bp, Zea mays
  Clone ID: LIB3078-002-Q1-K1-F4
cccacgcgtccgggcggcgcgggcggacaaggagcaggcggaggaggagttgtgcgaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacatacccttgtgaagagtgccattgtgcaagttgatgctgccccattcaagcagtggtacctgactcactatggagttga

SEQ ID NO: 71997 - DNA, 418 bp, Zea mays
  Clone ID: LIB3078-002-Q1-K1-F6
ctctatctctttcgccgagctcctcgaaaccctaggagcgtgcttgaccggcggcggcgaggtgatggcgatggaccctgacgcggtagcgaaggccttcgtggagcattactaccgaacgttcgacaccaaccgcgcggcgctggttgggctgtaccaggagacctccatgctcaccttcgagggccagaagttccagggcccgtccgccattgccggcaagctcggatctctccctttccaggcctgcgagcatcagatcgtcaccgtcgactgccagccatcgggtccccagggaggcatgctcgtcttcgtctccggttccatacgcaccggccccgaggagcaccccatcaagttctcccaggcattccatttgctgccggccgctgggtccttcttcgtgcagaatgacatg

SEQ ID NO: 71998 - DNA, 317 bp, Zea mays
  Clone ID: LIB3078-002-Q1-K1-F7
gttctgtagaggatttggtggcattggtggcatgttgcgctaccagctggatatccgttcttttgatgagctttctgatgatgacgatgtgtatgaagactctgactagcaatcagccaatctcatgcctgtgctggcccatggaaggacgcaacagctcgacctcaccatacctacgcaggagcacacgaaaagcaactatccaaggattaatgggcatgggccagcgtcgtcctcttcaagaggagcttaagactaagatgattttgagtcacaatcatgggagtaacgtgacaggaagataccctactatatca

SEQ ID NO: 71999 - DNA, 420 bp, Zea mays
  Clone ID: LIB3078-002-Q1-K1-F8
cccacgcgtccgtgggaatggaaaaacaatgcttgccaaagctgttgcatcagagggtgaagcaacattttttaatgtttcggcttcttcattgacatcaaagtgggtaggagaagctgaaaaacttgtcaggacacttttcatggttgcaattgatagacaaccatctgttatttttatggacgagattgatagtgtcatgtctacaaggttagctaatgagaatgactctagcaggcgtctgaaatctgaatttcttatccagtttgatggggtgtcctcaaacccagatgatctagtaattgttataggggctactaataaacctcaagaattggatgatgctgttcttcgaaggctggtaaaaagaatatatgtgccactacctgatccaaatgtacgaaggttacttctgaaaaa

SEQ ID NO: 72000 - DNA, 365 bp, Zea mays
  Clone ID: LIB3078-002-Q1-K1-F9
aattcccgttcgaccgactcgtccggctcctctacccccgcccaacactcccagccgtcactccgtctccgcctcgagtccttcaggcgccattagcatctccaataagaacctactcgagatctgcaagtacatcttccatgagggggttctatatgcctagaatgactacaacctgtccaagcaccccaagcttgacttgcccaacctgtaagcgattaatctcatgcacagcttcacgtacaaggtgtatttcactgagacctatttctgacagtactactactggtacctgaccaactatggcatttagcacctccgcatcttgcttaacctgccttcagaggtttagcccaacaccctca

SEQ ID NO: 72001 - DNA, 399 bp, Zea mays
  Clone ID: LIB3078-002-Q1-K1-E4
ctgggcgcaatcctcccgcgcccactctttccgtctctacgggtttgcagctgcagctcttcatgctccttcgcgtggatctcctcatcgtgggcgtgctcgctccttctcggtcttttacacctgcttcttctgtctccctatgtcatctatggtctgcttcccatgaaccagactcgttcctattccttgtgctgcttgcaccgtctgctccagattatcactttgttcgccagctctagatcgttaacagatagctaaaatcattgaccatagacactataccattcacatggacttatataccatggacgatactctatatattaacataccatggtcgacaatcctcagtaccatcttccgtactaacctactccctactacatactatcacat

SEQ ID NO: 72002 - DNA, 416 bp, Zea mays
  Clone ID: LIB3078-002-Q1-K1-D11
cggactcgtggtcggactcgtgggtgttgacagtgcaatgaagaagatgatggcgcataggagtgactgcaagaaggcagttgctcgggttaaggagcttctgaagcgggctgcccaggccaagcctcacagcgtcactgtcagtggaaagaaatggaagaaggttctgagcttccacgcaagggatagcgctgcggccacaaagggagggcggcaacagaagcagcacgaagaggcgataagctgcagctcgggcaagctgagcttcaagtgggacgtgggcagctgctcctcggcatcgtcggttgcgtattctccgctgtcgttgatgtctgcaccggcaaagtcctcggagcacacgctgctgacgccactgaggaaagactattgcatgtcaaggctgtcgtccataatcc

SEQ ID NO: 72003 - DNA, 468 bp, Zea mays
  Clone ID: LIB3078-002-Q1-K1-D12
cccactcgtccgcttcaatacttcatacaccatcaaatgagtcatgtgcaaaattcttcggagcatcagttcttgctctagaagaacttcatcaggtgattactcttttgctttcctttattgaataattagcacatgtgcgttcaaaaaaattgccacatgaatgaaatgatatattctcgaattattctattgagttttttgtttttatcacaacaccaccctggcgcgctagaggcggggtcgaatcagcaactactgctgacatgacgctacccatccagttgctcactgctcaggttatagcgaagaacattgttttagctggatacaaggagatgcagaagctctgagttttgacgatggatctatggatggttacactatcacatttgggatcagaaatgtgacgcacattgagaaagctctatcagaagcttacaggtcggctaatttagaaccctaaca

SEQ ID NO: 72004 - DNA, 424 bp, Zea mays
  Clone ID: LIB3078-002-Q1-K1-D3
agccttcggaacctccaagcctcccagcgtcgtcccaggcggtgatctggccaaggtgcagcggggcgtgtgtatgatctccaactccaccagtgttgtggaggtcttctcccgcattgaccacaagttcgacctcatgtacgccaagcgcgccttcgtgcactggtacgtcggtgagggtatggaggagggcgagttctccgaggctcgtgaggatctggcggcgcttgagaaggactacgaggaggtcggtgctgagtttgacgagggtgaggacggcgactagggtgacgagtactagacgctctactggcgcggcgtcgtcgggcttgtgtgccactgctatcctgtgatctgccctgagtggctcctatcgtgttatgtttctgtcggttcttatctatctgtcgttgtgtggtttaca

SEQ ID NO: 72005 - DNA, 426 bp, Zea mays
  Clone ID: LIB3078-002-Q1-K1-D4
agccttcggcgaccccttggccggccccttgggttcctggtctcccatcttcatcttcctcgcagggccgggactccatcttccggttcctcccttactcgcgctcggcacgcatgcgacgggagcggcgctcatgctcgggctctcagcggcgacttcagcggcttcccctcccgcatcgcgccctcgcctccggtcctccgcacatcggccggtgatcctgctttaagatgtcagaagcactcgagaaagataaagaaattgatgaagaggaagaggagtatgtattgctagagttggacaattgtctttattcagacatgtcgccaggtgctccgttcgtactctccggtttggatacattgacgcctaccttgataataggtgacagtcttaagatgatcggagaatatgaagaaactattg

SEQ ID NO: 72006 - DNA, 413 bp, Zea mays
  Clone ID: LIB3078-002-Q1-K1-D5
gtcaccccgggcctgctcttcctctacatcgccgggtggatcgggtgggtcggcgggagctacctcatcgccatcagcggcgagaagaagcccgccatgagggagatcatcatcgacgtcgagctcgccacccgcctcctccccagggggttcatctggcccgtcgcggcctaccgcgagctcatcaacggagacctcgtcgtcgacgacaaggacatcggctactactagctgctgcacctgtgcttgcacatcgctgctggcgagttgggcagtcgtcgtacgtgggaaacatggcttttggtgtaggaggaaggaatggaagtggtctgttgtacttaaagaaactagatgaagaagtcttgtataactgaaacttcacccctctcttgtgtatgatgtattcaccttcg

SEQ ID NO: 72007 - DNA, 415 bp, Zea mays
  Clone ID: LIB3078-002-Q1-K1-D6
ggctccgactccatcgcccggtgcatcttccgggaagggaaagaaggtagcggaggaggatgacgacaagaaggttgcagcgactccgcagccggtcgcaaaagctcaggtggtgggatggccaccaatccgaagctaccgcaagaacacgatgtctaccacccagctgaagggcagcaaggaggatgctgaggccaagcaggaccaggggttcctgtacgtcaaggtcagcatggatggcgcgccgtacctcatgaagattgacctcaagacttacaagaactacaaggacctgtcgactgcgcttgagaagatgttcagtggcttcagtactggcaaggatggcttatctgagtaccgcaaggatggtgaatatgttctgacttacgaggacaaggatggagattggatgctt

SEQ ID NO: 72008 - DNA, 414 bp, Zea mays
  Clone ID: LIB3078-002-Q1-K1-D7
gtgttcggcaagcccaaggcgagcacggagtacatcgcgtacagcggcgacggctggaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgagggcgggttcgagaccggcgccgtggccaccgtcaacgtcctggagagctccacccccgtgatcgacggcaagcagtactacgccgtgtccgtgctcaccaggacggcggacggcgacgagggcggcaagcaccac

SEQ ID NO: 72009 - DNA, 418 bp, Zea mays
  Clone ID: LIB3078-002-Q1-K1-D8
cgccttcaaccggtggcaagtgccccaagcacgcgcttaagttcgctgcgtgcgcgaacgtgctgggcctcgtcagcgccgaggtcggccacccgcccgccgagccgtgctgcagcatcctcggcggcctcgccgacttggaggccgccgtctgcctctgcaccgccatcaaggccaacgtgctcggcatcaccgtcgacatccctgtcaagctcagcctcattatcaactactgtggcaagaacctcccaagtggcttcatatgcgcctgatagatactctgatagatagctgcgcgtgtgacgtactacgcatgcatgcagcccatgcattggctgactccttatacctgtttctattgtctatgctatgtcatgtcagctaggttctgaatgtataagtactctagacaatgaag

SEQ ID NO: 72010 - DNA, 443 bp, Zea mays
  Clone ID: LIB3078-002-Q1-K1-D9
gccgggaaaagatcggctacagacagatgaggctctgtctccggcaagcggcggccaccaggtcacccctcgcagctaccctccgcggcaagacttctacgagcaccctcgccccccatggccggctcagcttcagccacaccacgtcgctgcagactgcgcccgggcaccgcgggctccgagcagggtgggcggtgcgcgtgctcccgctgacggaggagaacgtggagaaggtgctggacgaggtgcggccgagcctgatggctgacggcggcaacgtggcgctgcacgagatcgacggcctcgtcgtcgtgctcaagctgcatggcgcgtgcggctcctgccccagcttcaccatgacgctcaagatgggcatcgagacgcgccttcgcgacaagatccccgacatcctcgaggtcgagcagatcgtcgacaccgagacc

SEQ ID NO: 72011 - DNA, 411 bp, Zea mays
  Clone ID: LIB3078-002-Q1-K1-E1
ctctcctgatcgtcctgttcctcacagcagcagccatggcggccgagccggataagggggctgtccccgcggcacaggagacggccgtgcacatcgtgtacgttgaccgccccgaggacgccgaccctgaggagttccacatccgcaccctcacccacgtcctcggcagcgaacagaatgccagggacgcagtgctctaccactacaagaacgccgacagcggcttctccgctaagctcaccctccagcaggtcaaggatctcaaggagcaaccatgtgttcttcaggttgtgccgagccatacttaccagctacatggtcctgtgtctggcactcaccagtgcacgacacacaccttgtgccttatgtgaaggcttatgagaatcaagaagactgtgtttagtatggctg

SEQ ID NO: 72012 - DNA, 464 bp, Zea mays
  Clone ID: LIB3078-002-Q1-K1-E10
ctcttgatggatttcttctcttctgaaatccgaggtcccctatctggctcgcttctctgcgtggcggtcctcatttatgcctcgtttgttctgtatctcatattgcggggcaccgagctgtccgagaagattgccaaagcgatccgcggcagtttttcatgacaatagtcatcagttttggtcttacatagtgacaagaagtttctcagacagaagagacacgtatcgggagatactaccacacccggtctggtgactgcggactggatactatagcacaccggcgtatactgtacagtgattgcttggaagggtccacccatcagttgctgcgaggagcttgcaagcctgtagcagctgctcgttgcatctgctccaggccggaagtaacacatagagatgaacgaattgctgatgttgtacttgaacattcagagaagacaggttctctttgcaaacaactc

SEQ ID NO: 72013 - DNA, 469 bp, Zea mays
  unsure at all n locations
  Clone ID: LIB3078-002-Q1-K1-E11
atcggacagttccaccacattctggcgccgccttcgtctgatcctggaggcaattggagcggctgcaagtcggatcctggtggatgcagcgcaacacagatcgcaaccctccaaggactgagaagtggaatgttgacatctctgagacagtctgaaagcaaaccgaaggcaggggtgttcatcaactcctgcttcgcgcattgctagagtgagctacaggacacatggttcgcaccaaattctccatccatatataacaagaaaattgcagaggtggtaggtgattggtactttgaaagaggagctgacgtggagattgactgcgcctatccctgtgattcacagtcttgtcgcaaccttataccaattgataaggaactgaggatgtattangagttcggcagacgattatactcaattatcatcataataaaaaacactcttctaaattgtgatgatgttatgttac

SEQ ID NO: 72014 - DNA, 468 bp, Zea mays
  Clone ID: LIB3078-002-Q1-K1-E12
cgctggtcggcgactacgggttcgacccgttcggtctcgggaagcccgtggagtacctgcggttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctgctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcg

SEQ ID NO: 72015 - DNA, 413 bp, Zea mays
  Clone ID: LIB3078-002-Q1-K1-E3
ttctggtcctcttcgcctctacgggtttgcagctgacgctctccatcctcgttctgcgcgctccgttcctctttccctcctcccctccgtcttggttcttcacacctggttcttctgtctcccgttgtctctatcgtctgctccggtgaacccgcatcgttcctattccttgtgctgcttccgtcgtcggctccagtaaatcactctgttcgccagctcgagatcgtggacggcttgctaaaatcagttaccataaacatgagagcattctcagtgacaaatagagcatttcctattctctctatattaacaaaccatggaagacaatcctcagtaccatcttccctacttacctaccccgaacatcatcttatcacaagatgacgtacttggccttacaaccacgcaccagc

SEQ ID NO: 72016 - DNA, 448 bp, Zea mays
  Clone ID: LIB3078-002-Q1-K1-D10
gggacttccacttcgacatcaatgaaaaaggcatcatcaacaacaaatattgctgatgacgggtctgcgatatttggaggagctcctacatcagaagaatttcaagaagtagatggggagagcgaataaagaagactcgctaggatggaacggcatcaaagaactcgtgaacgagcgtcaaaggctttggctgagaagaatgaacgcgacatgcagcatcaaagagagcatgctgaaagacataggcttgcggaaacactggactttgagattaagcgctgggctgctggaaaagaaggcaatttgcgtgcattgctatcaactttacaatatgttctttggccagaatgtgggtggcaacctgtatccctcactgatttgatcactgctgctgctgttaaaaaagtgtacagaaaagcaacactgtgtatccatcctgacaaggtgc

SEQ ID NO: 72017 - DNA, 413 bp, Zea mays
  Clone ID: LIB3078-002-Q1-K1-B6
cggacgcgtgggcgcccatccaaccgaagtttctgaaaaggtattggctaaatcaaagcagcgtgccagagccagaaggagattggattttctgtcaaccccagtggagctcaaattgtgcactgctgcggcaagttgtcaaaggcctccccagaaaatggatcaaccgggtccagtggccgagaacatctctccgtcagatgcatgtcaagacatttcacagaatgttccaccagagcgtgcggatgccatcacaccgctggctgctagtaaccaccattcaccagcgacaccagttgatccattctctctcgaaatgcatgacgcgaacgcatcagatcttctggacatgtcctactgtgatggcttgataatcgattctcctcgtgatccacatgacggtagcctcatgt

SEQ ID NO: 72018 - DNA, 411 bp, Zea mays
  unsure at all n locations
  Clone ID: LIB3078-002-Q1-K1-B7
gctgtggtacctttctgtgaaggggtctacaaatacgccacagcttgggacgctttgagaaaagatgctgcagtattaactcaagatgtaacacttttggcagaagatgctgcacagaaaagcgggatcaccatcgaacaagtcagggataggttacggtcagtgttgtctttgactgatgtcactcgatttccagtcccaaagaacccacaggcggtcatctttgttggtgcaacggacgatggttatattcccagacattcagtgatggagctccagaaggcatggccaggctcagaggtccggtgggtaacaggtggccatgtctcctctttcttcctccacaacgatgcattccgcanggccatcgtcgacgcccttgatagattgtaacaccagaaggtgagagag

SEQ ID NO: 72019 - DNA, 471 bp, Zea mays
  Clone ID: LIB3078-002-Q1-K1-B9
cctcgttcctctagccgtctcgcgcagccacagcctccatttctcctccgacggcggtgcggctagctcaaccatggcggactccaaggccacctcggcggtcacccttcgcactcgcaagttcatgaccaaccgcctgctggcccgcaaacaatttgtgcttgaggttatccaccccggccgcgccaacgtctccaaggcggagttgaaggagaggcttgccaagatgtacgaggtgaaggaccccaacaccatcttcgtcttcaagttccgcacccacttcggtggaggcaagtccactggcttcggcctcatctacgataacctcgagtctgccaagaagttcgagcccaaataccgtctcatcaggaatggtcttgctactaaggttgagaagtcccgcaagcaaatgaaagagcggaagaacagggccaagatgatccgtggtgtcaagaagaccaaggcttgtga

SEQ ID NO: 72020 - DNA, 467 bp, Zea mays
  unsure at all n locations
  Clone ID: LIB3078-002-Q1-K1-C10
agtacctccgcttcctccgcaagcggatgaacaccaagccgtcccacgggcccatccacttgggcgcccccgccaagatcctgtggcgcaccatccgcgggatgattccgcacaagaccaagaggggggaggcggctctggcgaggctcaagacgtacgatggcgtcccgccgccgtacgacaagaccaagcgtatggtcatccctgacgctcttaaggttctgaggctacagcctggacacaagtactgcctnctcggcgagctctctaaggaggtcgggtggaactaccatgacaccatcagggaacttgaggagaagaggaaggagaaggccaaggttgcctacgagaggaagaagcaattggccaagctgcgtgtcaaggccgagaaggcagccgaggagaagttgcagtctcagatggagattcttgtccctatcaagtactgaggagctgtgctttgtcat

SEQ ID NO: 72021 - DNA, 464 bp, Zea mays
  unsure at all n locations
  Clone ID: LIB3078-002-Q1-K1-C11
cccacgcgtccgcggacgcgtgggcttgccgccgccactgcccgatccaggtgtgcagacggctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctccccttccagcgcctcgtccgcgagatcgcgcaggacttcaagacggacctgcggttccagtcctcggccgtggcggcgctgcatgaggccgcggaggcgtacctggtggggctcttcgaggacaccaacctctgcgccatccacgccaagagggtcaccatcatgcccaaggacatncagc

SEQ ID NO: 72022 - DNA, 454 bp, Zea mays
  unsure at all n locations
  Clone ID: LIB3078-002-Q1-K1-C12
cccacgcgtccgcgcaggctgagcagcaaccgccccaatctgcagttcaagaaccgtccacgcagaacccgtccgccctccgctccttccaacttgctctctacctgcaccagcctcgcccacccttcgctcgccgccgccatggggaggggaaagttcaagggaaagcccaccggccgccacagcgtctccacaccagaggagatcgctgctggtacttcaggtcgccctcgcacctttatgaagacatgcaattgaaaaagagaattgatcttttttatgggcgaagtgtcgaagatggctttggtgaaggaaatgtcttgttagcatcaagtaaatggcgacatcacaacccctacaagcttgtgccttanaacaagaggatacaagaagttggagtgcttttgtgaaggcttttgcgaatcactngaagcgttagtacttttgtgaatga

SEQ ID NO: 72023 - DNA, 425 bp, Zea mays
  Clone ID: LIB3078-002-Q1-K1-C2
agccttccgcggccccttgggtttggccccccgatccctattccttgcgcgctcctctctgccgggcggcttcttcacgcgtgtctctctctccctggtgcctgctcgcgacaacctcctgctcccttccgtggtcgcgtgctcagctctactgcacgccgcgcccagcttctctccctcggcgctcacagctctctctctcccctagtccctgccatggccgccgttccctggtcggagtttcttctagctcggatctcctccctacggcgcccgagctccatggctgctgcgttcttcagccgacgcgtcctgccgagtccttctgcatccacacggcgtcctgcttgcccagctctcatccatggccggagccctcccatgtcacgtcccagccaagcccctgcctcgatccctgtccgggc

SEQ ID NO: 72024 - DNA, 419 bp, Zea mays
  Clone ID: LIB3078-002-Q1-K1-C3
cgcactcgtgcggacagcctctatgttcgctcttcactcgctccttgatggtctggggagggctactgacgcgatgatcgccgtaaaggttgcctgcttctgacgataccgtgatgtcttccagggtcgcgctcttagctttactgaaggtggtgcccatgttatctcgatcgacactgacagcttttgctctctcctagctcttaccgaggccgttgatgtctgtccgtagtatgacgtagctcgtatctcctacatactgctcacgagctctatcgacgctgatttcttcatgcgacacgtcatgccgagtacttatacatacgcacttcgtcgtgattgcgcagattttatccatggccgtagtcttctcatgtcacgtaccaaccaagcctgtgagtgcatcactgtccagtcct

SEQ ID NO: 72025 - DNA, 405 bp, Zea mays
  unsure at all n locations
  Clone ID: LIB3078-002-Q1-K1-C5
cggacgcgtgggcggacgcgtgggtagagattgctggtcgagaagaagagatgttgacatatataataactactgtaggcagcggcatctcctgctgggacgaagattcaagaagctagctaagagagaagggcataacgagataataagcagcgcgcgaagatgcaagactgggcgccggtgttcgtctcgctggtgctcttcatcctgctgtcgccgggcctgctgttccagatgccgggcaagtgccggatcatcgagttcggcaacttccagaccagcgccatctccatcctcgtccacgccatcctcttcttcgccctcgccgncatcttcctcgtcgccgtcggggtgcacatgtacctcggctcctaggcggcggcgcggtgcgccgtaccttctctc

SEQ ID NO: 72026 - DNA, 413 bp, Zea mays
  Clone ID: LIB3078-002-Q1-K1-C6
cccacgcgtccgcccacgcgtccgcgaagatcggagagtggggtggatacgccggggatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcaaggacgagggcaccccgttccgtgtcaaggtgatgaacaacggccacgtcgctggcttcttt

SEQ ID NO: 72027 - DNA, 413 bp, Zea mays
  Clone ID: LIB3078-002-Q1-K1-C7
ccgaggcacggctccctcggcttccttcccaggaagcgctcctcccgccaccgcggcaaggtgaagtcatttcccagggatgaccccaagaagccttgccatctcactgccttccttggctacaaggctggcatgactcacattgtccgtgaggttgagaagccaggatccaaactccataagaaggaaacttgtgaggctgttaccatcattgaaacccctactcttgtcattgttgggctcgtggcatatgtgaagactcctcgtggcctccgcacactcaactctgtttgggcccaacatcttagcgaagaagtgaggagaaggttctacaagaactggtgcaagagcaagacgaaggctttcacaaagtatgctctcaaatatgaaaatgatgctggcaagaaggaaat

SEQ ID NO: 72028 - DNA, 368 bp, Zea mays
  Clone ID: LIB3078-002-Q1-K1-C8
cccacgcgtccgcccacgcgtccggtgcaggacggcgacccgaccaagaccatcggggtgcccgagggcttcgactacgagctctacaaccgcaacgacatcaaccgcatcctcgggcccaaggcctcctgcatctccttcaaggactccgcctgccgctgcttcggctacatggtctccaagaagaagtacatctacaccatcgacgacgactgcttcgttgccaaggacccatctggcaaggatatcaatgctcttgagcagcacatcaagaacctactcagcccatccaccccgttcttcttcaacaccctgtacgacccctaccgtgagggtgctgactttgtgcgtggataccccttcagcct

SEQ ID NO: 72029 - DNA, 357 bp, Zea mays
  Clone ID: LIB3078-002-Q1-K1-C9
ccaccagctgccattgccatctactgacctgtgacctccgcattttcaaacagcccgagccgtctagatcgagcatagcggcaggcacctccctactcaaggaacatggcccgcacgcagcagttggcagtagtggcgaccgccgcggtggccttggtgctgatggccgcagctacctccgaggcggccatcaactgcgggcatgtggcgttggccatggcgccctgcatctcctacgcgcgccgacagggctcggggccctgcgccggctgctgcaaccgcgtcaggagcctcaacaacgccgtccgcaccaccgactaccgtcgcgccgtctgcaactggctcaagaacgccgtc

SEQ ID NO: 72030 - DNA, 240 bp, Zea mays
  Clone ID: LIB3078-002-Q1-K1-D1
aaccaacttcgtccccggcaactaagctcaacggctatgctatgcaacttcattgtcgttcggatcggagagggtgtacgtacgtggattgattgatgctgcgagatgcatgtgtgtcttttgtttcacgttgcattgcataggcaagtcgagatgatgagttggcgttgtacactaagatgaaccatgtttgtgcaatagtggtggtttttgtttcctgctggttaattgttgatatcc

SEQ ID NO: 72031 - DNA, 406 bp, Zea mays
  Clone ID: LIB3078-002-Q1-K1-B5
cgcgcggcgaccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgttaccgtcctggaactgttgccctccgtgagatccgcaagtatcagaagagcactgagctgctgatcaagaagctgcccttccagaggctcgtcagggaaattgcacaggacttcaaaactgatttgcgtttccagagccatgcggtgcttgcccttcaggaggctgctgaggcataccttgttggcctgtttgaggacaccaacctgtgcgccattcatgctaagcgtg

SEQ ID NO: 72032 - DNA, 306 bp, Zea mays
  Clone ID: LIB3078-006-Q1-K1-F1
tctcgacccacgcatccactcacacttacaatccattttcatcatatatctaactatcactatttcagttacatttgacatgcataaatacttcaattgatcatatacaatcaactacaacaacatcaactacatgatatttcattacaaatacttcatgtaagaatatcaccttcatatcatcttataaatatcttcttatttaaaactattattaatgccaacatacaacctcatcaccaaactttcaatatttaattctatccataaatttccatactctttactcctttacaattcctacca

SEQ ID NO: 72033 - DNA, 416 bp, Zea mays
  unsure at all n locations
  Clone ID: LIB3078-006-Q1-K1-F10
tgatccactcccgctgggccangtgttgcgcgctcggctgcgtcttcccggagcttggctcccgcaacggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggtcgtctcgccatgttctccatgttcggattcttcgtccaggccatcgtcaccgggaagggc

SEQ ID NO: 72034 - DNA, 425 bp, Zea mays
  Clone ID: LIB3078-006-Q1-K1-F11
cccacgcgtccgggaacggttactgaacatgagcttgcagtatgcggaggtggaggctcagagggagcggttagtgatggagctcaaagccatgaagaaaggcaggtggttttagcaatgatggagaactgttgcctgacataaaacagacacaggctgactgacagcacagatgggcatgtcatgtgagagcaagcaaagcaaagcaaatgcaagtgatgcagagcctggacctgctaactggtgctggaagatgtgtatcccaagacgacactgaaggtccctgtgaccacccagcgcccctacatgacatgatgatcccattgttattggtatttatttttaacggcgtgccttttcatcttgtatataatatacgccggtttgtgaggagcttgactggtcagttgttgatatgattactc

SEQ ID NO: 72035 - DNA, 338 bp, Zea mays
  unsure at all n locations
  Clone ID: LIB3078-006-Q1-K1-F2
caaacaagtaggcacatggcacatcagttccgcccaatacagctgttgtggtatccacggtgcttcctgaagttacaagacctgaaaaatagaagagacattggagagaagccacattcttttgcgtatcttgctcaccgtcacctgacgaacaaaatatgacatcgggagtgcagtaacgattagtgagtggtcctgtattgagcctgggtgcagcctctgccagtataagtgctctacgtgttatacatttttttatgtccatgaaacattgatccactgagaaaatatatcttcaggtgccaatctacgacaaanaaaaaaaaaaagggcggccg

SEQ ID NO: 72036 - DNA, 361 bp, Zea mays
  Clone ID: LIB3078-006-Q1-K1-F3
ctcccccaccgtctacgactggctctacagcgactagaccaggagcaaccaccgctagatcgggcgagatggatggacagtgaagaggccatgtttgctggtccttgtggttatctaaaacgcacgcatgctctattatagctagtcatcactatatatatacttgtgtttgtgtattgttgttcttgttctgctggtgtctccgccgtttaatttgacctatgttatggagtgagtgatatatgtgccgtcactcctagtatatagtagtgagtgactagttggtatgtgtagtactgtactatcttttctccatatgcatgttttgccagcgcgtaatgaatgtaatgtcagtactgct

SEQ ID NO: 72037 - DNA, 279 bp, Zea mays
  unsure at all n locations
  Clone ID: LIB3078-006-Q1-K1-F4
gacccacgcgtccgcccactcgtccgctcagcaacaacctgctggcgtggatcctccggggggtcttcagcctcatctggtccctctacaccatctacacctctgacctcgacgaggacgaggagtccggtggcctctcgctctagatccaccctctcctgttaatgatctgaatgtaaacatggtggcggtcatcggtgtaaatttagacatggctatttgcatctaagatccatcctctcctgttaataatgtntggagactacgtacgcctgaact

SEQ ID NO: 72038 - DNA, 438 bp, Zea mays
  Clone ID: LIB3078-006-Q1-K1-F5
gttaaaatccaattttattcagacaagagcatcaccatatatttgggttgatgataggtgtgacaggagacttgcaagaatactacgggtggctatggcaattagctgtgggaacgtcaactgcatgatatttcattacaatttgttcatgaaagatgagcaccttcatttcatctcagaaagatctcctcatttaaaacggttggttatgccagcatggaaccgcatcaccaaagtgggaatatgtaatgctatccaaaggtggcaggcgctggagtccttgacaatgcctaccatcggacatcctccatatattatggaagagatagcaaggagctgcaagaatttcacagaacttaagatcatgggctcatttgatcaacaatttgcctcggcaattttgcagttccttccaaagctgaaagtgctgagccctcg

SEQ ID NO: 72039 - DNA, 329 bp, Zea mays
  Clone ID: LIB3078-006-Q1-K1-F6
gctcgggctcactgcgccaccagccatgttacaagacttaaaacctgctggtggctctagtctcattgggggtgagacagaaactcttgagagggtgaaaaaatttgcttcaaaatgctctattcagcccaaccaagttgaccaaagccattcccaagattgcctatattgggcttaattctcttgccaaaattcttcattgcttggttcaaggtggcttttttcaacggtcaaggattaagaagttgaaaaaccttcctactaaagcaattccttttgggtcaacacccaagattaatgatggcacatctgatgttggaacaaattgg

SEQ ID NO: 72040 - DNA, 413 bp, Zea mays
  Clone ID: LIB3078-006-Q1-K1-F9
gggagcgcatcctggtggccatatgaagagaacgaaggccgtggagcacatgatggtgagcagagccaagcccaacatagcagacgctgaacagaaagacatgctagactacctatacacatggtagtacaagatgcgagggatactcccggactcgctaggccgcatcgaggaccgaagcagggacaacttcacgcacgctgaggtcatgcgtgctcagcacaagcatgacatgctgcgagatcagagtaacgtagtactactgcaaagttgtcgacgagcacgtaaagccccgttgctatatatcgagtgcgcagtggaagacgacattatacctgtgtgtccaacgggagagactgcgtctagagaggcaacggacgacgcattagagtctatggacacgtagatcagac

SEQ ID NO: 72041 - DNA, 413 bp, Zea mays
  Clone ID: LIB3078-006-Q1-K1-G10
cccacgcgtccgcccacgcgtccggggcaggctgcgcgcgcaggccacctacgacgtgaagctgatcacgccggagggggaggtggagctgcaggtgcccgacgacgtgtacatcctggaccaggccgaggaggacggcatcgacctgccctactcctgccgcgcggggtcctgctcctcctgcgccggcaaggtcgtctccggctccgtggaccagtccgaccagagctacctcgacgacggccagatcgccgccggctgggtgctcacctgccacgcctaccccacctctgacgtcgtcatcgagacgcacaaggaggaggagctcaccggcgcataatcattcatgcccatccatctctatctctgtgggtcgtcgttgtgtgtaatttgagtacgcgcgtacacgtact

SEQ ID NO: 72042 - DNA, 422 bp, Zea mays
  Clone ID: LIB3078-006-Q1-K1-G11
cggagcctgatcttaggcggaggaaattttgtacataatacacttacctgcaatggagagaaacaaaagggctatttactaacgtctgctgcctgacagaattgaactagatcgcttggtacttgtacatggcccgatggccgccctttgcgattatctttctcactattctcagtctactatagagatgagtgccatggcatggtagcctcaataacaacagatatagtttacttgtgataaactgaagagatagtcatgaacagcgtcctggaaaatcaccagatactgcccaatctgaatctatagagctaagggaattctgtctgtgttatgctcctctaagtgctgagccttctgatctgatgtatgtatctcaatgctccgtgcgttgtcttttccttctttattcagaacattta

SEQ ID NO: 72043 - DNA, 267 bp, Zea mays
  Clone ID: LIB3078-006-Q1-K1-G12
aaaaaaaaaaaaaaaaaaaaaaataaataaaaaaaaaaaaaaaaaaaaaaaaaagaaagaaaaaaaataaaaaaaaaaaaaaaaaaaaaatataaataataaaattaaaattattttaaatgataatataaaaattaatatttattattatataacctagtatttttataactttaatcttttttttaaaatgttgatattgataaattgctttattttataaatttatttgtatttcaatttttaaaatttttggaaattgtaatt

SEQ ID NO: 72044 - DNA, 301 bp, Zea mays
  Clone ID: LIB3078-006-Q1-K1-G2
cccacgcgtccgcccacgcgtccgcccacgcgtccgcgacatcacggtggaggagtgggtcaacacgcacggtcccaacgaccgcacgctcgcgcaggggctcaagggtgaccccacgtacctggtggtggagcaggacaagacgctggccacctacgggatcaacgccgtgtgcacccacctcggctgcgtcgtgccgtggaacggcgccgagaacaagttcatctgcccctgccatggatcccagtacaacaaccagggcaaggtggtccgcggaccggcgcctctgtcgctggctctg

SEQ ID NO: 72045 - DNA, 437 bp, Zea mays
  Clone ID: LIB3078-006-Q1-K1-G3
cggcgacaagggggcgacgaggcaggcggagcggacggcgactacagcggcggcagatcgcacggaatggcggcgaaggcaatctcgagccccgtgccggtggagtggtacccgacgctggccgtcgtcatggtatcacgtatgcctcatgttcaccggctccttcttcatttatgaagcaacttcatcccggaggagccgtaacctgtcaaaggagatcgcaacagcagttgttgcttctggtctcttgggctttgggtctctgttcgtgcttcttgcaagtggtgtttatgtctgatgactggctatgggccgtgtgtgcttgtgttctgcatccagagttgtatacttggttatgacagatcctaaaagctgttgtcctaacgaatatagagcatttgaacttattctagaacgatgtatgggagcaaccgagt

SEQ ID NO: 72046 - DNA, 418 bp, Zea mays
  Clone ID: LIB3078-006-Q1-K1-E9
cggacgcgtgggcggacgcgtgggcggacgcgtgggcgagaccttcgccaagaaccgggagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaaggtgaaggagctcaag

SEQ ID NO: 72047 - DNA, 380 bp, Zea mays
  Clone ID: LIB3078-006-Q1-K1-D2
cccacgcgtccggtggttattggtcttggaggggttggcagtcatgcagcatcaatgctgctgagatctggtgttggcaggttgcttcttgtggattttgatcaggtatcactctcatcactaaatcggcatgctgtggcaaccagagatgacgttggaacttcaaaagcgttgtgcctcaagaagcatttttcaatgatatacccagagtgccaaatagatgcaaaagtgcaattgtatgatgcatcgtctgaggaggaaattctttctggacagcctgactttgttcttgattgcatagataacattgataccaaggtgtcactccttgcagcttgcgtgcgcaaaagtttgaaagtactttctgcaatgggggcttg

SEQ ID NO: 72048 - DNA, 430 bp, Zea mays
  Clone ID: LIB3078-006-Q1-K1-D3
atttgcttcagcggcgaccatgacatgtgtgtaccttacaccgggactgaagcatggagtgcgtctttaggctacgccgtcgttgatccgtggcgacagtggattgtcgacgaacaagttgccgggtatgtatctggattctgaacacaagcatatatgcattgaccctttatttcctcctaagatctttgaaccgtttagtcgatcctagatcgatgttgagtaattgctagctcttggacgatatgaattcactactataatcaacaaaaactttggcattatttatatatttcacgaaatattcagctcgatgatttgttatcatgttccatttgttccagtcaaatgtttgtatttttgctcccaggtacacccaaggatatgaaaagggccttacttttgccactattaagggtgctgggcacac

SEQ ID NO: 72049 - DNA, 373 bp, Zea mays
  Clone ID: LIB3078-006-Q1-K1-D4
tcatcctatgacacctaccttcgaccataacatttttttaccttacactcatacaggatcaatgaagctgatatcaaacttcgccagctttcatcttgaacatctttatcatgtatcactatcatcactaaatcatcattctgtatcaaccacacatgactatataccttcacaatctatttccctcaaaaatcatttaacaatgatatacccacaataccaaatatattcaaaagttcacttctatgactacatttactcactactaaattctttctatacatcctgacttttttacttattgcatacattacacttataccaaattatcactcattacacatttctttcacacaaattttaaaatactttc

SEQ ID NO: 72050 - DNA, 358 bp, Zea mays
  Clone ID: LIB3078-006-Q1-K1-D5
tcatcctcccactcatcctcgcactcttccaccgactcaagcgcaccgacaacctctccatcaacagagctttctgcacaatcctctacctcctatcaactcactcaatacatcctcaacatccactcctacacctcctacgacaccaaaacctctaccacctcaacacctgccatacctttacacgcacgacctactcaaacagtactactacctcatctcaacaccaatacaccctacctctacttcatcatcaaccactatctcatccaccacaacttcacctacccctacttctacaacttcaactactataccatctacaagctgcccatcaacgactccaacaacgccaccc

SEQ ID NO: 72051 - DNA, 417 bp, Zea mays
  Clone ID: LIB3078-006-Q1-K1-D7
cccacgcgtccgcccacgcgtccgcacggtgtacgccacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcgggcccctcatcggcggcggcctcgccggcgtcatctacgagctgctcttcatctcccacacccacgagcagctcccctccaccgactactaaaagccgaagccgaccgacccaggggtgcgcagctagcatccagctctctctccccgctcgccgtcgatcgtttagtttctctcgtgcacgtgcatgcatcgtcgact

SEQ ID NO: 72052 - DNA, 442 bp, Zea mays
  Clone ID: LIB3078-006-Q1-K1-D8
attccctttcgacccacgcggtcggccacgcgtccgcggacgcgtccgcacggtgtacgcgacttcggtggacccgaagaagggcagcctaagcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcgggcccctcatcggcggcggcactcgccggcgtcatctacaagctgctcttcatctcccacacccacgagcagctccccttcaccgactactaaaagccgtaaccgaccgacccaggggtgcgcagctagcatccagctctctctacccgctcgccgtcgatcgtttagtttctctcgggcacgtgcatgcatcgtcgact

SEQ ID NO: 72053 - DNA, 420 bp, Zea mays
  Clone ID: LIB3078-006-Q1-K1-D9
cccacgcgtccgccccactcccgactccccgacgcacgagctcccaggagttagccagggcctccaccaccctctcctccgccttcagcctcctctcccgcccctccacctccccgtgccccgccgtctcgctcccgaggtcctccttccccgtgcctgacagccgccggagacgccgcgccgtcaccgtcgcgtccaccgccaccgagtcccccaaggtcttggagctcggggacaccattgccgggctcactctcgaggaggcccgcaaccttgttgaccacctccaggagcggctcggcgtcacagctgcggccttcgcgccggccgccgtcgtcgcagcgcctggggcgggcggcggggccgcggccgaggaggaggcccccgttgagaagacggagttcgacgtagtaattgaag

SEQ ID NO: 72054 - DNA, 420 bp, Zea mays
  Clone ID: LIB3078-006-Q1-K1-E10
gaagaaggtgcctcctacccgtgccaaatcgccaaagtttacaagttcaaggagggggagctgcagtgatacaccattgacacctggcgtggaaaataccaacgcaacatctacccggccacatcgtcacagcatcgggagtcctagagacgctaacagagtacaacaatgctcgccaaagagcggtgtggcaaccaaaacaagatctgtcaaggctgagctgaatgccctatgaacagcatggagcagccgagtgatgtggttctctgtacaaactgaattgtctaaccgtttacatgttcatgcatttttgcttctatcgtatacccaacatctctagcaaatgaaggctgttgggtcaatgacgttgttcagcgccactggaccttattcatcttcttacattcgccttgtactcgt

SEQ ID NO: 72055 - DNA, 420 bp, Zea mays
  Clone ID: LIB3078-006-Q1-K1-E11
ggctgtccgcatcatcaagcataccctggagatcatccacctgctcaccgatgccaaccccatccaggtcgtcgtcgacgcgatcatcaacagtggaccccgtgaggatgccacccgtattggttccgctggtgttgtgaggaggcaggccgtggatatctcacccctgaggagggtgaaccaggccatctacctcctcaccactggtgccagggagagtgctttccggaacatcaaaaccattgccgagtgccttgcagatgagctgatcaacgctgccaagggctcatccaacagttacgccatcaagaagaaggacgagattgagcgtgttgccaaggccaaccgttgaactgagcttgtatcctggtgcactctgcgctggaaacttttatgtcgctggcagtcgtatcggttctt

SEQ ID NO: 72056 - DNA, 427 bp, Zea mays
  unsure at all n locations
  Clone ID: LIB3078-006-Q1-K1-E12
ctagcagccgctcactccagcctttacccgcagctagcaaacaaatggccaccgtcctgagcagcccccgcgcgccggccttctccttctccctccgcgccgcgccagcgcccactaccgtggccatgacccgtggcggtggcgccagcagcaggctgcgcgcgcaggccacctacaacgtgaagctcatcacgccggagggggaggtggagctgcaggtgcccgacgacgtctacatcctggactacgccgaggaggaaggcatcgacctgccctactcctgccgcgcggggtcctgctcctcctgcgccggcaaggtcgtctccggctccgtggaccagtccgaccagagctacctcgacgacggccagatcgccgncggctgggtgctcacctgcgtggcgtaccccacctncgacgtcgtcat

SEQ ID NO: 72057 - DNA, 441 bp, Zea mays
  Clone ID: LIB3078-006-Q1-K1-E2
cggacgcgtgggcgcggatggcgaccagcggcggcggctgcgagagctcgaggcggaggcggaggcggaggcggaagctggatcgatcttgggtcctccgaggagcagcccccgcgaggtgagggaggagatggcccggtgcttcgacctcgtccgccgcctcggtaggggcgccgtctacctcggctcctccagggtcccgcccacgcacccgcacttcctccaaaccaccgagctcgccagagagatagctcggctgctcgactgcaccacatggacgggagccggccctgggctcatggatgctgccatccaaggcgcctttgaggcagacaagcctgtcggtggcttgaggattgcaaaggaagcgggtgaatggacaagctcaggcttccatccttacttgccaccggagacctacctcacatgcaggttcttctc

SEQ ID NO: 72058 - DNA, 261 bp, Zea mays
  Clone ID: LIB3078-006-Q1-K1-E3
cccacgcgtccgcggacgcttgggcttcaaacggctctcacttactgacgtcaagattggcatcaaacgcgttcccaagaagtcaaccctgatcaaggctatggaggaagctgatgtgaagacgaagtgggaaaacagctcatggggcatgaagctgattgtccagaagaggagggctgcactcagtgactttgacaggttcaaggtcatgctggcatggatcaagaggagtggtgctatcaggcaagatcttgccaatgc

SEQ ID NO: 72059 - DNA, 363 bp, Zea mays
  unsure at all n locations
  Clone ID: LIB3078-006-Q1-K1-E4
ccctgggccaccagttcgccacccgtatgggcaacgtgttcaccatcgggaagggtaataagccgtgggtgagcctgcccaagggcaagggaatcaagctgagcatcatagaagagcaaaggaagcgggatgccgctgcccaggctgctgccaacgcataaatcctctgaatgtgctgtgttgagagttttttctagttgctctgcaaggatatagaacaatgttctaagactaccatgtttttaagtctgcctgatgcttataattcatgaacgatttttgcagctagctgtaatgtgactatnntatctatctgctngttcaaccctgttgtcgtgtgttgattctctggttcatgggcta

SEQ ID NO: 72060 - DNA, 435 bp, Zea mays
  Clone ID: LIB3078-006-Q1-K1-E5
cgtctgaggacagaacaccaagtttatgaactgccagattcacaccctcttctggaagggttcgaacagagagaaccagatgatccctgtccatatcttctttccatatggaccccaggtgaaactgcacaatcgatcgatgcccccaagacattctgtgattcaggggagacgggtagactatgtggaagttcaacatgctttagttgcaacaatatacgagaaatgcaggctcagaaagtcagaggaacacttttgataccatgccgaacagcaatgagaggaagcttcccacttaatgggacgtattttcaagttaatgaggtatttgctgaccattgctcaagtcaaaatccaattgatgtcccacgaagttggatttgggaccttccaagacgaactgtttactttggaactctaattcctacaatattc

SEQ ID NO: 72061 - DNA, 438 bp, Zea mays
  unsure at all n locations
  Clone ID: LIB3078-006-Q1-K1-E6
aattgtcacttgctctccctccaacaagctaattaaggccggtcgtcatccctcttctagctcgttttattatccatggcggaggagaagcaccaccaccaccacctgttccaccataagaaggacgaagagcaagaagagcaactcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcgaaaaaagacccggagcacgcgcaccgncacaagatcgaggangaggtcgcgggcgccgcggccgtcggctccggcggcttcgcctttcacgagcaccacgagaagaag

SEQ ID NO: 72062 - DNA, 361 bp, Zea mays
  unsure at all n locations
  Clone ID: LIB3078-006-Q1-K1-E7
ttatcatcgcttccagccgcctctcctcccagtgccttttgcangtgtcctacgccatcagcgtgcctgagcccctgtccgtgttcgtcgactcctacggcaccgggaccatccccgacaaggagatcctaaagatcgtcaatgagaacttcgacttcaggccagggatgatcaccatcaacctcgacctcaagaagggcggcaacaggttcatcaagaccgtcgcatacggccactttggccgtgacgactccgacttcacctgtgaagtggtcaagcccctaaagaaggcatcctcttaaaaatgtattgngaagttcaatggacattatgttcatctttctctggttcttctgatacc

SEQ ID NO: 72063 - DNA, 369 bp, Zea mays
  Clone ID: LIB3078-006-Q1-K1-D12
gcaggcgacggcgggctcgtcttcgagcccagccagttcaccgtcaaggccggggacggcatcaccttcaagaacaacgccggcttcccgcacaacgtcgtgttcgacgaagacgaggtgccgagcggcgtcgacgcctccaagatctcgcaggaggagtacctcaacgcgccaggcgagacctactccgtcaccctcaccgtgccgggcacctacggcttctactgcgagccgcaccaaggagcaggaatggtcggcaagatcacagtcaactaaagctagctatccattccatgcatctcgatctgtatgtactccgcccgtcgatggatgatgcatccatctctacttgttttcctcacatgtaca

SEQ ID NO: 72064 - DNA, 333 bp, Zea mays
  Clone ID: LIB3078-006-Q1-K1-B5
cccactcgttcggctaatcgcaggaatccaccacaaaatcctctcgcacagtctgtccggagtttttgggacttgagaaaagaaaatacaaagccttcacctggagtcagtatagtgagtgcaagagttcagcaaaagtcttttgcccgtatcaagagtattattgaagagtctaacagcatattgaaagaagatcaatctaggagttcacaatctatgaggaagcaccaaattcctgattagcttaatgacatttactcagagaatgatgatatttacaatctggctccctcaataatgtccaagaatcaatcacaaggtcctactgcttac

SEQ ID NO: 72065 - DNA, 282 bp, Zea mays
  Clone ID: LIB3078-006-Q1-K1-B6
cagctctgcaggatggtgacttgtacctcttcgaatcacgagcaatctgcaagtacgctgctcgcaaaagacagccagaactggtgaaggaaggaaacctcgaagaggcagcaatggtggatgtttggatcgaggtggaggctaaccagtacaccgctgcactgaaccccattctcttccaggtcctcatcagtccgatgcttgggggatccaccgaccagaaagttgtggatgagaaccttgagaagctgaaaaaggtgctagaggtgtacgaggcacgcc

SEQ ID NO: 72066 - DNA, 429 bp, Zea mays
  Clone ID: LIB3078-006-Q1-K1-B7
gacacgcgtacgctcacgcgttcggctcaaggagctggtccccggctgcagtaaggtatggtgaacaggattggtgctagatgagatcatcaatcatgttcagtctctccaaaggcaagttgagtacttgtcaatgaggctcgcagctgtaaacccaagggtcgattttggtgggctagacagctttctgaccacagagtgtggaaggatagcaggcttcaactgcaagaacggaatcgacttggagcaggtaacctggccagaaatgggtgttcatggagcaaggcagctgatgcaacttcaacagcagttctggcatggccatttaacacatccacaccaagtggcttcacagtgggaaaagcttggcgatggccattctcccgtctttagcaactgcagtccctctatcttccgctatgatctaac

SEQ ID NO: 72067 - DNA, 277 bp, Zea mays
  Clone ID: LIB3078-006-Q1-K1-B8
cccacgcgtccgagaacagcaagcgtctcatccacttctccacgtgcgaagtctatggcgggaccatcggcagcttcctccccaaagaccacccgctccgcaagggacctgaattttatggtctgaaagaagatgagtcaccctgtatttttggtccaatcgtgaaacaacgatggtcctatgcttgcgcgaagcaacttattgagaggcttatatttgctgaaggtgcaaaaaatggccttgaattcaacatcgtgagaccttttaattggattgg

SEQ ID NO: 72068 - DNA, 411 bp, Zea mays
  Clone ID: LIB3078-006-Q1-K1-B9
agcaacttcaatgctgtcattctcaagaggctcttcatgagcaaaaccaatcggccagcaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagaaagctcgtggc

SEQ ID NO: 72069 - DNA, 108 bp, Zea mays
  Clone ID: LIB3078-006-Q1-K1-C10
cccacgcgtgcgctgacgcgttttttttaacaccgccggactctctcacaaccggctgacttttttgaataaccggtagctcgatatgatacactgccgcaataccat

SEQ ID NO: 72070 - DNA, 338 bp, Zea mays
  Clone ID: LIB3078-006-Q1-K1-C11
ctcatctgggtcaccctctccgacatgttcatcgacggggatgacccgtccaggatcgccttcaagacgcccaccgggctcggcaggacctaccccgtctccgccttcgccaaggaaggcgccaccgacacagaggccaagcccaaggacgcccccgcaactaccgtcgccgctaacggtgaggcagctgccagcaagtgaggcggcggcgacgtccggagcttttacttgtgggctactctccttactgtagtagctgtaattggtgatatttatagtgcctcctgaataacggtgtttgtacgtctactacctgcttgaatttagcgtgttttatg

SEQ ID NO: 72071 - DNA, 428 bp, Zea mays
  Clone ID: LIB3078-006-Q1-K1-C12
gcaagggcacctccgtacctacatgaacgcggggattcccaagcggttcaaagaggatgaggagaaagaacagcttgcaaaagatctcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctctgagcccccgcttccgtggtgagcacgctctcagacgttatgaatctggggaagagcgctgcattgcttgtaaactatgcgaagctatatgcccagcgcaggcaattacaattgaggctgaagaacgtgaagatggcagtcgccgaaccacaagatatgatattgacatgaccaaatgcatttactgtgggttctgtcaag

SEQ ID NO: 72072 - DNA, 436 bp, Zea mays
  Clone ID: LIB3078-006-Q1-K1-C2
gcgagcggccgctcgcgatctagaactagtgatcttccatttactggttgtgcaggaaggatatgctcaatttgtgtttttagatccatgatatgttgtcggtctgttgtttgtagtcctagatatcttcgtttttgtcactactaaaaacaccgatcggttctgatgtactgctatttattgctctgatatttttgtcatgtatgtgattggtgacttgggctttactagaggaacattcgtggtatagttttgaagagagaagtgagtcataaaattagagatatctgcattcattgtgatctatctttaacacttcatttttactgtagacatcaagtaagtggcgacatcacaacccctacaagtttgtgcctcaaaacaagaggatacaagaagttggaatgcttttgtgaaggcttttgcgaatcacttg

SEQ ID NO: 72073 - DNA, 248 bp, Zea mays
  Clone ID: LIB3078-006-Q1-K1-C3
caagcgggcaggccctagatgtagaggttcaagctaacgagatattgacgaacaagaagaatgtcattcagatcgtatcaggcttcacaggccgcactcctgagcaggtagagaaagacattgacagatatcgctacataggccctatcgaggctgtcctatattgactcactgatagctatatctatgaaaacagtgtcatgccagttaagcctgactcggactgaactattctaacattcgtctta

SEQ ID NO: 72074 - DNA, 438 bp, Zea mays
  unsure at all n locations
  Clone ID: LIB3078-006-Q1-K1-C4
gaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaaggtgaaggagctcaagaacggccgnctngccatggtttccatgttcggcttcttcgtccaggccatc

SEQ ID NO: 72075 - DNA, 433 bp, Zea mays
  Clone ID: LIB3078-006-Q1-K1-C5
atctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaa

SEQ ID NO: 72076 - DNA, 142 bp, Zea mays
  Clone ID: LIB3078-006-Q1-K1-C6
cccacgcgtccgatgatgtcaagcctgcatattccacactttcgccatccgaagcacccgagccttaagattatcatgatgtgaaagattagctatgatcccaagatgttttcaagcttggtcttactgaatgaaagtttgg

SEQ ID NO: 72077 - DNA, 159 bp, Zea mays
  Clone ID: LIB3078-006-Q1-K1-C8
acctccgtagctccatatcatgggctcaactgcattttcaacctatcatctcccggcctcctgcaaatcctctcaacttcatctaaccctaatggattccctgcatgcaggtatgttcggcctaccccaacaagaaattcgagactctctcatacctac

SEQ ID NO: 72078 - DNA, 426 bp, Zea mays
  Clone ID: LIB3078-006-Q1-K1-C9
cggacgcgtgggcggacgcgtgggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgccggtggcccgctcggggaggtggtcgacccgctgtaccccggcggcagcttcgacccgctcgggctcgccgacgacccggaggcgttcgcggagctcaaggtcaa

SEQ ID NO: 72079 - DNA, 360 bp, Zea mays
  Clone ID: LIB3078-006-Q1-K1-D10
gtcggaggccatgacgactgcgaggcttcgatcctcggcctccctacgcgttgcgtctgctcctccactactctgtgggtcccgtctcgactcctctcgccgtctccaggttcccatatttccaggtttctcattctattatctggttgcatttcccatcctccaggcctaaacgtcttgcaagacgcgacaactttcatgtgatcgactgcttgcacgcttagatactatgcgccacgattgctgctctcactatagaggctgaatgcagccttattgaccacctcctggagccgctaggattctcaactgcggactatgagccggacgctgtacgttcatatcctggggcagtctgat

SEQ ID NO: 72080 - DNA, 426 bp, Zea mays
  Clone ID: LIB3078-006-Q1-K1-D11
attgcacagcaggtagctgtattaatctctaatattgcacgctgggattacccagaagagcggtatgtgtttatgatacagtctgccaatgttctaatttcccatcatgtgtttatggccttgtttcaaaccccgaagtaggtggcgattaaacattttgccatggctctgaagaattatggagagaaaactcagacgagtccttcaaagacaggcaaatcgctaagttgatttaagcaaggcagaaatccatccatattgtttcgttcaccaaagtgtgcttccagctacagttgactatggcagaagattattatagatcctgaacggactgactgctcgaggagtttcagtactggactgcaggtcccacagagggtcaatttttaatataccctgatgaaagctactgaacccaggtccaat

SEQ ID NO: 72081 - DNA, 427 bp, Zea mays
  unsure at all n locations
  Clone ID: LIB3078-006-Q1-K1-B4
tcgtctcgtattcaaagaagtcgtacctgtgccctgaatctttgtctaacanaagattgggatgattgtacatgacagcgatcanccttctngatcttcggccttcagaatgccanntaaacattgctgtnntcgttgcaaggggttcctgtacatagtctncatagaagtcttgcataccagtgatcggcattcagactctagtcgagccagcaagaaatnnggcagtagcatngctggcctaatcagaatgggttgggttatttaccagaaagcttgacagacnctcgatggacatggcatttctgttgaggcttcaagagtttnggaaattggtgaagaaccatgcctttcattgcagccnnngtagaagaaagagataccaaggaatgccctgcatcnnatggaagggaccataactgatgcc

SEQ ID NO: 72082 - DNA, 421 bp, Zea mays
  Clone ID: LIB3078-006-Q1-K1-A1
caaccatctaccagcgactcagcgagcgagagcagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggc

SEQ ID NO: 72083 - DNA, 384 bp, Zea mays
  Clone ID: LIB3078-006-Q1-K1-A10
gccgcgggcagagagaagtttgcttcagtcccatgtggcggcggcggtgtggctgttgcggcaggtgcacctgctgctggcggagctgctcctgcagctgaggcaaagaaagaagagaaggtggaagagaaggaagaaagcgatgatgatatgggcttcagcctcttcgactaggttgcacagtcatcacagtattgtttcgggcagtgaaatcaaagggaaaccagagtcatgtttagattttaaccttattttatgttggaaagtactgcaaagactgctaattgtctctgtatttggtaattcagctgtagattgctatgatggttgggatttactcgtgaaccagagtttttctatcttatatcctgaattggttatccc

SEQ ID NO: 72084 - DNA, 428 bp, Zea mays
  Clone ID: LIB3078-006-Q1-K1-A11
ggaggtggagccctccggcggggacttctggaagcttgaccccattatcgacctgatgaatcgcggcgccgtcggggtgatccctactgacaccgtctactccgtcgtctgtgacctgagtaacaatgaatcgattgagcgccttcgcagactgaaaggcattggagactccaagcctctcagcatcctgtgtcgctcattacgtgacatcgatacctacacaacaggatttcctcaaggcactaaccaagggcaagctaacatttttcgtgttgtcaagcgtgcaatacctgggccttacacatttattttacctgcaagcaagcagtttcctaaacaatgtataaagcatggttcttccacaaggtatgcaaaaaggaggcaggttggcgtccgaattccagatgatcccatctgccaggcaatat

SEQ ID NO: 72085 - DNA, 206 bp, Zea mays
  Clone ID: LIB3078-006-Q1-K1-A12
ggcgctctaaccttaaagctggtttttttatcagctacagcacactatacacgggatgcatcacctacaactgaggctgatccatacacacatcgaacacttcgaagcatgtaacataacacacaataaatacactcatcgcctccacatactgatacgcaattaaaacttcaatcctgccatcatctcacatctatcactactca

SEQ ID NO: 72086 - DNA, 433 bp, Zea mays
  Clone ID: LIB3078-006-Q1-K1-A2
gttcaatgatgttgtaggagtcactggattcatcctgacaaagctcgatggcactgcgcgcggtggctgtgtggttagcgttgtggatgagcttggcatcccggtgaagttcattggggttggtgaagggatggaagacctgcaaccttttgacgccgaggcatttgttgaagccatcttcccatgattttgggttttggagagataattcatgcttctactgtaaagctttggactctgccgttgctttggctcgttgtgcgagtttttttcttgttgggaactacgatagtggtaggaagcacatggcccgtgtcaagatgaactggaactggagttgaggcaaacaaagtggagcgtccagctttggagccctaagggatggtttggtaatcagagaattagatagggtctatagcggagaaatctcctt

SEQ ID NO: 72087 - DNA, 365 bp, Zea mays
  unsure at all n locations
  Clone ID: LIB3078-006-Q1-K1-A4
gtggagctagctagctagtagagaggtcaatcaccaatggcgaggcagctcgttgtgcttgctctgcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgtccggcaccgncagggctgccgggatcaagcccgaggtcgccattaccatccccaagcgctgcaacatggccgaccgncccgtccgctacaagtgcggagattacacgct

SEQ ID NO: 72088 - DNA, 428 bp, Zea mays
  unsure at all n locations
  Clone ID: LIB3078-006-Q1-K1-A5
gcagacagcgaggtggctcccgtgcagcgaccttgccacctcgtcgtcttcggcacccgcttcccctccccgctcgctggcgccttcggctccccccaagaaggcgttgattggtgcttctactggttctaccggaattgcgacgagcagtggtgctggtgcagcgatgagcaggagcaactggctgtcgaggtgggtcagctcctgctccgatgacgccaagacggcgtttgcggctgtgaccgtgccacttctctacgggtcgtccctggccgagccgaagtccatcccgtccaagtccatgtacccgaccttcgatgtcggtgatcggatactngctgagaaggtctcatacatattccgggatccagaaatttcggacatcgtgatcttccgggctcccccaggacttcaggtttatggctaca

SEQ ID NO: 72089 - DNA, 444 bp, Zea mays
  unsure at all n locations
  Clone ID: LIB3078-006-Q1-K1-A6
ccgaggacatctggttccatgtagataagatgtcctctgcacatgtgtatgtgagattggataaaggtgaatcaatggatgacatgagtgagggtttgctggaagactgtgcgcagcttgtcaaagctaattccattcaaggtaataaagtcaataacattgatgtagtttatactccatggtacaatttgaagaagacgccttcaatggatgtgggccaagttggttttcacaaccctaaattggttcgcactattaaagtggaaaagaggatcaatgagattgtgaaccgcttgaataagacaaaggtggaacggaaacctgatttaaaggctgaaagagaggctattagtgctgctgaaaaggcagaaagaaaggcacagcttagagacaagaaacgtanggaagagatggagaggcttgagaaagagaagcaagctgata

SEQ ID NO: 72090 - DNA, 433 bp, Zea mays
  Clone ID: LIB3078-006-Q1-K1-A7
gttcagaccaaagagcaagctgaactgtgcatccaagcatttgtaccttgaggtaccctgagattgcagcaggactaaaaagagcagtgttgctgtatccacagcttttgttcttgcctggcaagagatcatccttgcattcataaggttgtcgttatcatggtcaacagatgtacctggaaatcgtgaagttgtccctatggatggggcaagtgatccaagagcaagggttgctcttgcctttccactcggtttaaatcgtatacgtgtgatggagccagatgcagccttaatgatcctgtatctgacaagctcgtggaaatgtagcctatgctggaacggagtccagcatatgtaagatggattgatccaacgggggattagccatcatggccttcaggtgattgttcatctgaaaattcatgttgtgtgc

SEQ ID NO: 72091 - DNA, 192 bp, Zea mays
  Clone ID: LIB3078-006-Q1-K1-A8
tccgcttgcttgattgctccaggtacctccattcgcagtcggccgtgtccttggaaccgggggagatgggggatcaagagacagtagctgtggttgaagcacctaccccggttctaggggaaccgatggacctgatgactggcctgcaacttggcatgaaaaaatcaagggcttaccatggccttgtgaaag

SEQ ID NO: 72092 - DNA, 261 bp, Zea mays
  Clone ID: LIB3078-006-Q1-K1-A9
cgcgcgcggagctgagcccgtcgctggtgatcagcctgagcacgggcgtgtcgctcggcctgggccgcttcgtcttcttcaacttccagcgggagaacgtggcgaagcaggtgcccgagcagaacggcaagacgcacttcgacgccggcgacgagcgcgccaaggagttctcgggcctgctcaagtccaacgaccccgtgggcttcaacctcgtcgacgtcctcgcctggggctcgctcggccacatcgtcggctactaca

SEQ ID NO: 72093 - DNA, 427 bp, Zea mays
  Clone ID: LIB3078-006-Q1-K1-B10
gtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagcgaagaagtgaggagaaggttctacaagaactggtgcaagagcaagaagaaggctttcacaaagtatgctctcaaatatgaaaatgatgctggcaag

SEQ ID NO: 72094 - DNA, 424 bp, Zea mays
  Clone ID: LIB3078-006-Q1-K1-B11
cggacgcgtgggcggacgcgtgggcggacgcgtgggcgacgcgcccggacgtgggaggtacgccgccgcaggaggggggaggcggcgctgtggccgttctctgcccgtgagcgcccggatccgtcccgccgcaaggattatggatccgaaagagaagccaaatgtatcgagcagtccaccaacaccacggctggactgcataaaatgctttgatatgctctggttctgttactcaccattccaccagatgcagaattattaccggtatggggagttcgacacctgcttcggcaagtggggcgatcttatgggctgcctcgctctcaagacaaagcggaaggcagaggtggaggagatcctcatcgcgcgggagaaggccaaaccacatatctggacctaccggacggtcgatgaggcatcggag

SEQ ID NO: 72095 - DNA, 428 bp, Zea mays
  Clone ID: LIB3078-006-Q1-K1-B12
cccacgcgtccgggccaagaatgaggccggcggcatcatcggcacccggttcgagtcgtccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaagagcggctgcagc

SEQ ID NO: 72096 - DNA, 192 bp, Zea mays
  Clone ID: LIB3078-006-Q1-K1-B2
ccgagaatgattaccaagatagaaggcctttgtaatggtatcaagacaggggttgttaagatggtttacatagcaaaagcgcttgccaggccagcttcctacacaaccaagtactttggatgttagcttggtgcacagtccaaatttgatgagaagacagggatttactatgttaatgtgactcatgatact

SEQ ID NO: 72097 - DNA, 430 bp, Zea mays
  Clone ID: LIB3078-006-Q1-K1-B3
gttctatataaggtaccctggtggcctgtggtttgacccgctcggctggggcgccggggcgccggagaagatcaaggagctgcgcaccaaggagatcaagaacggacgcctcgccatgctcgccgtcatgggcgcttggttccaggccgagtacaccggcaccggacccatcgacaacctcttcgcccacctcgccgaccctggccacgccaccatcttccaggccttcacccccaaatgaggagctctgatgaacttagcagttcgaggagtgctaccacacatgcatgcattgttaggtttgatggccgatatggaacttcattttttttgttgcgggcggactactgggtagactgtcaatgatgatgatgatgaaatgttcgtggtgcgatgcatggtgtacttgtactatgttgtaactaatgta

SEQ ID NO: 72098 - DNA, 430 bp, Zea mays
  Clone ID: LIB3078-004-Q1-K1-G12
gtggcagggctgccagctttaacatcattccgagcagcaccggtgctgccaaggctggtggtaaagttctccctgatctgaatggcaagctcactggtatgtccttccgcgttcctactgtggatgtctcggttgttgacctcaccgtcagaatcgagaagggggcctcctatgaggatatcaagaaagctattaaggctgcttccgagggtccactcaagggtatcatgggttatgtggaggaggatctggtttctaccgacttccttggtgacagcaggtcgagcatcttcgacgccaaggccgggatcgctctgaacgaccacttcgtcaagcttgtctcgtggtacgacaacgagtggggctacagcaaccgcgtcgtcgacctgatccgccacatgttcaagacccagtagagggttttccccct

SEQ ID NO: 72099 - DNA, 344 bp, Zea mays
  Clone ID: LIB3078-004-Q1-K1-G3
ggtaaatcttctgtccacaccagtgttcacctctccccttcccaagtttgcccagtccgtaggtggtgaccatcgtcagcaggtagtccacctcgccgtgaccagaactcccagcacaaggactgaagcttcaagctgaagtggtgactgaagaggaatctactccagtggctgctgatcaagtggaagagccatctaactgggtagcttgtagagggatctagacctcttcactgcaacaaagaactcccagcacaaggactgaagattcaagctgaagtggtgactgaagaggaatctactccagtggctgctgatcaagtggaggagccatctaactgggt

SEQ ID NO: 72100 - DNA, 433 bp, Zea mays
  unsure at all n locations
  Clone ID: LIB3078-004-Q1-K1-G4
ggggcctcggatctgacccggagagcctgcggtggaacgtgcaggctgagctggtgcgctggctgtgggcgatgctcggcgcggcgggcatcttcatcccggagtttctgaccaagatcggcgtcctcaacacacccttctggtacaccgccggcgagcagcagtacttcaccgacaccaccaccctcttcatcatcgagctcatcctcatcggctgggccgagggccgccgctgggctgacatcatcaagcccggaagcgtcaacaccgaccccatcttccccagcaacaagctcaccggcaccgacgtcgggtaccctggtggcctctggtttgacccgctcggctggngcagcggctcgccggagaagatcaaggagctgcgcaccaaggagatcaagaacggacgcctcgccatgctcgccgtcatggg

SEQ ID NO: 72101 - DNA, 380 bp, Zea mays
  Clone ID: LIB3078-004-Q1-K1-G5
catcaactgcagcatgatcgtgctcctacgcctgctacaaggttgcacggaggagtagagggacatctggatgggggcggtgcatgtgcacgacgccgccatggcgcatatcctggtgttcgagagcccggcagcgtccgggaggcacatctgcgcccagtccatctcccactggagcgacttcgcggccaaggtcgccgagctgtaccctgagtacaaggtgcccaagttccccaaggatacccagcctgggctggtgcgacagggagccgaggaggggtccaagaagctcgtcgcgttggggctgcacttcagccctctggagaagatcatcagggacgctgtggaggccctcaagagcagaggctacatttcgtagc

SEQ ID NO: 72102 - DNA, 426 bp, Zea mays
  Clone ID: LIB3078-004-Q1-K1-G6
ggaacgtgcaggcggagctggtgcactgccggtgggcgatgctcggcgcggcgggcgtcttcatcccggagtttctgaccaagatcggcgtcctcaacacacccttctggtacaccgccggcgagcagcagtacttcaccgacaccaccaccctcttcatcatcgagctcatcctcatcggctgggccgagggccgccgctgggctgacatcatcaagcccggaagcgtcaacaccgaccccatcttccccagcaacaagctcaccggcaccgacgtcgggtaccctggtggcctctggtttgacccgctcggctggggcagcggctcgccggagaagatcaaggagctgcgcaccaaggagatcaagaacggacgcctcgccatgctcgccgtcatgggcgcctggttccaggccgagtacaccg

SEQ ID NO: 72103 - DNA, 443 bp, Zea mays
  unsure at all n locations
  Clone ID: LIB3078-004-Q1-K1-G8
cccacgcgtccgctcgctatgcacattcaccactgcccatgctaggctcgctgcggtgccgcgtcatgccgcgcccgcgcaccgccaccagtgtctcatcacacatcaccgagctccgtcgagcgctggagaatggacatcagccacccccatccgaaggcttgcagcgcccgaagctacgccagagcaccacggacatcgacgcctctgactgcgatccattttcgagcttcaaggaatcgacagtcaagcttcggcaaccaagtgatcgaatttttcgagttctacaaagttgaagaccctgagcatctgtttggttgcctttggtgcaatctatgctgaggtaaagaagaagacgtcgaggtggatctccaggagttccaggacgttgatgagttcgaggattaggctagcgacctnccccagtcagctgcctgtggtgg

SEQ ID NO: 72104 - DNA, 364 bp, Zea mays
  unsure at all n locations
  Clone ID: LIB3078-004-Q1-K1-H1
gtcaaataataccttgctctgatgcatgtgcctaagctgcacaaccgtaccctgcgagtacgtcatctgagtccgcactggaggtggccgatggctctgtgactgtcgccgaggcggaggaaccgaccccttcgagcaagcccaatgttaagttccgctaaataacttcgatactgaatacgcagtttattgcagactctcagaaggtgaagactgttccgcatctgatgactgacgatatcattgatcttatgatgcttccgaccatcaaaaggagatcgtcgctctttaatggcataatcatcacagtgcacanagctggtgttcacacgacaatctgtagcagaacgatcattgctggtgt

SEQ ID NO: 72105 - DNA, 440 bp, Zea mays
  Clone ID: LIB3078-004-Q1-K1-H10
gctgcatggagtggcaacaatgtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataataatgggtcaactgacaactctgggtcggtggatttgtagttggtttgggttttttagttgtagaacggtgttgccctcctagagagggatgaacacattatgcatgcgatgtgtcagttcggtcggtgctatgctcgttgggatttgattgtcggaaataaaacatgggtgatgaatgtgtaccctccctaa

SEQ ID NO: 72106 - DNA, 363 bp, Zea mays
  Clone ID: LIB3078-004-Q1-K1-H11
gactggagcaaggcttctgtgcaggagatgaaggataggttcgtcgctgttgggttgggtcctcgccagcttgctgttatgtcagcgttccttggacctgaccaggctggtacggagggacgactgatagctgatccggattgccgtccatgggtggagaagtaccaacggagccccgagaccgtcttccggactgactatgaaggtgacctgataaccacactcacaaagctgagcttccttggccagaagataaactacgaagcctacacataccctaagcagaagattgacctgggaaaactggaactgtgagagttgattgccgggcacctgcattggccgtattcagtaatcgggagc

SEQ ID NO: 72107 - DNA, 334 bp, Zea mays
  Clone ID: LIB3078-004-Q1-K1-H12
gtgcgagcgacccacgtccacacgacactaaccaccaccaccaaccagtcaccgggccgcgcacccagcgcgaaagcgatggcgtcgctcaccatgatggcgtccttcgccgccgtggcggtggccgcgccctcgcgccgcggcaccttcgccgtggtcaagtccgccaaagtcgaccgcttgcaagagcccgccacgctagcagcaaccgaggccaggcccgccgtcgacggacgccgcgccgtcatgctcgcggctgctgcggctgccgtggcagccatcggcggcgcccgcgccgccatggcgggccccaagaacgggacccccgaggcga

SEQ ID NO: 72108 - DNA, 387 bp, Zea mays
  Clone ID: LIB3078-004-Q1-K1-H2
cgatcgggtacctgctagcgaattcgatcggtctggtacctgctgctagcgatatatggcagcatcatcagccagcagatcgtcgccggcacgatggccagctcgtcgtcgtcgtcgtcagctctggtcgtcctcgtggtggttctagccgcggcggtggcgtgctccgcgacgcgccccgttcccgcgcggcagcgggcggcggcggcggaggaggaggacgtgaggcggccggacacgctgcacgagggcacggtgctgatcccggggatggggcgctacgagatcggcagtcactacatcccggacatcggcgggctggaccacagcgtgcccgccgtcacccactggcagttcatccccggagccgacgacacctgggtgccc

SEQ ID NO: 72109 - DNA, 208 bp, Zea mays
  Clone ID: LIB3078-004-Q1-K1-H3
cccacgcgtccggaagtgaggctgctgcctagctgctacgttagctgctagcgtcacgagcagcaatcttgtaatggctgaatctccacaatcatcatgtaatttattgcatgcttcattcaccgtggactcaataatctctcttgctctaaaatcgatgtattcgtttttcttgtgattttgtacatgcacataaatttctctctgg

SEQ ID NO: 72110 - DNA, 419 bp, Zea mays
  unsure at all n locations
  Clone ID: LIB3078-004-Q1-K1-H4
cccacgcgtncgcttcgcgtgggcgccgcctctacagcccgcacctcgtttcctcggccgggttcgatatgacgaagcgaaccgagaaagccggaattgttggcacatatggaaccaggtatggtgctaacttgcgtaaaccaaatcagaaaaatggaggtttctaacacctccaagtttttttgggaagtctgtgggaaagtttccttgaagaagaaaacggttgggatttggggatgcaaggactgttggaaagtcaaggcccgttgtgcttacaccatgaacacttgtaatgcggtcactgtcaagagcaccatccgtcgcttgaaggatcctactgtagcatgatcggtcgcttgtcaagcatactggggtccactatatttgctgtgtatcccatacattctccaacatttttg

SEQ ID NO: 72111 - DNA, 343 bp, Zea mays
  Clone ID: LIB3078-004-Q1-K1-H5
gcgacccgttcatcggcagcctggagacgcccgtcacctccagcccgctcatcgcgtggtacctctccaacctgccgggctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgtcggcctcgtcgccatcctcagcgtctgcctcaccatgtacggcgtcgccttcttcaacgagggcgacccgtccacggcgcccacgctcacgctcaccggccggaagaaggaggccgacaagct

SEQ ID NO: 72112 - DNA, 391 bp, Zea mays
  Clone ID: LIB3078-004-Q1-K1-H7
gcgagagacagactcgtatacccaggcttctgttgacgaggaggacaataatactagggatatggcttcctgcgcgtacgcctcatggtccaagctagtggatccgtccctaggtgtacccgatgttcgtgccgatggacgtggccctgagtatctgctagtaccagcttgagcgcaacatcacaacctacctcaaagtccggttgaccaaacaaatgatggcagtcgtcgtacatgacatccacaactagggcgacacttactccatgcacggactcaggaacttcgtcatctggcacgaagccctgagatcatgtattgcatcaactgcttcttctgagactctcttaaggacgattaatctagagtccgtcatggatggatgcatatg

SEQ ID NO: 72113 - DNA, 226 bp, Zea mays
  Clone ID: LIB3078-004-Q1-K1-H8
ggaggctctggaagaagaagagtttctccaccagcagtaccaatacgatgatgacgaggatgatcttgacgaggaatcttattacatgaacaagtccccaagcattcgtattggtaacaggagatggggtgacaatgggtacatcatgggaggcaggtaagaggcgaagccagtgaatactgatgtcgctgctggtccatccaggactacgaagaagaaagagaaa

SEQ ID NO: 72114 - DNA, 420 bp, Zea mays
  unsure at all n locations
  Clone ID: LIB3078-004-Q1-K1-G11
gggcgtgccaggtggtgctcatgggcgccgtcgaggggtaccgcatcgccggtggccggctcggggaggtggtcgacccgctgtaccccggcggcagcttcgacccgctcgggctcgccgacgacccggaggcgttcgcggagctcaaggtcaaggagatcaagaacggccgcctcgccatgttctccatgttcggcttcttcgtgcaggccatcgtcaccggcaagggtcccgttgagaacctcgccgaccacctcgctgaccctgtcaacaacaacgcctgggcctacgctaccaacttcgtccccggcaagtgagcgagggcatatacatacttgtatgcgtgtaccgtagacatacgtattcgtatatgtactgcangagatgtaccagtatttgtgaagaagggagcatgggctc

SEQ ID NO: 72115 - DNA, 400 bp, Zea mays
  Clone ID: LIB3078-004-Q1-K1-E6
gagactttgacccagatgagatattcagacacttattctttggcggcatggcgcctgcaaccaccatactgtttggacagtttggaactttgcattttaggaccgctgggatgcatgcccatgctcatgcccaacaaaactctggtggatcaactgtcaggatgcttattcagctcgtgcctgtgactactgctgctgatgctcaactgactgccatactgtgagcctgtatactcgctgaaccgttcatacccttatgagcataagttgcaaaccccacgtggagttgcatactatgtcaagatgtctaatttacaggaacagtattcacaccaatgcactgaacgagctactctggagcagcatgttgatagggatcattactccataatcacacata

SEQ ID NO: 72116 - DNA, 411 bp, Zea mays
  Clone ID: LIB3078-004-Q1-K1-E7
tgctgctcatcggctccgctcagaacttcctcggctacggctggctctggctcatcggcaccaggcaggcgccggcgctgcccctctggatgatgtgtgttcttatctatgttgggaccaactgcgagacattcttcaacacatccgcacttgttacatgcatacagaacttacccaagagctgaggtcatacagtgggtattatgaaaggatttgcgggccttagcagtgcaatcttgacgcagctgtatgcagtaatgcacacaccagaccatgcaacacttgtcttcatggttgcagttggtccatcgttggttgctcttggcctgatgtttattattaggcctgttggaggtcaccgtcagtccaagatttcatgcatctgagcgacaatgtgaggctctccttttt

SEQ ID NO: 72117 - DNA, 405 bp, Zea mays
  Clone ID: LIB3078-004-Q1-K1-E8
cccactcgtccgcccacgcgtccgcctacgcgttcgcggactcgtggtctgacgcgggggccttcacgaggaggagcacgtccatgagcaactcgtctagaagctgctcaactacgccgagcgcgacaaggagcatgacttctggctcgacgtggagcccaagttcctagacaggttccccaacatcaccaagcgcctcaagctcccctccgtcgcgcttgtctccaccgacggcaactggatcacattcatgaagttaaggctagacagggtcttacaagaccagttcgacgcataatcagttgaagaggcattggcttctaaccctgttgagttgaaatttgagaagcctgagaaatggacagctccgtaccctaaatatgggtttggatggtgggaaccctt

SEQ ID NO: 72118 - DNA, 380 bp, Zea mays
  Clone ID: LIB3078-004-Q1-K1-E9
ggagatgttcattgggttgattggaatccccttgatgttaactatatcttaactgggggggccgataactctgtccgaatgtgggatcgtcggaatctgggttcaggacgagctggttctccaattcacaaatttgaaggccataaagctgctgttctttgtgttcagtggtcacctgacagagcatctgtttttggaagttctgcagaagatggtttcttaaacgtgtgggatcatgagaaggtggggaagaagaaaaattctaatgtcccagccgggcttttctttcagcacgctggtcatagggataagattgtagacttccactggaattcgtcagatccttggacaattgtcagtgtctctgatgatggcgagag

SEQ ID NO: 72119 - DNA, 276 bp, Zea mays
  Clone ID: LIB3078-004-Q1-K1-F1
tttacacctgcctaaacgccaacatcttttattatgcatcatgtttactatctaatcgatgcggtaacaaacccagagacatgtttacgtcctgatatagcattcatcccattttctcattactttgacatctacacagtcacaactacagctatctgtgttccagatattgtacatattcatgtcatccatcttcactgtccacttaatagattaatactgaagctactatgcaaaatcttcattaatttctagccacactgactctaactatca

SEQ ID NO: 72120 - DNA, 369 bp, Zea mays
  Clone ID: LIB3078-004-Q1-K1-F10
cgccagacgcgctgagccgctgagtgttacccttgagaactgcactttttttggctgcgtcgttgactgactaagctcatgctccaggcacaagctacacagctgacgaagaagcaattgagcggttcatcgcgaaagagttaaaaaaaaaacggtagtgtaaattagtaccattgctgcaactttgtcagcgccgccgtggatgctggtgtgagaaattctaggacgaactgagaactggtattgtagtggtaatacatgttgttttagcttcttataataccctccatacagtaatagggctccttcaacacacgtttctaatgtctcgaatttttggttgtgaaagggattctaaatgagttggtc

SEQ ID NO: 72121 - DNA, 314 bp, Zea mays
  Clone ID: LIB3078-004-Q1-K1-F12
gcttgagaacgtaagatttgacttcgcagatgggtcacaagacctcagtgaactacaggggggtgcctgtgtcaccactgactatgttgagtatgcatttaatgccagtggcgacaaatcaagagaggcagcagagtcctgccctcttccctaaattaaaacaggcagtgctggtccctgagaccgtctgtgcaggagacaacaccttcaaacagaaaggcgatgacgtagacagcacacccttctccttgttccagttcaacctgccgattggcccttccaccctggcaacattcaaagagcgaaatggggaa

SEQ ID NO: 72122 - DNA, 432 bp, Zea mays
  Clone ID: LIB3078-004-Q1-K1-F2
ccagacccgagtcgtcaagaccccaggcgggaagcttgtgtaccagtacaccaagaagagggggagcgggcccaagtgccccgtcaccgggaagaaaatccaggggatccctcacttgaggcctgctgagtacaaaaggtccaggttgcctaggagccgcaggactgtgaaccgtccttatggtggagtactctctggaattgctgttagggagagaatcattcgtgccttcttggtcgaggagcagaagattgtcaagaaggtcctgaaaatacaaaaaaccaaggacaagacagccgcaaagtaaatctccaggaatggggaagcctagccctgttttgtacactgcgaaaagtaattttggtggatggaaaatctacgtgccttgttgagcatttagcatgtgtgagtttagagagtctgggacactga

SEQ ID NO: 72123 - DNA, 376 bp, Zea mays
  Clone ID: LIB3078-004-Q1-K1-F3
cccacgcgtccgcccacgcgtccgctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgatt

SEQ ID NO: 72124 - DNA, 353 bp, Zea mays
  Clone ID: LIB3078-004-Q1-K1-F4
gtctcattctctgcctcaaggctgcaatgcaagaacctgtcatccctacagagccctgggagcgtgactgctacttgcgcttctttcgccgagaagaggtcggctcctgtccatgccacggctgaggggtctgaggctggtgcggcggagcagccagaagaaccgaaacctgcgaccaagatcgaggaaatgccgctcgagtcgaagcagaagatgatcatggagcagagggcgcggatgaagcttgccaagaaactgagacagcggcgcaagcggctcgtccgcaagaggaagcttaggaagaagggcaagtggccaccgtccaagatgaagaagctcaagaatgtatgaac

SEQ ID NO: 72125 - DNA, 347 bp, Zea mays
  Clone ID: LIB3078-004-Q1-K1-F6
gtggcgtcagcacgccccgcgggcaggagggtgaggctgctgagcgtgaggtgcgagcagggagccaagggcggtggcgggctggacgtgtggctgagccgcggggcgatgctgggcttcgtcggagcggtggccgtggagctgaccaccgggaaaggcgtgcttcagaatgtgggattgaccgcgccggtgccgacgctggcgctggcgctcaccggcgcggtcggcgtcctcacggccttcctcatcttccagtccgggacgcgggactgatgggtgaattgtcaaagctcccaaaaggacatgcataaagtctgtcagagtcttgtgctgtgtatgtctatgct

SEQ ID NO: 72126 - DNA, 399 bp, Zea mays
  Clone ID: LIB3078-004-Q1-K1-F7
cctccctctccgaaatcaaggtagcatacaccgctgcagtttctagagccctctctggcactcgtgatcccactagtcacgatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctaaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgcc

SEQ ID NO: 72127 - DNA, 422 bp, Zea mays
  unsure at all n locations
  Clone ID: LIB3078-004-Q1-K1-F8
cccacgcgtccgcggatgggcgcaggtgctgtactacgcggtcctgacgctgcgttggagcgggcacaaggccgtctacgccgccgtcgagaggccgctgcagttcgcgcagacagccgccatcatggagatcgttcatgggctcgtagggttggtgaggtctccggtctctgcaactcttccacagattggatccaggttgttccttacgtggggtgtcttgtggagttttcctgagacccagtcacaccttcttgttactaccctggtcataagctggtctatcactgagatcatcagatactctntctttggaacgaaggaggcatttggctttgcgccttcctggttattatggcttangtacagcaccttttatgttgtgtatnctactggcatctctagtgaagttggtctgatct

SEQ ID NO: 72128 - DNA, 427 bp, Zea mays
  unsure at all n locations
  Clone ID: LIB3078-004-Q1-K1-F9
tgcagatccaccacgaggcgcgccaccccaagctccccttcgagccggagaagctgcggacctgcactcctccgcccgcgctgctgccgccgccgccgccgctgccgccgccgctgccgaggccaccacctccaagcccaagcccggcgtccgcggcagcctcaagaagtaagcttgctgggcttggttggctcgcccgcctgcatggggcgcaattcccttcggtttcaatcccatccgccgacccgatctataatcaatcaaaccgncgccctccggcctggcggctgccgcagtcggcctgcggtgtactgttagtctgctgctgatttccgttgttatactgctggtacatgtgtcgtgtgatagatgtgtcaactatatatcaatctcgtcgccggcagctctggcatgtttgagtatgtgt

SEQ ID NO: 72129 - DNA, 159 bp, Zea mays
  Clone ID: LIB3078-004-Q1-K1-G1
tttacgcttcttctcactcgacctctttcgttttaacaccttcaaattttcctctcgcgtagatgattatcaggatgggtgaactctatccgttcagcctcgacaatcagcactacatattatatcctactgcacatactgtctccagcaacattgatg

SEQ ID NO: 72130 - DNA, 420 bp, Zea mays
  Clone ID: LIB3078-004-Q1-K1-E5
caccgtcaaaggcaccaggctgagcaacccctctctctctccctcttatccccaaggcgaggagcggagcggagaggagggcccttctgcttgtttctccgctttgcaagatgtcgtccccgagcaagcgccgcgagatggaccttatgaagctgatgatgagcgactacaaggtggagatggtgaacgacgggatgcaggaattcttcgtcgaattcaagggcccggccgaaagtatctaccaaggtggtgtctggaaggttcgggtagaactgcctgatgcatacccttacaaatccccgtccatcggcttcatcaacaagatttatcacccgaatgtcgatgagatgtctggctctgtctgtttggatgtcataaaccagacatggagcccaatgtttgatctagtaaatgtttttg

SEQ ID NO: 72131 - DNA, 327 bp, Zea mays
  Clone ID: LIB3078-004-Q1-K1-G10
ctcgttgcccaccgtcggcatggtcgtcccctacggcgccttcttcgtccctgccggggccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgccgagaacaagttcatctgcccatgccacggatcccagtacaacaacca

SEQ ID NO: 72132 - DNA, 423 bp, Zea mays
  Clone ID: LIB3078-004-Q1-K1-C9
ccaacacgccgcccgccatcgtcgcgcctctcagcacgatatgtgacccgtacctggggatcttccggggcatcatcccgccgctcgggggaacgctggacctgtcgccgatcctcgccttcctcgtcctcaacgccttcaccagcacggccgcggcgcttccggcggagctgccaagctgctcggcaacggcgcagcatcaccagaggactgctgtctcaccctgctcggcgccgcatgaggcgacgctcagccagaggaaatggatgcggagaatgcggtcacagaagccacagggagacgatggtgatcactaggactcgtgagcccgtggatgtgttcctcaaatcgtcagtgccttgttgttaccaggctggggaccatgcttcgcatcagacgctcgaggtctgcacggcactgtgt

SEQ ID NO: 72133 - DNA, 398 bp, Zea mays
  unsure at all n locations
  Clone ID: LIB3078-004-Q1-K1-D10
tcgcgactcgctaccggaaggggcaggaacgggaattccgttgccatcgtcgattggggaggatggggagcagcttgcacccaagcagaagatcagaatcaagctgcggtcctactgggtgccgttgatagaggactcgtgcaagaagataatcgaagctgccaaaacaaccaacgcatagaccatgggtcccgttcctctgcccactaagaggagagtctattgtgtgcttaactctcctcacgtgcacaaggactcacggttccatttcgagatccggacgcatcagcggctgattgatatcatgtatccaactgcccaaacaattgattcgttgatgcaactncagctccctgccggtgtggatgttgaggttaagctatgattctgttggagct

SEQ ID NO: 72134 - DNA, 408 bp, Zea mays
  Clone ID: LIB3078-004-Q1-K1-D11
cccacgcgtccgcccacgcgtccgccccccgcagccgtccccagtccactgacatcgggggcgctgcctcctggggagtcttcgccggcaccgccggcctttacctcgtccagccatttgactggattaagaagactttcttccagaaacctgaaccagaggcatgagtctccaggcagaaaaatgctgcaaatctgcaactttggtacaccacttttgtccgggatgattcctgatgataactcagcaaataatatgagaccccctcgtctttccttggttgattttattcagatgtaggcattcctcttgcatgtaatattcacgaggggagtgtgatcatttgacttgtttttcatcacacagagaaactgcttggttcaaccgtgttatatggtcttgatggcg

SEQ ID NO: 72135 - DNA, 353 bp, Zea mays
  Clone ID: LIB3078-004-Q1-K1-D12
agatgagaggcgtaaaacatgggatagctggtcaacgaaacggaaactgatgcacatgtgtagctcggaggtttccatcactactaccattcttttatcgccaaacctttctttctggaaagcaaggacatccagagagttggttgtcgctgtcattggggaagaaggacaaaactttactggaaagtcctgcgttcaatgcattctgggaaaggaatgttgcagagtctgtgcgccagggagatgcaaggccatttgtggaggaagctgtgctgcaagtatctgactggggtttcagcctatctgacatccaaatgcagaagaaagaggctcgaggcttttttgaactcatc

SEQ ID NO: 72136 - DNA, 390 bp, Zea mays
  Clone ID: LIB3078-004-Q1-K1-D2
ctgacgcgtggagctgacgacggtacatcggctcagaggtgcgacgtacgacgacgaggacgggggcgccacacatggcatcggagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgacaccaacctgatcatggtgacgacgacgacgctgatgctgttcgcggggcggttcgggctggcgccgtcggcgaaccgcaaggcgacggcggtgctgaagctggaggcgcgcgactccggcctgcagacgggtgaccccgtcgggttcaccctcgccgacacgc

SEQ ID NO: 72137 - DNA, 397 bp, Zea mays
  unsure at all n locations
  Clone ID: LIB3078-004-Q1-K1-D3
ggccccgcagctggaccccagcacgccgtccccgatcttcggcggcagcacgggcgggctggtccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagtaccttcaccccaaggacggcgtctacccggagaaggtcaaccccggcagggagggcgtctgccagaacttncgcagcatcggcaagaacgtcaaccccatcgacgtcaaagtc

SEQ ID NO: 72138 - DNA, 335 bp, Zea mays
  Clone ID: LIB3078-004-Q1-K1-D4
tcagggaagttcgacctgcgatgtgaaatctctggcaagggaatccgacgtgctgaggtgagaagttcagcacgacgacggcaccaaccaggttacggagtccgccgatggcgccaaccaagcggactcattgctgcaggcaggcgtagctgctggatctgaatctcctggggttccagatgacgccgcttcttcgcttgagtaaccaccgcgaaaataaatgaatgacgccgtaatcagacgcgaaaacaaacgacctcattaccacaacactgttctgatatttttgggtcctgagagagccacttgagttcacaataaatgtagtacccatc

SEQ ID NO: 72139 - DNA, 367 bp, Zea mays
  Clone ID: LIB3078-004-Q1-K1-D6
caaatagctgaacaagagccagcaaattctgtctggtctagcagttaccatgtgtgaggcagtaacttgtaccaggatgattgctggagttgctggggactattggattaagtggcacagcctgatctattgagcttggcccgtacctgcagcactctgctaaatttcttttgagcatggaggtctttgaagcatgacaatggctgctcttaggtttgggattgccaccatcttctgggacaaagagggagtggcggatgattgatctgtcggcagtctgatggggatgaattatacgagggcttcaacgctgacacaaagggttaatgaaacaaactcgaatccagtgattataggcgcttcggac

SEQ ID NO: 72140 - DNA, 429 bp, Zea mays
  Clone ID: LIB3078-004-Q1-K1-D9
ctacactacaccacaccacacacacccgacgacgatcacacacacgtagaagatcgagggcgttcgatcgtgaccgtgacgcatgaagctataagctagccaagacaggaataataatggcggcgtcgacggtggcgagcctctctgtcccggtgacgacggcgaccttcgcggcggcggcggcggcgggcggcgccgacgtgctgatcgtcgtcccgaggagggcgggcgccgggcgcgtcgtctggttccccgcggcggcgcgccgcggcggcgggcggttggtcgccgtgcggtccagcgggccggccacgccgtcggagatctccgacaaggtgtcggagagcatcaagcatgcggaggagacgtgcgcggacgaccagaagggcgacgccgagtgcgcggcggcgttggacgaggtggaagaac

SEQ ID NO: 72141 - DNA, 381 bp, Zea mays
  Clone ID: LIB3078-004-Q1-K1-E1
gttcctgtaacctaacccgacggcttgtcccacacctcactactaggcacttggaaagcacggttcggcgtcctcgattcctgaacttccaagatcgcctgctgcaagagtgtcttctccaccaatgtgccgatattttcttttgagatgcttgggttactttgatatctttctggtgatggatcgtgagttgttggcttgttgcattatgaattgcgtactgtaagtatccagtttgctgcttagcacttatacaattcgaaagcaaagctcgaagtcctggctgcctggctcttccttggagatggaagtttttgcacttccagaaatatcgggaacataaagtccatgtgatcttttgtgcctttaaaattgtggatc

SEQ ID NO: 72142 - DNA, 161 bp, Zea mays
  Clone ID: LIB3078-004-Q1-K1-E10
gttctagatcgcgagcggcgccctttttttttctgtgtttttaacgacgattcgacgtacaattgtgttgccatccgagtttgtgtgtttggataaacatatccatataactcttatcaaaaatggcaggcacagagagcgagagccacaaagggaaaaac

SEQ ID NO: 72143 - DNA, 217 bp, Zea mays
  Clone ID: LIB3078-004-Q1-K1-E11
caggcatgcccataagcactagatggtcacccgagattaagcaggaaatcaaacagagccgggtcaatgttacatcaaaggtggtgaagtacattaaccatgctggaaacgctgatactcgaccctcagtgtttgtgagcgcaacagccattggctattatggtaccagcgaaatccatagctttgatgaatcaagtccctcgggcaatgactacct

SEQ ID NO: 72144 - DNA, 403 bp, Zea mays
  Clone ID: LIB3078-004-Q1-K1-E12
cggacgcgtgggcgaaccctgacgcagaagcgctcaggaagaacagccatggctactgtgcgcagccagcttgcgtcgagccgtcctgcgtcgtccaaccgtcatgcgcagccccgaccacctgctttggcccgcgcctgttctcctccaagtccaagaaagaacggaagccaagacctgaagctgccaccccggtcaacccttggcctgagctcatagcagagcccagcgacgcacggtcgatgtcgttcgttgggacgcacgagtacctggcccccgagatcatcaaaggcgagggccatggcagcgccgtcgactggtggaccttcggggtattcttgtacgagctgctgttcgggaagacgcctttcaagggatccagcaaccgggccacgctgttcaa

SEQ ID NO: 72145 - DNA, 387 bp, Zea mays
  Clone ID: LIB3078-004-Q1-K1-E2
cggccgtgctgggcatcttcgcggggcacgcgtgcagcggcatcccgcggttcgagggcggggcggacccgagcgccatcgggcccttctacttcgggtcgctgctgggcacgcagctgctgctgatggggtgggtggagtcgaagcggtgggtggacttcttcaacccggactcccaggccgtggagtgggccacgccgtggtcgcgcaccgccgagaacttcgccaacttcaccggcgagcagggctacccgggcggcaagttcttcgacccgctcggcctcgccggcaccgtcaaggacggcgtgtacatccccgacgtcgacaagctcgagcggcttaagctggcagaggatcaacacgctcgcatcggcatgcttggcatgc

SEQ ID NO: 72146 - DNA, 410 bp, Zea mays
  Clone ID: LIB3078-004-Q1-K1-E3
gtcaccttccgcgtgcagcacggctccaaccccatgtacctggccgtgctcatcgaggacgcgaacatggacggcgacgtggtgcatgccgacatcatgcagaacaactccgggtactgggagcccttgcacgagtcctggggcgccgtctggcggatcgaccccagccgcccgctctgcggccccttctcggtgcgcatcaccaacgagtccggcaagcagctggtggcccagaacgtcatcccggccaactacatcgccgacgtcgactaccgctccttcgtccagtatacgaattaacccgaccggccgggcggtgcgcccactgcatgagctagctcgatcggtcacctctgcgaccgtcgtacgtccgagatagctcgttgcttaagtgttcgtgtttagtggct

SEQ ID NO: 72147 - DNA, 452 bp, Zea mays
  Clone ID: LIB3078-004-Q1-K1-E4
gtcggtgtggttcaaggccggcgcgcatatcttctcggacggcgggctggactacctggggagaccccaacctggtgcacgcgcagagcatcctggccatctgggcgtgccatgtggcgctcatgggcttcgtcgagggctaccgcgtcggcggcggcccgctcggggaagggctcgacaaggtgtaccccggcggcgccttcgacccgctgggcctcgccgacgacccggacaccgccgtcgagctcaaggtgaaggagctcaagaacggtcgacttgccatgttctccatgttcggcttcttcgtgcatgccatcgtcaccggcaagggccccatcgagaacctcttcgaccacgtcgccgaccccgtcgccaacaacgcctgggcatacgccacgaacttcgtacgcgggactaactgactgagcaacgccgtacatgtgtactaccat

SEQ ID NO: 72148 - DNA, 271 bp, Zea mays
  Clone ID: LIB3078-004-Q1-K1-C8
tcggttgaagaccaagtttttgggaaattcagtggaaatttacccagttggaaggactcgagtgacactaaaaaaaatctggtgtcgtgttggatttggtgccaccactaacaaaggttaacaacctgatatttgggcgcacttgggttgattctcctggagagatggtcatgacgaacctgacaactggagacaaagttgtgctatatttccagccatgcggctggtttggggctggccgttacgaggtggatgggtatgtgtacagtgc

SEQ ID NO: 72149 - DNA, 393 bp, Zea mays
  Clone ID: LIB3078-004-Q1-K1-B1
ctccattcgaaaggtcacagacaagcctattctgatatatcccaacagtggtgaaagagatggtggtgtaaaaaaaggagtgggtggaatccactggtgtgtcagatggtgattttgtttcgtacgtaaatgaatggtgcaaatatggggctgcgcttatcgggggctgctgcaggacaactccaaacactatcagggccatacacatatctcttaaccaaggctgccacaagcatcagttacctgtaggctgtatcatagatctgtgctccactcctgatgctctcctgccagcaataccttgagctgtatccccgagattccttaaccagcgcgagccaatatactgctgcgtgttctcctgcaaatgagatgttctgcacctatgcttgt

SEQ ID NO: 72150 - DNA, 421 bp, Zea mays
  Clone ID: LIB3078-004-Q1-K1-B10
cccacgcgtccgagctgagggcgttctgggacgaggtgcgcaacgtggggcacggcgacaagaaggacgagccgtggtggcccgtgctggacacccgcgacagcctggtggagacgctgaccaccatcatgtgggtcacctccggccaccactcggccgtcaacttcggccagtaccacttcgccggctacttccccaaccggccgaccaccatccggaagaacatgccggtggaggagggcgggccgggcggggagatggagaagttcctcaagcagccggagacgacgctgctggacatgctgcccacgcagatgcaggccatcaaggtcatgacgacgctggacatcctctcgtcgcactcgcccgacgaggagtacatgggggagttcgcggagccatcgtggctggcggagcccat

SEQ ID NO: 72151 - DNA, 370 bp, Zea mays
  Clone ID: LIB3078-004-Q1-K1-B11
gagatgctgacgaggaaatggcgaacgctgttgaaagacgagagcttactgaactggagcttatggtcatgtggaatcgacttgatattgataggcgtgacgatgagcgggatgccatcataagccttgatctcttgtatagaagggtctagacagagattctgaagagtgaagcaactgctgccatgagattgctcaatgatcttcttaatcttcatgatggatgcgacaatgagaagcggtgtaaagaaactgataaagcgcatgcttgaagtctttacaagaaaggacccattcaatgtggtcttgtctgctgggatcaacatggagaatcgtgaagggcgaactgagctaccggctcaagatgatg

SEQ ID NO: 72152 - DNA, 366 bp, Zea mays
  Clone ID: LIB3078-004-Q1-K1-B12
gagggctacagttctttccatttctggaatgttcacatttctggttcactttgccatcccccttcaattcccaaagcaacaacctgtcgtcacactgcagagttctcagcactgtaatgccgatgggatgcctatcacgtcgcctccgataaatgactatccctggagtcctagatgggaccaggcagagatggttgaacggatctagtaagtacatggtctatctatcccttttccaatctatgctgcctgtcaatggtacagctttgagatcctgtccaattttgcagcgacttcctgaccgacgagtgccaaaatttcaagaagttctgcagcgatgctatcactcagcaaaagtagctgaca

SEQ ID NO: 72153 - DNA, 282 bp, Zea mays
  Clone ID: LIB3078-004-Q1-K1-B2
gacatggcatgggacatttttagggaattctttatccataccattaaaagatcaccggtttggatccataccatgactatatgacctacatgtggttccacatgagttaattacatgtggggtacatggtatatatctaaagtttggatcttttaatgctctagatccaatcattcgacacttttaacaatttcgttgacaatagcgtatactttgacctctactacatcgtccataccacctgacagtgctacctgtacgggtcttactcgccctcttcct

SEQ ID NO: 72154 - DNA, 295 bp, Zea mays
  Clone ID: LIB3078-004-Q1-K1-B3
taaagcgtgaggcccgtttgaacggcctgctctattatatcccatacaccaacctccgtgtggtcgtctacataaatggcatggacatcaagcatctcaacaccaactacatctcccaaatgaagctatacatacacagcccatacgcccattacatccacaagccctgcgcaaccatcactatgcacaactacggggacaataacgtatactttgacctcgactacatcaaccacaccacctcacagtgctacctctacagatctgactcgccctcttactacaaccctctaca

SEQ ID NO: 72155 - DNA, 383 bp, Zea mays
  Clone ID: LIB3078-004-Q1-K1-B5
cggacgcgtgggtttggtttcctctgcttctcattctcccgtgcacttccagttcctgcccagctgcagggctgctccaatggccaccttgtccgccatctctgccaacgtcggctactgcaaggcaccaaccctgagctggaagggaagcggagtaccaggccggattgtggtctccatgtccaccacccgaagaggcctcgtctccctaagacgacgatcccctcggtttcgcgtctacgcggcgaaggcggagacggtgagcaaggtgatggacatcgtgaagcagcagctggcgctggccgcggacgtggggctgacggcggagaccaagttcacggacctcggcgccgactcgctggacacggtggagatcgtcatga

SEQ ID NO: 72156 - DNA, 150 bp, Zea mays
  Clone ID: LIB3078-004-Q1-K1-B6
gagacgcataggagtaaatatctatggttcttacactaccatacattactgaggtagggctaattgccatcctgagtcgacttcctatttctcagcgctatgatcacacgtcatgccatcacaatcctctatctattagctagaatgcta

SEQ ID NO: 72157 - DNA, 149 bp, Zea mays
  Clone ID: LIB3078-004-Q1-K1-B7
cagaccctcacgagtaaacatctatgtttcttacactaccataccctactaaggtatgccttattgacaacctgaatcgacttcatatttctcagcgtaatgatcacacgtatgccatcacaatcctctaactattaccatagaatgct

SEQ ID NO: 72158 - DNA, 396 bp, Zea mays
  Clone ID: LIB3078-004-Q1-K1-B8
tcgcaaccttgttgaccacctccaggagcggctcggcgtcacagctgcggccttcgcgccggccgtcgtcgtcgcagcgcctggggcgggcggcggggccgcggccgaagaggaagcccccgttgagaagacggagttcgacgtagtaattgaagaagtgcccagcagcgcgcgtatcggcactatcaaagtggtgcgcgtgctcaccagcctcgcgctcaaagaggccaaggaccttatcgagggccttcccaagaagcttaaggaggccgtcagcaaggacgaggccgaggatgccaagaagcagctcgaggaggtcggcgccaaggtgtctatcgtgtgacactaggtatactgactcctttttttttcttcttttttttttaaatttctttc

SEQ ID NO: 72159 - DNA, 381 bp, Zea mays
  Clone ID: LIB3078-004-Q1-K1-B9
acgcgccaggcgagacctactccgtcaccctcaccgtgccgggaacctacggcttgtgctgcgagccgcatcaaggagccggaatggtcggcaagatcaccgtcaactaattaagctagctatcgatcgatatccattcatgtattagctgttgcttcctgctttgtactccgccgatctgtccatctctacatgttttcgtcttcacacaacaacctctgctacgactacgtatatatgcatgctactagctgattgattttaacgcgaccaggccgaccccgaaagctagcttggaccaagttttgtacccattaattctaccgatgcatctctcagtttagactcccataatcatacaaactgctagctttcatctgc

SEQ ID NO: 72160 - DNA, 419 bp, Zea mays
  Clone ID: LIB3078-004-Q1-K1-C1
gccgaggatgccgcggagcacgggaagctggggcagtcggaggaccgagctatctaggaggggggggcgtgtggactggaggacttctgcgccatcaccattgatgggagcggagggctcagcgaggacatcctgcagcagcgcctgcagagcgttgtgcggcaaagggagcagctgcagcaggtcgagatggagctgcgtgcgcaggccattgcacacccgcagatcattcaggcgcaacaaagcttccaggctacttccaaggaacatgccgcagctgtggccaagatcaaggttgctccttttgcttcgagctcagcgtttctctactactagcttaaataagagtgtgcttcacttaccagttggagacgagttggctagtagtactgctcgttttcccatgattttggactttt

SEQ ID NO: 72161 - DNA, 391 bp, Zea mays
  unsure at all n locations
  Clone ID: LIB3078-004-Q1-K1-C10
gcgcacgttcgaggtggcgcagaaggtgtgggccgaaaccttctacgccatggcggagggcaacgtcatgttcgagggcgtcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcangacgcgctgctgctgcgcgcc

SEQ ID NO: 72162 - DNA, 305 bp, Zea mays
  Clone ID: LIB3078-004-Q1-K1-C11
caacctccctcgagcccgagcaaacaagggcggacgcggagccggcggcggagcggagatggcggagaagaagcgaggcgccggcactcgcaaggatgaggtggtgacacgcgagtacactatcaaccttcacaaacgccttcacggatgcacctttaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgttagaa

SEQ ID NO: 72163 - DNA, 388 bp, Zea mays
  unsure at all n locations
  Clone ID: LIB3078-004-Q1-K1-C12
ctcctcgcacctcgcccattcgcttcaccaagggtttaagaccggcggcgatggcggggaagctggcgcagctgcgcacacaggtaacgcgtgcggcggagttcgcctcgaagcacggctgctcctactacaaggaggtaatggagaagaacaagcagtacgtcgttcagccccccaccgtcgagaagtgccaggagctctccaagcagctcttttacacccgcctcgcaagcctaccaggtcgctatgagtcattctggaaggagcttgattgtgtcaagcaggtatggaagaacaggaaagacctcacggtcgaggaccttggcattgcgagtttatttggagttgagctctatgcatgggtctgcgtangcgagattgtcggcag

SEQ ID NO: 72164 - DNA, 391 bp, Zea mays
  Clone ID: LIB3078-004-Q1-K1-C3
ataccagatatttttgggtaggaccagtagaacaggtctggcctgatcaaaagataggattcgaacttaaggctgtatggatggatgctgctggattctacacatattccatatttgcacttatgttttgggaaacaaggcgttcagactttggagtgtcaatgtcacatcatgttgctactgtcgtcctgattgttctatcttacgtgttcagatttgctagagttggctctatagtattggcaattcatgatgcatgtgatgttttcctggaagtatggaagatgtccaagtacagtcattgtgattggcttgccaatgtttcgtttctgtgttctgttatttcatgggttcttcttcggcttacttattttccattctggattctgag

SEQ ID NO: 72165 - DNA, 407 bp, Zea mays
  Clone ID: LIB3078-004-Q1-K1-C4
cccacgcgtccgctacctcaagaaagttgggtacaaccctgataagattgccttcgtgcccatttctggttttgagggcgacaacatgattgagaggtccaccaaccttgactggtacaaaggcccaaccctgcttgaggctcttgaccagatcaccgagcccaagaggccttcggacaagcccctgcgtctgcccctccaggatgtgtacaagattggtggtattggaactgtaccggttggtcgtgtggagactggtgtcatcaagcctggtatggtagtcacctttggtccaactggcctgactactgaggtgaagtctgttgagatgcaccatgaggcgcttcaggaggctcttccgggcgacaatgttggcttcaacgtgaagaacgttgctgtcaaggatc

SEQ ID NO: 72166 - DNA, 443 bp, Zea mays
  unsure at all n locations
  Clone ID: LIB3078-004-Q1-K1-C6
cccacgcgtccgcccacgcgtccggcgtggccgggatgctgatcccggaggtgctgagcaaggccgggctgatcaacgcgccgcagtggtacgacgccggcaagtcggagtacttcgcgtcgtcgtcgacgctgttcgtgatcgagttcatcctgtttcactacgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggaggctggccatgctggcgttcctggccttnctgatccagcacaacgtcacccggcagggtgcccttcgacaacctgctgcagcacctgtccgacccatggcacaacac

SEQ ID NO: 72167 - DNA, 312 bp, Zea mays
  Clone ID: LIB3078-004-Q1-K1-A9
cgactcgcacggcatgcatgcaatgtcatcaatggcctttgtggatcccacatgtgggtgaaccttatgtttcatgccaacgctctgaggttcaccttctttacacccaacgtcatattccactgaatctaactcattgaacataactgatcctgatgggtcctttacgtattccctctcctaaatgctttatctggactaccggaacacccaccttcaaagaatttcctgaacctgtgccgatgaaacaactggcaaagacaagtattgactgttcatcctaaagcttaaaaaccgttacttaattactcg

SEQ ID NO: 72168 - DNA, 298 bp, Zea mays
  Clone ID: LIB3078-003-Q1-K1-H12
cgacgcatgcgtacgacgacaaccttccacgtgcatacgacactaaccagcagcaccaaccatcatccgcgccgggcacacagcgcacactgatggcgtctgtcaccatgatggcgtccttccccgccgtggccatcgccgcgctgtcccgccgccgcaccatcggcgcggtcacgtcctccaagatctaccactgccagtagcacagcatcactccagcagccgagaccagcgccgacgaccacaaaggccacgccgtattcctcgcggctgctgacgaggtcgaggaactcatcgc

SEQ ID NO: 72169 - DNA, 431 bp, Zea mays
  Clone ID: LIB3078-003-Q1-K1-H3
acgggtcgagacatgcctgcgcgaacacacaatggcaccagaaacgatgctcctaggagtatgttccgcgctgatgctgggcggagtcacgagcgcattggaagaccatgttgcgtcagacgtcgtgggcctggcgaggtgcaccgactgcacgaggaacaacatgaaggcttacgaccttttcaagggtctttaggtggatatcaagcgcaagaacagcaactgggacttcgagacaaatgccgtgagtgagatccaaagctccggagccttcaacgtactactcggcgtcgacctccactgcgccgactgtcacgcgcagatccacagctacctctataacgcgccttgacctaagcaagtactcgtcatgaaccagcccatgctatggcgtaccttaattgtcgtgcctgtcaagatgcactaaccgt

SEQ ID NO: 72170 - DNA, 402 bp, Zea mays
  Clone ID: LIB3078-003-Q1-K1-H4
tcgctcaagttagagaagtttaaagggccaattcaatatgctgatggatcaatttcatatcgatcaagaactacggtaccaattttgggaagcttgaatttaacactgaatccaaacgaagtagttgcaattgttggtcttagtggaagtggcaagagcactataatcaatttactacttagattatacgaacctacaaatgggcaaatactaattgatggtgtcccgctcactgagcttgatatcagatggttcagggaaagaattggtttcgtcggacaggaaccacgcttattccgaatggatatcagctctaatattaaatatggttgcccaagagaagtcagtcatgaagaagtgatatgggctgcgaagcaggcctatgctcatgacttcataatg

SEQ ID NO: 72171 - DNA, 418 bp, Zea mays
  Clone ID: LIB3078-003-Q1-K1-H5
ggatgatatcattaagctcaaggattattttgatcgaaggaacgaggcaaagagtcaagtaccattgacaaaggctactgtaacaaaggtcgaggttgttggtatgggtgatcgcgtttgtgtggatctttgcagtatcatgcgacctggtgaaggccttctggttggatcctatgcgagaggaatgtttcttgtgcattctgaatgcttggagactaattacattgcaagcaggcctttcagagtcaatgcagggcctgtacatgcatatgtcaccgttcctggtggcaagacaagctacctctcagagttggggtcaggaaaggaagtcatcgtgatcaatcagagtgggctatggcgtactgcaattgtcggtcgtgtgaagatcgaatcaaggcctctgatccttgtagaagcg

SEQ ID NO: 72172 - DNA, 98 bp, Zea mays
  Clone ID: LIB3078-003-Q1-K1-H7
catactcgtacaaacatcaacacactcttctatacagagacacagatcgaaacgcaagaggtcattttcaccgtcattaccaccatcgttaccaccac

SEQ ID NO: 72173 - DNA, 374 bp, Zea mays
  Clone ID: LIB3078-003-Q1-K1-H8
tttcatatatgcttaaaacacttccgtaccacaattttggaaggttggatttaacacttgattccaaccaaataattgccaatgttggtcttattggaagaggcaagagcactataatcaatttactacttagattatacgaacctacaaatgggcaaatactaattgatggtgtcccgctcactgagcttgatatcagatggttcagggaaagaattggtttcgtcggacaggaaccacgcttattccgaatggatatcatctctaatattaaatatggttgcccaagagaagtcagtcatgaagaagtgatatgggctgcgaaacatgcctatgctcatgactttttaatggctttgcctgatggttataac

SEQ ID NO: 72174 - DNA, 167 bp, Zea mays
  Clone ID: LIB3078-003-Q1-K1-H9
gctcatgggctctttccaaacttatcgcatgtgctgtacgagggtctgtaagacgatctgccggatggtcttcaagcagtagttccttccaagtgggactggccatcaacccaaaggcaataggatacctttatgtcaactagatcaagacctgccgaatgcccata

SEQ ID NO: 72175 - DNA, 213 bp, Zea mays
  Clone ID: LIB3078-004-Q1-K1-A1
gcatactgactgatccgatagtcggttacggcttcaaaaacgacgaggtcgtttctgtcaaggtcgtatccaatatctacagggactgcagaattgactacctggataacccgaacctgatccacgcgcataccatcctgtccatctaggcgtgccatacgacactcatgaccgccatcgaagagcaccgcatcgctcgtcgcccgctctaaa

SEQ ID NO: 72176 - DNA, 329 bp, Zea mays
  Clone ID: LIB3078-004-Q1-K1-A10
cccacgcgtacggctgaattgaaagccagtgcttgatttttttttctgtgttccctgggatcatatttggtggagtggaattgtatcaacctgtcgagagcttacttcccgaatcttttttaatcttaacggacaatttgtccgtcatccttctgatgagaggaactcattaaacaggcgaaataggtcttttttgcgctgggaaaagtttacgcttgatgcataataatttgcaggacggcaacgctctatagcgcaggttatgttcaccttctgtaccgaagaatgcttaaagttacatttcacattatggtctttatgaaagaaaa

SEQ ID NO: 72177 - DNA, 407 bp, Zea mays
  Clone ID: LIB3078-004-Q1-K1-A11
cggacgcgtgcggaacattctagagcgccatgctagctatttgatgtctggcaagggggtttataaactcgtcgcttttgtcaaggggactcaatttgatcttgtggaatatctacaacgagaaaggcaagggtctgctcgtctggagaattttgcttctgcactcgaactgatcggacaaaagctccaaatggatacactgcaaagacgacttgatgcagagttccttctagctcatatgtgttcagtcaagtttaaggaatggatcgtggtgctagctactttagtgccgcgtacacagttttggtggatctctttcaacatgatttgccattgtagaaagcctatagcattactctacagtcacatgatgtattcagggaataacttgaccttcttaatatctt

SEQ ID NO: 72178 - DNA, 201 bp, Zea mays
  Clone ID: LIB3078-004-Q1-K1-A12
cccacgcgtacggctaaccttccagctattccttgaccttacattatcttacatgggggggcatcttatgtggcatgctgctccttcgagctatagataactcatttcccatgtctcatgtcacactgactgccacagtgatcctgactcatcttgaccgactcattcactattcactctgatatcggatttttctgcact

SEQ ID NO: 72179 - DNA, 357 bp, Zea mays
  Clone ID: LIB3078-004-Q1-K1-A2
gaactccatcaattcatcgagccatcatgttcaaagccggctaccacaacttcagcgggggcgctctggactaccgcaggaaccctagcctgatccacactcacagcatgcttaacatctatgcctagcacctcatgctcatctacgcattctaagtctacctcatctcctccatcaccatcgaccaggtcgctgacccactttaactcggctagaactgctaccactactgactcggctactactactaggtcttagctcgatctcaacgtcaatgtgctcaagaacaaactgctcaccatagactccatctgcggattattcatgcataccatggtcaccctaaaggatccaatc

SEQ ID NO: 72180 - DNA, 404 bp, Zea mays
  unsure at all n locations
  Clone ID: LIB3078-004-Q1-K1-A3
aacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactncgacgggaactggaggaactgancggtggggcc

SEQ ID NO: 72181 - DNA, 58 bp, Zea mays
  Clone ID: LIB3078-004-Q1-K1-A4
cccactcgtacggcttctctgacagccagtgcttgacctttcattatgtgtcccatgg

SEQ ID NO: 72182 - DNA, 395 bp, Zea mays
  Clone ID: LIB3078-004-Q1-K1-A5
cccacgcgtccggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgc

SEQ ID NO: 72183 - DNA, 314 bp, Zea mays
  Clone ID: LIB3078-004-Q1-K1-A6
cccacgcgtccgatcagttcgatgatggggagatcatttcaatcgagattgacgagggcatcctggaataggttgtccgagttctgccttgctttatatttgccctgagcttaattggcctagtttgtaccaaatcaaatactacatattttaagtaattatttcctcgcctataattatcgatgggtaggctgccacactttcatttggctagtaatgttcctactactgactgggttctttattttcctttccagctgctgagttctttactctcttcaaaatgaaactgtgtcgaaataagtttttttgag

SEQ ID NO: 72184 - DNA, 347 bp, Zea mays
  unsure at all n locations
  Clone ID: LIB3078-004-Q1-K1-A7
cccactcgtccgaccactcgtacggtggcggctacagctgacggcacaagggtgatggcatcctctactgaggcggtggaggatactgttgtcggatctagggtgttagctgaagctacctaggctgcaccagatgatgtagtaactgatgtatgtgcccatcctgtcttctgtcagaatatcttatctatctataggattgtgataccgctcgcttctgtcaccctgctagacgtccgttctaactttggattacgtgttgtgacccctgnagtttccttagaatgctcccgctatgaaacgagacgacagaagaatgagcaaggttttcggtcgcaaatatacaa

SEQ ID NO: 72185 - DNA, 412 bp, Zea mays
  unsure at all n locations
  Clone ID: LIB3078-004-Q1-K1-A8
cgctctcgccccgcttcctcgccctatcctctccgaagccggccgcgcccgcggcctgggccttcctccccttcacgctgccgctgcgcgctgtgtcggcgccggcgccagcgaggcgggtcttcgagcccgtagccgtcgcggtgtcgtccgagtacgggaccgaaggcgcggagcagcaggacggggagttctccgaggacctcaagctgttcgtcggtaacctgccgttcagcgtcgacagtgcgcagctggccgggctcttcgagcaggctggctccgtcgagatggtcgaggttgtatacgatagaatgactgggcggagtcgtggatttggattcgtgacaatgtcttcagctgaagaagccggngctgctgtcgagcaattcaacggttatacatttcaagggag

SEQ ID NO: 72186 - DNA, 424 bp, Zea mays
  Clone ID: LIB3078-008-Q1-K1-B12
gtccgagtcgtcgcatcaggtcccctcgattcgccggcggcgccaccaaccaagctcatacatctgaattgactagtcaaactcagtgatctctttggggactaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctaggccaggtcattcaactgcaaggtgatcagcgtaaaaatgtcgctacttttcta

SEQ ID NO: 72187 - DNA, 304 bp, Zea mays
  Clone ID: LIB3078-008-Q1-K1-B2
gtccaaccgcgtcgccggaggccggaaccatgaagcctgtcagtgtcgccgaacacaagagccaccagcctcgcctgcactcccccacgccggcgtcggcgaccaagatctcgatccccatctcttcgagcgaggcggcgctgttcgggaagggtaggtacaaggtgtgggccctcgcggccatcgcgctcctagcgctctggtccatgttcgccgcctccgtcacgctgcgcttgtcctccgtcgatctcgccaccacgttcggggacgcgagcgaaccgctcaatcgcgaacttgatcccct

SEQ ID NO: 72188 - DNA, 389 bp, Zea mays
  Clone ID: LIB3078-008-Q1-K1-B3
cacaagcacgaaatagagattattacagactgataggttaccaggaagaaaatggacagctcgagagcactgaaagttatctaacatacgtcgttgcatatgttaaattgtacgcagcaatgattcagacggaaatcaaaggtgttcgtcatcctcatggtttagctgagggatggaagtggctcgccatgttcctcaattctctcccagctactacagccactgcatgtgcccttcacgctttcctcaagatggctggttttgcacttcacaagaaatatgggtcacagttcatgaaaatcctggatgtaatatcacggtgctttttaccagctttgaaggaacaaggcaacaagatgcaaactgaggctgtcaacaatctacagaat

SEQ ID NO: 72189 - DNA, 299 bp, Zea mays
  Clone ID: LIB3078-008-Q1-K1-B4
ggaaagagaggacatggacaactcactcagtgactatatgaaagctttatccatgttggagcatttggttgagcctgaccatcgtcgagttgtggaattaaacttccgcatttgtttggtttatgaactagtttccaagatcggagaagcaatttcatactgtgcaaaagcaatttcgctatgcaagtcacgcatacagagcctgaaaagttccaaggatgctttgttggctggtatagatggtgatgcatctgctgctgaagctgaaagaagctcagaaaaatctgccattgaaaaag

SEQ ID NO: 72190 - DNA, 361 bp, Zea mays
  Clone ID: LIB3078-008-Q1-K1-B5
ggaaacaccgccgtcgccgcgccttccattccagtactcgcggaggaaaggaacaccagccagcgccatggtcacgtcgacgaccgccgccgtcgtgctgtccccgccgtccgtggccgggcttcgcctggcgccgtctccccgggcgcgcgtggcgttccgcgcggcgccggcgcggcggtccgtggcggcgcgcgcggagctgagcccgtcgctggtgatcagcctgagcacgggcgtgtcgctcttcctgggccgcttcgtcttcttcaacttccagcgggagaacgtggcgaagcaggtgcccgagcagaacggcaagacgcacttcgacgccggcgacgagcgcgccaaggagttc

SEQ ID NO: 72191 - DNA, 421 bp, Zea mays
  unsure at all n locations
  Clone ID: LIB3078-008-Q1-K1-B6
ccgccacatcaagacctaggactatatatcagagtattcaattatccgatccacttacctccagctcatgggaaaggtgcaaaaatttgtggaggcaattcaaagctaaaactgaatatacagttgctcaagcgataactgctcaggaagcaaataagaggaacaacaactggctgccaccttcatgggcacttattgcaatgtctatccttggattcaacgagtttatgacactattgaggaatccactntacgtgtttgccatattttgtgatttatcttgttggaaaagccctttgggtgcaatcaaaaattggcagggaattccaacatggatttcttcctaccattctttcactggtcatgaaatttggtccctctataatgaacattctgaagagattaactgacctgggtcaag

SEQ ID NO: 72192 - DNA, 357 bp, Zea mays
  Clone ID: LIB3078-008-Q1-K1-B7
aaactgactaactgctgcccactcgccggagaaccatggccacggcggcggcgtgtgtgcgggtggcgtctccgttcacgggcccacctatctggcatcccagacacgtcatctcaacgaggcggggacccaggagggccgggctggccgtcacggcggcggctgccgccggtggatcgccgcgcactgtgctcgtcaccggcgcgggcggccgaacaggccaaattgtgtacaagaagttgaaggagagggaaggacagtttgtgggacgtggcctagtcaggacgggagagagcaaaggcaaaattggaggcggtgacgacgtgtttgtcggcgacatcagagaccccgagagca

SEQ ID NO: 72193 - DNA, 308 bp, Zea mays
  unsure at all n locations
  Clone ID: LIB3078-008-Q1-K1-B8
cccacgcgtccgaggcctaccacgagcagctctctgtggctgagatcaccaacagcgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctnctagcgttgtgcctggtggcgacctggccaaagtgcagcgtgccgtgtgcatgatc

SEQ ID NO: 72194 - DNA, 223 bp, Zea mays
  Clone ID: LIB3078-008-Q1-K1-C1
tcgactcgtggtctgacgcgtgggcctccaccttaacccacgaacagagcgagtcgacgccggggcaccttttctccggcgaagggaaatggcaaccgttccacgggatctgatctggcaggttttgaggaagaacaactccttccttgtgaaccacttcgccaacggcaatgccaaggtgcagttcaccaatgagccaaacaacctctacaacttccactcc

SEQ ID NO: 72195 - DNA, 417 bp, Zea mays
  Clone ID: LIB3078-008-Q1-K1-C10
tcccactcgtccggtttctacagaggaagcagtatatttgacaaaaggtgctcgacatgggcatttactagttagaaaggatcaactacctgcttccaaagctatgcacgacaggttgataattgcgaatgtttcatagttctaaacgaccttaacatatcaccatactgcattacacttgccttttatgataatgacaatgtctacagtcagacttttgacgctgatcttattagctgcgacacgtgcatgacctaatctgcaacaaaggatgccttacaccttcgcatccgagttcaccccttccatgtgcttcgtatcaacaagatgctttcgtgtgctggtgctgattagctccatactggaatgatgggtgcctttggcaagccttatggcacctgttcttaggttgacatt

SEQ ID NO: 72196 - DNA, 436 bp, Zea mays
  Clone ID: LIB3078-008-Q1-K1-C11
cggacgcgtgggcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggc

SEQ ID NO: 72197 - DNA, 375 bp, Zea mays
  unsure at all n locations
  Clone ID: LIB3078-008-Q1-K1-C12
gccgcctcagcccttgcacgtcccagccacgctcgcccactgtgtgccgtcgtggtgagaaagaaagcaacgccgtcgccctgtacctgtgcgctggcgggcagggaaattatcgcctgcacgttgagcggacctgggcaccgtcgttcagccggatcgtgcagactcagacggtctttatgcggtgggcgccatggtgcgctgtgcatgctcgatgcgtaatcgctcgctcgggtagcgactggagctcgggtgctcgacgtcatggttccccgccgccggggaccagcaggtattcagtcgccggggcccaatccggtgtcctaggagtggtgcctncactcgatggtgtatttcggagtctcgggtcgggcg

SEQ ID NO: 72198 - DNA, 283 bp, Zea mays
  Clone ID: LIB3078-008-Q1-K1-C2
cgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacc

SEQ ID NO: 72199 - DNA, 190 bp, Zea mays
  Clone ID: LIB3078-008-Q1-K1-C4
caaacgttcacctacgctggtgcactgtcgtctaccgacacctagagattgatctcgactaggaacatcattctgtggtgactgtgtagctggtagctataacctacccgaaacaggtatcattatgtacgtgtggacccttgcctgactatctgataagttgactacgaacaccttcattaatgatcac

SEQ ID NO: 72200 - DNA, 329 bp, Zea mays
  Clone ID: LIB3078-008-Q1-K1-C5
gttgcgtcgggctagccatttcccttcgctgtttcatccgtccaggatgggtcttggggctgccggcgccgccgacagctctccggcaagcgggggccggcgcctggccgccgagggctgcacgagcacgggggcgaccatgtccgtcgccgcgcacagcgcgccggcggtgtcgtcgggctgccgatgcagcagcagctgcggcggcggtgggcaccgtcactgctgctgcgtcaacgtctacgtgaacaacaacgtgcaaggtgtcaccaacttcgtgctggtcggcagcaaggtcgtcgtgaggatgaaggacgccgggacgcgcg

SEQ ID NO: 72201 - DNA, 237 bp, Zea mays
  unsure at all n locations
  Clone ID: LIB3078-008-Q1-K1-C6
tcggagagatgtcactatctctagttcgtcgtcactcgtttgccatgggtnccaatggtctcgtctgtggaaactctgcactttcagtaggtccanntctatcgtcggtttctagtctatatgccacgagttttgtcgctaacgaacaaactcagtcagatcgttgttggtgaactctattcatcgatggagcctttaatttgtctgcttaactatcgactcgtacctgttaaagta

SEQ ID NO: 72202 - DNA, 406 bp, Zea mays
  Clone ID: LIB3078-008-Q1-K1-B11
cggacgcgtgggcgcagagcatcctggccatctgggcgtgccaggtggtgctcatgggcgccgtcgaggggtaccgcgtcgccggcggcccgctcggggaggtggtcgacccgctgtaccctggcggcagcttcgacccgctcgggctcgccgacgacccggaggcgttcgccgagctcaaggtgaaggagatcaagaacggccgtctcgccatgttctccatgttcggcttcttcgtgcaggctatcgtcaccggcaagggccccctcgagaacctcgccgaccacatcgccgaccccgtcaacaacaacgcctgggcttacgccaccaacttcgtccccggcaagtgagcgagggcatgatgcttgcatgcgtgtaccgtatacgtaccgtattcctacgtact

SEQ ID NO: 72203 - DNA, 445 bp, Zea mays
  unsure at all n locations
  Clone ID: LIB3078-007-Q1-K1-H6
ccaatatggaaaaagggtgatgagaaggctgtggtggtggaacctgtaaattcagttcggaaaatcctggaagaaccaggaattagagttaaagtggacgactcagagctgcgaactcctggatggaaattcaatcactatgagatgaaaggggttcctgtaagaatagagataggtccacgtgatgtcacaaataagagtgttgtggtttctaggcgtgatgtccctggaaagcaaggaaaggagtttggagtgtctatggagccttcgatattggtgaaccatataaagggtcgtctagatgacatacaagcatnccttttacagaaggccataacattccgtgatagtaacattgtcgacgtaagctcatatggcgagctgaaggaagctatttctgaaggaaagtgggctagaggtccttggtcagctagcgatgctgatg

SEQ ID NO: 72204 - DNA, 230 bp, Zea mays
  Clone ID: LIB3078-007-Q1-K1-H7
ggcgccgaccaggcttctgcacttcaacattcctctcgagtccggggagtacatgtcgaagcacgtcttcgactgaaagtgcccgaccaagggctgcgagctgctggatggaaaggtactgcctgtgatcatacaggtgatcactgatggcctcgatctagctgctcgtgatgttgctcatactagagcccatctacctactcatgtagtacgtgtcccgcagcgtgctc

SEQ ID NO: 72205 - DNA, 444 bp, Zea mays
  Clone ID: LIB3078-007-Q1-K1-H8
ccacgcgtccgcccacgcgtccgccaacgcttccgttggagctggacttgtcgagtctcaacactgtaaacgacggtgtttgcagctctttttagtaagcttggtgtgccaattaaaacaactgtttcagctacagttttagaggaggcattgaatggttcggttatggtttctcaactccagctaggaaactcagtgcagagaaaggtggaaaagcaatcggcccatttctattctgtggatataactgaaaaacaagctaaaatggggctagtttgtcgtgttcactcaaacgataaaagcaaattcaagttgctatattttgagcttgaagaaaatggcgggcttagtcttgcactacaggaagacagtgtgaaggttgggaaagttactgctgcagggatgtatttccttggttttcctgtgtaccgttttgaacaaaat

SEQ ID NO: 72206 - DNA, 478 bp, Zea mays
  Clone ID: LIB3078-007-Q1-K1-H9
cccgcgcgtccgcccacgcgtccgcccatgcgtccgcccacgcgtccgaaggagccgagatcgtgaggtgcctgctcaggaccaggatcaccggcgaccaagcgcccggggagacgtggcacatggtcttcagcacagaaggcgaggtcccctacagagagggccagtccatcggcgtcatcgcggatggcgaggacatgaacggcaagccgcacaagctcaggctctactccatcgccagcagcgccctcggagatttcggcgactccaagacggtgtcgctgtgcgtgaagaggctggtctacaccaacgatcagggggaggtcgtcaaaggagtctgctcgaacttcctctgtgacttgaagccaggcgctgaggtgaagatcacagggccagtgggcaaggagatgctcatgctcaaagaccccaacgcaacaatcatcatgctcgcaacgggtacccggatcgctccgttccg

SEQ ID NO: 72207 - DNA, 308 bp, Zea mays
  Clone ID: LIB3078-008-Q1-K1-A1
ggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcctatgaggaaattaagaaagctattaaggctgcttctgagggcccactcaagggtattatgggctacgtggaagaggatctggtttccaccgacttcaccggtgacagcaggtcgagcatcttcgacg

SEQ ID NO: 72208 - DNA, 407 bp, Zea mays
  Clone ID: LIB3078-008-Q1-K1-A10
cggacgcgtgggcggacgcgtgggcggacgcgtgggtgaggctggagacttattaccaggatatcgagtccttgctatcaacatatgagaacattattgtcaaagtgcaaggagatgccacagtggatgctgtctttgctaagatcgacgagctgctgggttctatcctggagaagaaaaatgaaatggtttccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttctccatgtggatgtggtcaaagcataggaatttttttccttcaattattaact

SEQ ID NO: 72209 - DNA, 397 bp, Zea mays
  Clone ID: LIB3078-008-Q1-K1-A11
cgcgtccgcacttgtttatttcttattccatatactgtcagcaaactagagcagggttttacaattgggccattgataagttattattctgcctaggttagctgtcagttttctatgatagagaaaattagttctactatatgtttttttctcgaacgagatgagcaaatgttggagaattctgctatacgttattgcagatggtacatgaactgaaaaaaaatatgtgcactctctaacaagaaaaaaagtgaaataaatttgagttcaatggacaaggctttactttattcgtgctgtgttgtaaaaaatgtcaacaacagtacactcactaagtcactagcaatataattcactttataccagtattctttatattgcctttctcttggttttg

SEQ ID NO: 72210 - DNA, 397 bp, Zea mays
  Clone ID: LIB3078-008-Q1-K1-A12
cgcactcgcgtctctttcctattcgcgccgccgtcgctgctgcaagcgccagctcgccgtcgtccgaatagtacactctaacgccgccatggggcgtatgcacagccgcgggaagggtatctcgtcgtcggcgctgccgtacaagaggacgcctcctacctggctgaagaccgtcgcctccgacgtggaggagatgatcacaaaggcagcgaagaagggacagatgccgtcgcagatcggcgtcctgctccgtgaccagcacggtatcccccttgtcaagagtgtcaccggcagcaaaatcctccgcatcctcaaggcccatgggctggcacccgaaatcccggaggacctgtacttcctcatcaagaaggcggtggcgataaagaagcaccttgag

SEQ ID NO: 72211 - DNA, 265 bp, Zea mays
  Clone ID: LIB3078-008-Q1-K1-A2
gcggaggacttcgacaagcgcgggtccgggaagcaggataccatcgccgacgtggtgctgtcgccggaggagatggagatgtacgtcgacctgcaccccttcaccaacacgttgccgtacacggtggtcgagaccatgtcgctggccaaggcgctcgtgctcttccgggaggtcggcctgcgccaccttctcgtcgtgcccaaggcctgcgataggtcgccggtggtcggcatcttgacgaggcatgacttcatgccagagcaca

SEQ ID NO: 72212 - DNA, 431 bp, Zea mays
  Clone ID: LIB3078-008-Q1-K1-A3
gaggcacgcgtcacgcttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggctgagtccggcgaggccgtccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataagtattgtgtggtgtgtgtgagagagagagaaa

SEQ ID NO: 72213 - DNA, 268 bp, Zea mays
  Clone ID: LIB3078-008-Q1-K1-A4
caagcagctggaggatggccgcaccctggcggattacaacatccagaaggagagcactctccacctggtgctccgcctcaggggtggcatgcagatttttgtgaagacattgactggcaagactatcatcttggaggtggagagctctgacaccattgacaatgtgaaggccaagatccaggacaaggagggcattcccccagaccagcagcgtctgatctttgcgggcaagcagctggaagatggccgcactctcgcggactacaac

SEQ ID NO: 72214 - DNA, 442 bp, Zea mays
  Clone ID: LIB3078-008-Q1-K1-A5
cggattctagccctagaccagtgtaaaagtgtggaagtccttgtgctccagttgatgccagtctcttcccagccactaggtttgctctgcacaagtgttggcacaccatcggtctgccagtagtgaccacgccggtcagtttggccatgtcgccgtggccaagacaactcagcaagagctccgagcagaaggagtgtaaattcaagacgaagtggttgtggaagaggagtttgctccagtgcctattcagcaagtggatggagctatctaactggttattgggtagaaaggtcttaagcctcttcactgcaataaaggtgatgaggagtactctatgtgttcgtgaggctggagggcgctttcagttctagaggaggattagttaggcttgtgtataagctttggaggggtcctactttcctgctaatgtagtaagttatgc

SEQ ID NO: 72215 - DNA, 148 bp, Zea mays
  Clone ID: LIB3078-008-Q1-K1-A6
agcactcagagggcgtagatgcacagcagccacggggtgctcatactctgggggacgagcctgatgacggtgacagctaggacgctaagagcgtgcgcgagctgatgttgtctgagaccagtggtgaaccgcactggcgcaatgacac

SEQ ID NO: 72216 - DNA, 345 bp, Zea mays
  Clone ID: LIB3078-008-Q1-K1-A7
gttcaaggaacacttgctcttcaggttcttaatgatactgatgggttcatccatttgcagattgaaagccaagatatgcctgggcttagcttcaaaacacacccaaatatcaataaggatttgtttaacagtcagcaaattttgggagcaaaagatccaaacaggccctttccgagtggtcaaaatgaaactcctctggtgaaatggagaatccaggggatggatgagtcgtctttacctctgtcagtcaattgctggccgtcagtatctggaaatgaaacctatgtgaacattgaatatgaagcttctgagatgtttgatctgcacaacgttgtcatatctata

SEQ ID NO: 72217 - DNA, 276 bp, Zea mays
  Clone ID: LIB3078-008-Q1-K1-A8
cgagaacaacggcggcagcagcgacagttacggcgataggcgcggcggcggtggccctgcggcgggaggcaccagcaccaccaccagctgcaatggcttcgatggtggcgagcacaacgaagccgcggacgcgcaggcgacggggcaagctgccgtcgacgccgccgccttcacggagctgatccgggaccccaagagggtgaagaggatccttgccaaccggcagtcagctcataggtcgcgggtgaggaaactgcagtacatcttcgagctcga

SEQ ID NO: 72218 - DNA, 446 bp, Zea mays
  Clone ID: LIB3078-008-Q1-K1-A9
gcgtcgccgaggcgctaaatgaaacagtctgtctcgataagcaatgtgaaggactcatgatacaaggaaaatactatgtcaaaatagacccacaaggagaaggagctcggtggcgtcggacatttggccaggaaatatactcccctctccttcttgctttcacagagcaggatggaggcaactgggcgaattcacatgttgcaaaattctctgcgatggattcaacttacagcttgcctgataatgttgcaatgcttacccttcaggagcttgaagatggaagtgttctccttcggtttgctcatctatatgaggccggggaggacaaggatctttcatctttagcgagtatcgacctcaagagagtgttcccggagaagaagattggcaaggtcatcgagacaagcttatcggctaaccaaaaacgcgcaatcatgggagaagaa

SEQ ID NO: 72219 - DNA, 389 bp, Zea mays
  Clone ID: LIB3078-008-Q1-K1-B1
gccacgcgttcgcccacgcgtccggcgagagcggatagagagagtgagggaggcgccgacgccgggtcctttcttcatcctgcatctgccgctgtttccgacaggatgtttctcacgaggacggagtacgaccgtggggtgaacaccttctctccggaggggcggctgttccaggtcgagtacgccatcgaggccatcaagcggcggcatgcttgccagccaataccttttttcaaagcactttggcatttcttgatgcctctacggatttgaaggtgtaccaattcttggcgtagttgcagtactacggtggcggctgcatggcctcttcctgctgtgctgcagctgctcttggagtatagctgtagccccttcgtactgttcggatc

SEQ ID NO: 72220 - DNA, 405 bp, Zea mays
  Clone ID: LIB3078-008-Q1-K1-B10
attctttgctgatgatgaagaatctccagcaacaccaaaggcagatgcttttttcatccctagagagaacccaaggaacctggtaattcgtccaattgagcagtggtcttcacggagagaaactggccggcaatatactgcaaagaatgttactgattcgaacaaatatgaagatgcttccattgaaggtgagcgtggtaagtctgccatgtcaccaagcagcaggccacctgtagtggaaaatgacaaacagcatgaggccagggccatggctcaacatgcgaatggaaatgctacttcagttgagaggctgttgcctaagcttccacgtgcagattacttcacagagcctagtatagaggagcttgcggccaaagaacgtgcggagccaggctactgcggtcg

SEQ ID NO: 72221 - DNA, 162 bp, Zea mays
  Clone ID: LIB3078-007-Q1-K1-H5
gcgtacgcccacgcgtccgcttgctatgaacgtcaactatgagaacacacatgcactttgtgaacctgactgcacggaatcttcaattggtgtttgggacattccaaaatgctcaagtctattccacccagaagtaaaaatgctataacttcattaaagaaa

SEQ ID NO: 72222 - DNA, 311 bp, Zea mays
  Clone ID: LIB3078-007-Q1-K1-F4
cccacgcgtccggaagcctttcatgtgtgatgctcctaagcaggaacccgagcctttagcgtacttagccgaaaagaatcacataaattatgacattcctcttgaagtctcgattaagccgaaagatcaaaatgacgcatcaattgtcacgaaaactaatttcaagcatctgtattggacgctgacacagcagctagcacaccacaccatcaacggatgcaacatgaggccgggggatatatttgcgactggcacactgagtggacctgaaccggactccctcgggtgtctgctggagctgacatggaacg

SEQ ID NO: 72223 - DNA, 332 bp, Zea mays
  unsure at all n locations
  Clone ID: LIB3078-007-Q1-K1-F5
cggacgcgtgggcgccggcgtcactctgcaccgcgcgctgcatccagcgtcaccgtctccgcgccttcccaagctcggaaatacctctagaggaactcaacccatccgtcgatctacttangagaactgcggangccgttggcgatttcaggaaaacgccaatctatattgttggtacggattgcacagccaagcgcaacatcgccaagctgcttgcgaattccataatataccgctacctcagcagtgaggaactgcttgaggatgttnctggtggcaaggacgccctcagagcctttcaaggaatctgatgagaaggggtatcttgaagt

SEQ ID NO: 72224 - DNA, 292 bp, Zea mays
  unsure at all n locations
  Clone ID: LIB3078-007-Q1-K1-F6
ggtagctatagcagcctagcacacaccacttccaacaaccacggggccacaaacttgcgggaagtgtgctgtgcttcgttaatcgaccgaccgatcgatctcggcatggcggactgggggccggtgctgatcgggctggtgctcttcatcctgctctccccgggcctgctctttcagatccccggcaagggccggatcatcgagttcggcaacttncagaccagcggcctctccatcctcatccacgccgtcatctactttgccctcctcgccatcttcctactcgccgtcg

SEQ ID NO: 72225 - DNA, 86 bp, Zea mays
  Clone ID: LIB3078-007-Q1-K1-F8
cggacgcttgggttttttttttggtcttctcgtaaggttcgctttttttttttgttaacgcatataggaatttgtgaatggtgatg

SEQ ID NO: 72226 - DNA, 349 bp, Zea mays
  unsure at all n locations
  Clone ID: LIB3078-007-Q1-K1-F9
gtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtcgatgaaatgaagaccattgctgagcaattcagcgtagaggccatgccaacattnctgttcatg

SEQ ID NO: 72227 - DNA, 111 bp, Zea mays
  Clone ID: LIB3078-007-Q1-K1-G1
ggcagttctacgacggggtgaaccggcggtacctgccggcggtggagccgctcatcgcggagggctgcgtgtacgaggacctggtgttcccgcgccccttcgtggggcggg

SEQ ID NO: 72228 - DNA, 380 bp, Zea mays
  unsure at all n locations
  Clone ID: LIB3078-007-Q1-K1-G10
gcacaagttagctcctcgccaacatgtgcgcatttagaccgacagagtcgctgtagtggattcagctcgtgttagctcctggctaacgagctgaccatacggctttagttttgtgaagtgggcgcgatttcgtcatgtcatgcatgtgttagctcctggctaacctgcaaatgcgtgtgttggtgcaggtttttgtcacgtctgcgtcagctcctggctgaccagcagttgtttgtcgttcattctctgcgtcagctcctggctgaccagcagttatttgttgttcattcttgcgctagcaccaggctaggctgcanaactgcanatannttgtgcatggaacatttngtaatatcagtcaattcccattcttgttgtgc

SEQ ID NO: 72229 - DNA, 299 bp, Zea mays
  Clone ID: LIB3078-007-Q1-K1-G11
cggacgcgtgggttctagatcgcgagcggccccttttatttttttattttttttgttttgggagcatgagagattattgagtccacggtgaatgaagcatgcaataaattacatgatgattgtggagattaagctattacaagattgatgttgtgacgctagcagctaacgtagcagctaggcagcagcctcacttcacaactacaaatcacacaggatcatggggtccttgagcagactggccttactcatttcacctcgaggatctcgtccaaggcgtaattgttggtagacactcc

SEQ ID NO: 72230 - DNA, 253 bp, Zea mays
  Clone ID: LIB3078-007-Q1-K1-G12
cggacgcagccatcctaccgcgtgctcctgcgtagctagcgtatgcgtaggcgtagccgtagcagcttgtgcgagatggggagaaatgcttatggggagggcgctattggaggacacggacatgccgatgcggatgcaggacgctgggacctccgcaggctcgcagcgcactcgacctcttcgacgtcgccgactgtcgagccatacacgaccacatgaagactgagttcgacaagcggtacggcgtcaggtg

SEQ ID NO: 72231 - DNA, 425 bp, Zea mays
  unsure at all n locations
  Clone ID: LIB3078-007-Q1-K1-G2
gcgggcgccgggcgcgtcgtctggttccccgcggcggcgcgccgcggcggcggcagcgggcggttggtcgccgtgcggtccagcgggccggccacgccgccggagatctccgacaaggtgtctgagagcatcaagcaggcggaggagacgtgcgcggacgaccagaagggcgacgccgagtgcgcggcggcgtgggacgaggtggaggagctcagcgccacggtcagccacgcccgcgacagcctcaaggagaccaacgccaacgacccgctcgagaagtactgcaaggagaacccggactccgaggagtgccgcatctacgacaactagctatagtcgtagctatatagggcgtggaatgatactctcgatcggcgcgtcatacgtggaatgaactngtatgaagctatacctcaatgcttctc

SEQ ID NO: 72232 - DNA, 430 bp, Zea mays
  unsure at all n locations
  Clone ID: LIB3078-007-Q1-K1-G4
gctctacgtggtgagcatcggcaccaacgacttcctggagaactacttcctgctggtgacggngcggttcgcggagctcacggtgggcgagtacgaggacttcctggtggcgcaggcggagcggttcctgggcgagatccaccggctgggcgcgcgccgggtcaccttcgccgggctcagccccatgggctgcctgccgctggagcgcacgctcaacgcgctccgcggcggctgcgtcgacgagtacaaccaggtggcccgcgactacaacgccaagctgctcgccatgctccgccgncttcaggcggcgcgcccggggctcaaggtagcttacgtcgacgtgtaccagaacatgctcgacctcatcaccaacccttccacgctgggtagagagagagagagagagagagagagagagagagagagagat

SEQ ID NO: 72233 - DNA, 56 bp, Zea mays
  Clone ID: LIB3078-007-Q1-K1-G5
ggtaggtgctgggctagagtgtggtattgtggtagatgacttcgatgaatgggagg

SEQ ID NO: 72234 - DNA, 400 bp, Zea mays
  unsure at all n locations
  Clone ID: LIB3078-007-Q1-K1-G6
agttctacgacggtttgaaccggcgttacctgtcttcggtggagccgctcatcgcggatgtctgggtatactattacgggntgttcccgcgccccttcgtggggcgggagcgggtggtcggcttcttcggcgagttcatggtgaccatcatccccgacctgcagttcgtcatcgacgacatctccgcctaggactccgtcgccttcagcgtcacctggcacctgtagtggacggggaggccgtttaccttcagcaggggatgcagcatttaccgcttgctcggttcttctgtctcggagcagcagcaacggctgcacattgtgtatggtcgatactgcgtggagcctgccgacaatcccggagatttggcactggtaatcatcacgggagtgacatggat

SEQ ID NO: 72235 - DNA, 445 bp, Zea mays
  unsure at all n locations
  Clone ID: LIB3078-007-Q1-K1-G9
ggcgaggagttcgcgatcggcgtggtgctctccgcgaagaccaccctgngggaggagtgcgagggccagatcgtcgccttcgatcgaccctccaacctcctcgttatccaggagggcgtggggagggcggagagcggagagcggcggaacgtgagggtgctgaaggcgaactacatccgggagttctctgtgctcagcaagggagacgaccctctcgatcctgccggttgcatgctggaccttaactccatttatgcccgggaggatgctgcactcaggcaagcagagattgaagctgagaaaattggtgttggtgtcaccccagaagctcaaaatatattcgatgcgctgtccaagacgcttncggtgcagtgggacaagactgacattgttgtaatgaaggagggtcgtgtacgcagnccgtacctgccttgaaaatgtagtg

SEQ ID NO: 72236 - DNA, 322 bp, Zea mays
  Clone ID: LIB3078-007-Q1-K1-H11
cgctgcttcgtcggcggcctcgcctgggccacggacgaccactccctccacaacggctgagcacctacggcgaggtcctcgagtccaagatcatcctcgatcgggagacgcagaggtcctgcggcttctgcttcgtcaccttctccacggaggaggcgatgcggaacgccatcgagggcatgatcggctaggagctggacggccgcaacatcaccgtctacgaggcccagtcctgcggcggtcgttgatgcggcgtcagtgggtacggtggtggccgtagatgcggtgtctacggcattggtaggcgccgtgatggcggtgg

SEQ ID NO: 72237 - DNA, 390 bp, Zea mays
  Clone ID: LIB3078-007-Q1-K1-H12
cgcggagctggaggccaagctggacgaggggcgcagccgtgtggaggccgagctcgtggaggcgctcgccaacctcgaggcgcagaaggaggaggctgttaaggcgctcgacgcccagatcgcctcgctcagtgatgagatcgtcaagaaggtgctcccatccgcgtgatgaaaccaaaccggccctgccttatcctacgactatagttacatgaacatcataaattaatgataattttgaagaaattggccgatgactccgacactgtactcatgaaagattattggatgggttgtgtccaccgtctgtgttgggtgtggattgttgtagacttccagtgatctttctcgataagcttggacaggtcaatacatacagaccccccattg

SEQ ID NO: 72238 - DNA, 411 bp, Zea mays
  unsure at all n locations
  Clone ID: LIB3078-007-Q1-K1-H2
cgtccgccgacgccaaaaacgcgaaggcgaacgccatggccccgaataagagcacccgcggcggatgactccagtttcaaccagctgctcggtatcaaaagtgcttagccagggaacggccttttggaaaatccgccttaacttaactaagccggtgacatggcctccgcttgtttggggagttctctgtggagcagctgcctctggaaatttccactggacagttgaagatgtcgcaaaatctattgtatgcatgataatgtctggtccatgccttacaggatacacacagacacttaatgactggtatgatcgagacattgatgcaattaatgagccttatcggcctattccatcaggtgctatatcaganaacgaggtaataacccagatctgggtgctattgctagg

SEQ ID NO: 72239 - DNA, 251 bp, Zea mays
  Clone ID: LIB3078-007-Q1-K1-F3
tccgaaaaaggcattctgaggttacccgtttcatttaaaagtcccttgacagatttccagtgatggttaaaagggctgaaaggagggatattcctgacttcgccaggaaaaggtacctcgtccttgcagatcttacagtcgggcagttcgggtatgttgttaggaagagaatcaagctcagtgctgagaaggctatcttcatatttgtgaaaaacacccttccaccaacagctgctctgatgtcttcaatc

SEQ ID NO: 72240 - DNA, 128 bp, Zea mays
  Clone ID: LIB3078-007-Q1-K1-H3
ctgacgcgtggtcgcgtgcgaaccaagcagtaccacaacaagaagaagcgtagtcgtcgccgtaaggaaaggcgcggagcatgatgtcgtggcaggcgtacgtcgacgagcacctgatgtgcgagatc

SEQ ID NO: 72241 - DNA, 413 bp, Zea mays
  Clone ID: LIB3078-007-Q1-K1-H4
acgcgtccgcccacgcgtccgcccacgcgttcggcgacacctgctgcccgctgctctccggcgtggccgacctcgacgccgcgctctggctctgcaccaccatcaaggccaaggcgctcagcgtcagcctcgtgctccccgtcgccatctcggtgctcgttaacgagtgcggcaagcatgtgccctccagcttccagtgcccgtaatcacatcagctgcatatatgtgctactatgatgtatcaccaccactaatctatatccgcatgcatgcatcaatgcatgggtgattaagggtttatacgcggtcaaagttatacacgcatatatatgtagcttcatacatggagctgtgggttgtgcattcattttcaaatcatgtaccagtattatattgtagtatcataaaccagt

SEQ ID NO: 72242 - DNA, 52 bp, Zea mays
  Clone ID: LIB3078-007-Q1-K1-D12
ggaccactcaagcagcgctagacaacatgctctcgtccacgttgaccgtctc

SEQ ID NO: 72243 - DNA, 287 bp, Zea mays
  Clone ID: LIB3078-007-Q1-K1-D2
acctagccagaacatactcatactattcatttcacattatcttgtacatggcgatcatgtactctgtaatgctactgactccatgcacaacttctgattctgataacgcaaagcctcaatcatgattcatcaacatgagcacatcacaagaatctaacatagcatcaaacagaccaaactcttatatggatctaagctacaccaaccctttgtagcgacacctaatccttagtatcaccaagcgtacaccgactgatcaaacgtacataatatcctacgcattataa

SEQ ID NO: 72244 - DNA, 205 bp, Zea mays
  unsure at all n locations
  Clone ID: LIB3078-007-Q1-K1-D3
tncacacgaatttgccttgtttttaaccttgggaaattttaccgctgttgggaattaacttgttcggcccaagccggcagtttcagccaagttggcgcaaaagaagggccttcatgccggtgctgggtggaccaccattaagaagaagggaacttcaagggtcgtgccaactttctttaacccttttggggattaacgcattctt

SEQ ID NO: 72245 - DNA, 87 bp, Zea mays
  Clone ID: LIB3078-007-Q1-K1-D4
gatggtattgctgggctttaccgtggatttaacatctcctgtgttggaatcattgtttatcgtggtctgtactttgggctctatgat

SEQ ID NO: 72246 - DNA, 314 bp, Zea mays
  Clone ID: LIB3078-007-Q1-K1-D5
gccacacgaaccatgcctacatcaggtgctacaggaactagcaccgaacgtcattcgggctcatatagcgctagaatgtacccattgcatcatcaactgttcgtatcaacaaacagtctcttctagctttcgatccttacatcgacactgtatcacggttccaagataatgctcgctagacatgctcccagatcccgaaaaccggtataggctcaaataaggctatgatctcaaacaaggactggtccatatccttgacatgcctctgctggtattcatctatcataatactaagaaaccgaccatgacatcct

SEQ ID NO: 72247 - DNA, 415 bp, Zea mays
  unsure at all n locations
  Clone ID: LIB3078-007-Q1-K1-D6
cccacgcgtccgtcaagccaagccagttaaccgtcaaggccggcgacaccataacattggggaccaacgccggcttcccgaacaacgtcgtcttcgacgaagacgaggtgccgagcggcgtcgacgccaccaagatctcgcaggaggagtacctcaacgcgccaggcgagacctactccgtcaccctcaccgtgccgggaacctacggcttctactgcgagccgcatcaaggagccggaatggtcggcaagatcaccgtcaactaattaagctagctatcgatcgatatccattcatgtattagctgntgcttcctgctttgtactccgncgatctgtccatctctacatgttttcgtcttcacacaacaacctctgctacgactacgtatatatgcatgctactagcttgatga

SEQ ID NO: 72248 - DNA, 293 bp, Zea mays
  Clone ID: LIB3078-007-Q1-K1-D7
ccatcgaaccattgtgtgccaggcggcgagcagcatctccgccgaccgcttccccgacatggataagcgtaagctgatgaacctcctcctcctcggcgccatctcgttgcccaccgtcggcatggtcgtcccctacggcgccttcttcgtccctgccgtctccggaaactcctgcggcggcacctacgctaaggacaagctggacaacgacatcacggtggacgcgtgtctcaacactcacggtcccaacgaccgcactctcccacaggttctcaagggtgaccccacgtacc

SEQ ID NO: 72249 - DNA, 257 bp, Zea mays
  unsure at all n locations
  Clone ID: LIB3078-007-Q1-K1-D8
atcaccgtgttcgtaaccctgaacctgttcttgaagctcctttactacacgcccatgggggtgctcgcctccataatcctgtcggctcttccgggactgatcgacatcaaggaggcctgcagcatatggaagatcgacaagatggatttcctcacctgcctcggtgccgttgttggcgtcctgntttggtcggtggagattgggcttgcaagtgcacttggcattttctttcgcaaagatcatcatacagtcgcttc

SEQ ID NO: 72250 - DNA, 461 bp, Zea mays
  unsure at all n locations
  Clone ID: LIB3078-007-Q1-K1-D9
gggctcaaggcgctgctctccgtcgctacctaccggaagctctggttccccgaccgccggcacagggactacctcgaggtgatgttcaccaaccgcaaggagagaggcgagctgctggaaggtttggtggtcagcaacaaagacgccaccgtgcccgtcctgccccagaaaatactcctgttgtggggagagaacgacaacatcttcaacatcgagctcgccaagacaatgaaagagcagctcggcgagaagacgacgctgcagagcataagcaaggccggccacctggtgcacctggagaggccctgcgtctacaaccggctcctcaaggagttcctggcgtgcgtcacggctaccgaaaccaccaacaaggagtgacaagggcagctggaaggagttggccgcctacatttgccacgagttctgtctgtttcngaataacgagagagaacggacgacac

SEQ ID NO: 72251 - DNA, 483 bp, Zea mays
  unsure at all n locations
  Clone ID: LIB3078-007-Q1-K1-E10
caggcagaggcagcgtagcagcagccaactccatccatcctctttcccctcctcgcttggcttcctcggcggattcctgctccctcgaccgtccccgtccccgtccccttccggcgcgcgagctcgcccgagatggcaaacgctagatcgggtgtcgctgtgaatgacgagtgcatgctcaagttcggcgagctgcagtcgaagaggctgcaccgcttcctaactttcaagatggacgacaagttcaaggagatcgttgtggaccaggtcggggatcgcgctaccagctacgaggacttcacaaacagtctncccgagaatgactgccgatacgcgatctatgatttcgactttgtcactgcagaagatgtccagaagagcaagatcttctatatcctatggtccccatccttcgncaaagtgaagagcaagatgctntatgcaagctcaaaccaaaaattcaagagtgggctcaatggcatt

SEQ ID NO: 72252 - DNA, 335 bp, Zea mays
  unsure at all n locations
  Clone ID: LIB3078-007-Q1-K1-E11
gccgggcctgggccgctgtcggagatcgagccggacctggaggaggacgccatcgacgggtaccgcaccaacggcatcagcccggaggacttcgagtccgggaagtatgacggacaccacacctatttcgaaggtcaagacaagaagggcttctgggaggatgtctccgagtggtaccaagaagctgagcctnctcagggctttcaagcactcatctnctgagcatttcctcctgcgatcatccttcgcatggctttcaatgttgccgctgagtacctgtacatcggngcggncgtcttcatcgtggtgttctgcgtcatcgagatgggcaagcc

SEQ ID NO: 72253 - DNA, 296 bp, Zea mays
  Clone ID: LIB3078-007-Q1-K1-E12
ctgacacctgggcgggcgcgcgttatcacgcgagcctgctatgagcctagagtggtcgggcacgctacctatagcatgagccccctacaatatcagaaccgccgcgatgagagacactactcctccatcgcgccatctgtgctccagggcttgaccaaggcggtggccatgacggtcctatacgacgacggtgacaagaccttcttcgccgtcataatattggctatgcaccataccatgatactggacctggcacgctacgtgactgcactaatagtgatcacagctgtatcagc

SEQ ID NO: 72254 - DNA, 264 bp, Zea mays
  unsure at all n locations
  Clone ID: LIB3078-007-Q1-K1-E2
cggacgcgtggtcggacgcgtggtcggacgcgtggggtcaaggtcagtgggagggctgcgcaaaatccgaaatgtataccccagaaatggtcaatctcatggaaagcacccagcctgatttctctgcaccatccggggagtcactcatacaggtacagtttcggatgatggaattcctcaaccggacagtcctaagactaccaganaaggtggcaaatggggacacactgtcacaacataatgagttgaaggggttctctcggc

SEQ ID NO: 72255 - DNA, 395 bp, Zea mays
  unsure at all n locations
  Clone ID: LIB3078-007-Q1-K1-E4
gcttggtgttactgacgtctacgatcggcagccatatcttataaagtctgccatcgactgtgangtgtgctcaagagcagatgtgtttgttggcaatagcttctcaacattctccaacctcgtagtgctgtccagaacaggaagggctgtataacctaggaaaggcaagctcatgtggcaagaacatcgggctttcatcgtatgcatacaatgtcatgggtggcaatggtggaccgcatagatggatgacggatatgtcggatgcaagcctgcaaaggttaagttacggaacaaataacgtttaatgccactgactttgacgcatagcacttgactgaacatgatgtatacgtgagggagtccctgtcagatttcatttatatagacaaaggaaa

SEQ ID NO: 72256 - DNA, 361 bp, Zea mays
  unsure at all n locations
  Clone ID: LIB3078-007-Q1-K1-E6
cggacccgtggccggcaccctggccggccccttggggaaaaagcctgtcctcgttgaaggcggcctcaataatccactctctctgcttttaacccaaccgttactggctctgcgctgcgacgcaggactctgtcaagatctgggacctcgagtcgaagcacgttgtgcaggacctcaagcccgacatccaggtctccaagaaccagatcctgtactgtacaagcttgagctggagtgcggacggaagcaccctctacactggctacaccgatgggtctatcaaggtttggaagatctccgggtaccgctacgcangctagatgttgaaatcaacttggtctaagcagtctttcgggggaaa

SEQ ID NO: 72257 - DNA, 425 bp, Zea mays
  Clone ID: LIB3078-007-Q1-K1-E8
ggcgtcgtcgtcgtcgccgtgccccggccccaaggacaacttcaacggccacggcaagagggccaaggtgatgcacctgctgctctggggacccaagtgaagcggcggctataggccaccgtaccgccgggctctcccgccggcgttgctcgttttgctctgcctgcaatccgccccgcacggactgtactgtacctatacacctatatactacgacgtgcacctgtactacgacgtgctgctgtaccatactaatactagtgcgctgctgctcccttgccttcttgcttgcaccagccactcccgctttttttgctcgaacgatcgactgctcgtgtcgcgtcgggccacggccggtcgtcagtttgggtgtgtccactccactgtaaagctcctctcttttttttgggtactccctccatgcc

SEQ ID NO: 72258 - DNA, 419 bp, Zea mays
  unsure at all n locations
  Clone ID: LIB3078-007-Q1-K1-F10
cggacgcgtgggtcttctgtcttccgatggggagaagcttaattctatgaatctgttggggtacatggctccaatcgctgttatcttcttgcttcctgcaactatctttatggaggataatgttgtcggcgttacaattgagcttgcaaagaaggatttcacgattgtttggttgcttttgttcaattcttgcttgtcgtattttgtcaatttgaccaatttcttggtgaccaagcatactagtgcactgactctacaggttctcggaaatgcaaagggtgcggtggcagttgtcgtctcgattatgatattcaggaatccagtgtccataacaggaatgctcggttatactctcacagtttttggcctcattctttacagtgaatccaanaagcgcaacaacaagccatgaataccct

SEQ ID NO: 72259 - DNA, 343 bp, Zea mays
  Clone ID: LIB3078-007-Q1-K1-F11
cccacgcgtccgtccacgcgtccgcggacgcgagtgcggtcccgccatccaaccagaggggaagttgagcacacgagcataggtagaagagagcagacgatgatggctcgtacgaagcacaccgcccggaagtccacggtaggcaaggcccccagcatgcagctcgccaccaaggcggcgaggaagtctgcgccgacgaccggcggcgtgaataagccccacaggttcaagcccggaacagtgtcgctgcgcgagatcctcatgtaccagaagagcacggtgctgctgatccggaagctgcccttgcagcgcctggtgcgcgagatcgcgcatgacttcaaga

SEQ ID NO: 72260 - DNA, 443 bp, Zea mays
  Clone ID: LIB3078-007-Q1-K1-D11
ggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtcgtcgacgctgttcgtgatcgagttcatcctgtttcactacgtggagatccggcggtggcaggacatcaagaaccccggcagcgtcaaccaggacctcatcttcaagagctacagcctgccgccgcacgagtgcggctaccccggcagcgtcttcaacccgctcaacttcgcgcccacgctcgaggccaaggagaaggagctcgccaacgggaggctggccatgctggcgttcctggccttcctgatccagcacaacgtcaccggcaaggagcccttcgacaacctgctgcagcacctg

SEQ ID NO: 72261 - DNA, 338 bp, Zea mays
  Clone ID: LIB3078-007-Q1-K1-F12
gccttccacccagctagcgcatccagagcaagcgatcgagcgagctctctcggcttggtggctagctccattatatataacatcgatcgcttgatagtttttggtagctagaaagaagagagagaaagagcagctagctagtacagggatggagaagatgaacgtggttgcgagcaggaagcagcagggcggcgactggatctgccggtcgtgccagtacgtgaacttctgcaagcgcgacgcgtgccagcgctgcggcgaggcgaagctgggcgtggagcggacggactacggcgcgctgggcggcgactgggacgtgaagccccgcgactggtact

SEQ ID NO: 72262 - DNA, 419 bp, Zea mays
  unsure at all n locations
  Clone ID: LIB3078-007-Q1-K1-A8
acccttccggcccgagccggccgtgtccgtgcagttcggcgaccacggccacctcgcctactcccacacggaccaggcgctcctccgccccaggtcgttcgcggccaggacganngtgtctgcctgttcaaaggggtgctggacaacctnggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctagtcgcatccgaccccgagggcagggtgccgctcttctgggggatcaccgccgacggctgcgtcgccttctccgacgacatcgacatgctcaa

SEQ ID NO: 72263 - DNA, 471 bp, Zea mays
  unsure at all n locations
  Clone ID: LIB3078-007-Q1-K1-B12
cccacgcgtccgcaaagaggtcgtgtgagacttatattggctactgatcaaatgacttgagatacttgggatctcattagtgctgaaacaaagcaggcacaaagtagtcgggaaaatggtaattatgtgcttgatatagatgagggagggcacttcggagagtggtctctcattggtgagactattgctttcactgctattgctgttggtgatgttacttgttctactatcacaaaggagaaatttgactcaattgttgggccttttcctaaactttcgcaagctgattccaagattaaagaatctctggtaactctggagaatgttgcagatggtgatttcccttttaggagggtgaagctctcagatttggaatggaaaatgtgcatatatgctgctgattgcagtgaaattggtcttgtccaagtcaggggctatgagcagatgagaacnttaaaaggttttacatca

SEQ ID NO: 72264 - DNA, 406 bp, Zea mays
  unsure at all n locations
  Clone ID: LIB3078-007-Q1-K1-B4
ggccgctgtcggagatcgagccggacctggaggaggacgccatcgacgtgtaccgcaccagacggcatcagcccggaggacttcgagtacgggaagtatgacggacaccacacctatttcgaaggtcaagacaagaagggcttctgggaggatgtctccgagtggtaccaagaagctgagcctnctcagggctttcaagcactcatctcctgggcatttcctcctgcgatcatcctcggcatggctttcaatgtgccgggggagtacctgtacatcggggcggccgtcttcatcgtggtgttctgcgtcatcgagatgggcaagcccgacaagccgcacaacttcgagccggagatctacatgatggagaggtcggcccgcgacaagctcatcgccgactacaact

SEQ ID NO: 72265 - DNA, 403 bp, Zea mays
  unsure at all n locations
  Clone ID: LIB3078-007-Q1-K1-B5
gcagatcttcagcgagggtgggctggactacctcggcaacccgagcctgagccacgcgcggagcatcctcgccatctgggcctgccaggtcgtgctcatgggcgccatcgaggggtaccgcgtcgccggcggcccgctcggagaggtcgtcgacccgctctaccccggcggcagcttcgacccgctcggcctcgccgacgaccctgaggccttcgcggagctcaaggtgaaggagctcaagaacggccgnctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgagggggtgga

SEQ ID NO: 72266 - DNA, 398 bp, Zea mays
  Clone ID: LIB3078-007-Q1-K1-B6
caagcaaataagagcaaatcatagctgaccgatccaaacaacacgcccccgctctctcccgggtccctaagtgaaccaccctgtctggctaggcatggcctattgcgcatttgctccatctgcaccacctcaatattctgagcttaagatgactctatacacaaacaaggaggtgtatcgttctgggccagatcaaaacggagtaaccatcacagagagatcaaacatgggcacaacctgggtcttctcgtggcctgtagccgatgggccaacacctgatgcgaacatcgtcggccaactccagggcactagtgttcaagtagccaatactcccgttgtggtgtaccactactccctgggattagtgttcgaggataaaaggttcaatgggtccacac

SEQ ID NO: 72267 - DNA, 82 bp, Zea mays
  Clone ID: LIB3078-007-Q1-K1-C1
actacgcgtacgaccacgcgtaccgccgtttacccttggcggaggtttcaaccccttgggggtggcctacaaccccaaggcc

SEQ ID NO: 72268 - DNA, 465 bp, Zea mays
  unsure at all n locations
  Clone ID: LIB3078-007-Q1-K1-C10
cggacgcgtgggttctagtaacctcaggtatcagcttctggctggtgtgatcgagcaggggatgctggagccgttgctgcataaccagaagctactgctgagtgcaatgtgcttcatcgttcgtacgggcaacacattccttggctctttgctgtgggttgactatgccagatggataggcgtccagaagtctcacgaagaggcctaaagttctagcagcttgcctgcatgttccgctgtcactgcctcactaggcacgttcacaataccatcgatggcttgcctgcctctatagaatgctgatctactcttcactggaggcccccttatatataggacaaaaatcccaattttgtttggaaaaccacaagtagggatatatctgtcgaattctcgtatgcaacggcaacgccggtctaaccctcaactttnttttcccttttctactttgcaacatgcaacaag

SEQ ID NO: 72269 - DNA, 462 bp, Zea mays
  unsure at all n locations
  Clone ID: LIB3078-007-Q1-K1-C11
cccacgcgtccgcaaggccaacctattgaccctgagaagatgcaggagcattttgaggagttctatgaggacatctatgaggagttggggaagtttggtgagattgagaatctgaatgtttgtgataaccttgctgaccacatgattgggaatgtctatgtccagttcagggaggaagagcaagcagccgcagcatacaatgctcttcaggggcgcttttactctggccgccctataattgttgagtattctcctgtgaccgacttccgtgaagcaacctgtaggcagtttgaggagaacagctgcaaccgtggtggctactgtaatttcatgcatgtgaagcaaattggcagggatctcangaggaagctgtatgggcgttctgcttccaggaggtaccatgggagaagccggagccgaagcccgncaccacaaaggaggggccaccgtgaccgtgatgac

SEQ ID NO: 72270 - DNA, 396 bp, Zea mays
  Clone ID: LIB3078-007-Q1-K1-C12
gccactccttcacgcgatctgttatggtatgtggtaagatgagcaccaaggtagggggggaacaaatgcttaacctgctgatcaacatctattactacttctcttactacttcctcaacagcatgaagtccagcgtgtgtgacattgcaccaatcgttctgacaatgtccttcacattcgtcggcaactcaacctgcatctaagacatgatccaccacatgatccagcacttcacggacatgttcacgagcatggctatgttgcactgttacacacactagggcatagatgagatgatggttaccatggcatagagtgacatgaacaacctcgtgaacgaccatcagcactaccatgacgccactgacgacgatgatgactacgatgaggaggacg

SEQ ID NO: 72271 - DNA, 135 bp, Zea mays
  Clone ID: LIB3078-007-Q1-K1-C2
gctgtccgctgtcagagatcgagctttacctgcacgaggactccatctacttgtacgctcacctactacatcagcccggacgacttctagtactggaagtatgactgacaccacacctatttctaatgtcaatac

SEQ ID NO: 72272 - DNA, 209 bp, Zea mays
  unsure at all n locations
  Clone ID: LIB3078-007-Q1-K1-C4
agctttgtttagaaggactggatctggttctggtcacaatcganagcacaccgggcacggaagtcttctgaagtcactgatgccatccaaggctgttgattcggataaagcaaggccacaatcatcgtcgcgcaacgggagcacatcaagaagagctgtcatttcatcaagcaaaccaagctcttctggggatctaagcgacccgaacc

SEQ ID NO: 72273 - DNA, 425 bp, Zea mays
  Clone ID: LIB3078-007-Q1-K1-C5
cccacgcgtccgcccacgcgtccggtccttgctgagggtcgcctgatgaaccttgggtgggctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgt

SEQ ID NO: 72274 - DNA, 314 bp, Zea mays
  Clone ID: LIB3078-007-Q1-K1-C6
gaaaaggctgaaccggaagcccggcctgcataagagaaggcgagggcagaggctcttgccgtggaagagagggagaggaggagagcagagattgctgctaaggatgaagccgcagctaaagccagtgccgctgccattgaagctatcctagcccataaaaggaagacagagaatgaacgaggagcgcctgctcctgatgcaaacaccctgcatggtggctttctcagcaagctaggctttaaaacaaccggcgaacgggcacttcaaggcaatccaacacaaagcggagactatggaaaacgggcacttcatgg

SEQ ID NO: 72275 - DNA, 176 bp, Zea mays
  Clone ID: LIB3078-007-Q1-K1-C8
ccaaggcttccgaacccggggttatctggacttcagagacactgtccagtgcgtgaagcgggcattagccaacccagccaaacctggcgagttcagagtcttcaaccagttcaccgagcagttctctgtcaatgagctagccaaactggtgactgcggcaggagcgaaacttgggc

SEQ ID NO: 72276 - DNA, 310 bp, Zea mays
  Clone ID: LIB3078-007-Q1-K1-C9
aatacacctcaagaatttagttcttctatatgtcactccattatcgggcgggttctacacattgtcacgcaatgattacatcaattatccccatcaataccacactgtcaacctcaaaatttcacctatcctcaacaactacaaatctactaacacactttaaaattaatgttctccagcaataaacatagtttgtcaggcacaacaagtccgatcgaagctttcacttacatgagatccatactgcaactcatagtctcccacacattgaactgacagatagctaattgatacaaatgttaatacttat

SEQ ID NO: 72277 - DNA, 79 bp, Zea mays
  Clone ID: LIB3078-007-Q1-K1-D1
aagccttcggccaagccttccgggaccccttggttaaacttaacctgttaatccgctttcaaacttggggggcattcct

SEQ ID NO: 72278 - DNA, 406 bp, Zea mays
  Clone ID: LIB3078-007-Q1-K1-D10
gaatggttcagctccatcacatccccacaacagaagacaagataacagaatggatggtggagaggtttaggcagaaggaccagctcctggcagatttcttcatgaaggggcactttcctgatgaaggaactgaaggagatctgtcgacgccgaagtgcctggcaaacttcttaacagtagtatgcttgacggccatctgtttgtacctaactcttttctcatttgtgtggttcaaggtctatgttgtagcaagctgcgcttacctctcatttgttacctattactccatactaccaccccaactgataggttcaccagagggtgatgtcaaggccaaaaaggttgtgtagatgttgatgtaacttgccatgaaaactgtacatccgcaaacgatttttactgctgg

SEQ ID NO: 72279 - DNA, 311 bp, Zea mays
  unsure at all n locations
  Clone ID: LIB3078-007-Q1-K1-A5
acccacgcggtccncgaccccttggccgaccccttggttgtaaaagtggctttaacagttaccaaggatttgggccactacaaatctggatggtccaaccccataaccggtggcattttgggtggccatgccgtcaagttgattggatggggaaccagtgatgctggagaagattactggcttctggcaaatcagtggaatagaggctggggcgatgatggatacttcaagatcataaggggcaaaaatgaatgtggcatcgaggagggcgtttgtgctggaatgccatccacaaagaatatggttccaaa

SEQ ID NO: 72280 - DNA, 158 bp, Zea mays
  Clone ID: LIB3078-006-Q1-K1-G7
ctgactcgttctggcatgcgtacaagagactaccgattcaataccgaaggcaagactagtagagcatggtttgaattgtgacgaccatggcggctaccaagaacgcgtgccagactcatgacgagctttacgtcatgatggtcaatgccaaggcacaa

SEQ ID NO: 72281 - DNA, 222 bp, Zea mays
  Clone ID: LIB3078-006-Q1-K1-G8
tcgtcccactccgcttgtgggttccacgattttatcacgatgtgacgatacgagatcattggttgaatttctggagaccaaggccactatcctgatcgagttccttatcaagaaccatgtttaagacattatgatcgatgctatggctcaagaccatattagagtcatcaccatatataagcacttgcacaatccattcctgatagatggccacagattacg

SEQ ID NO: 72282 - DNA, 418 bp, Zea mays
  Clone ID: LIB3078-006-Q1-K1-G9
ccaagatcatcctcgatcgggagacgcagaggtcccgcggcttcggcttcgtcacctgctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtcc

SEQ ID NO: 72283 - DNA, 428 bp, Zea mays
  Clone ID: LIB3078-006-Q1-K1-H10
cccacgcgtccgcccacgcgtccgagacaagtggtttccaaagccaagtgtgtgctagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgtcaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgag

SEQ ID NO: 72284 - DNA, 431 bp, Zea mays
  Clone ID: LIB3078-006-Q1-K1-H11
tccgtcttgaggcgaagcgtaggtgcttacgagtctgccatggccagcgagaatgaggtatttaggttcgaggaagtcgccaagcacaacgtcaccaaggactgctggatcatcatcgccggcaaggtgtatgatgtcactccttttatggatgagcatcctggtggagatgaggttttgctagctgtaactgggaaagatgctacagctgattttgaagatattggccacagcgattccgcaagggacatgatggagaagtaccacatcgggcagatagatgcttcaacaatcccagcaaagcgaacttatgtgcacccccagcaagcgcccaggcactcagacaagaataatgatctcctcatcaagatcctgcagctccttgtgcccattatgatcctgggccttgcatttggtatacgtcagtacac

SEQ ID NO: 72285 - DNA, 431 bp, Zea mays
  Clone ID: LIB3078-006-Q1-K1-H12
gcgatccgaagaagacatgcctcaggaccctggaaaaaccgatgaagcatcatcttgggggaatatgggagaagagcttggtgacttaacaccacaggcagaggagtatattattcagatgcaatctcatttgaatgccatgaaaaaggagttacatgatctcaggagaaagaattctgccttacagatgcagcagtttgttggggaggaaaaaaacgacttgctggactatttgaggtcattaacaccagagaaggttgctgaactatcagaatcgacgtctcccggtgtgcaagaaactattcattctgtggttcatggtttgcttgctactctttcccccaaggtacattcaaaggcccctccaccgctagataacatttctggtggtgttctaaaccttgggggcgaggatgatgatcgtgcagaac

SEQ ID NO: 72286 - DNA, 444 bp, Zea mays
  unsure at all n locations
  Clone ID: LIB3078-006-Q1-K1-H2
ccccgctccgcttctgcaggccacggctgggcgacaccctgatggcgtcgcctcctcccgtggcgaccgcggggcctcacagcgtcttcgtgtacggcacgctgatggaagaggaggtggtgcgtgtgctcctgggccgcgccccgccctcctcctcccccgcgctcctccccgaccaccgcaggttcagcctcaggggccgcgtctacccggccatcctccccgcccgcgcccacgcggtgagcggaaaggttatccaggggctcaccgacagggaactccatgtgttcgacatgttcgaggacgaggagtatgtgaagacaaccgtcgaggtctcactgactgatgcatcggagaaatcactcgcctacgcctacatatggggtaaccagggtgatcctgacctctacggngaatgggattttgaggagtggaggaaggtgc

SEQ ID NO: 72287 - DNA, 439 bp, Zea mays
  Clone ID: LIB3078-006-Q1-K1-H3
cccacgcgtccggattcttgaagagatcgagcttcttttgcaccacaagggcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatc

SEQ ID NO: 72288 - DNA, 221 bp, Zea mays
  Clone ID: LIB3078-006-Q1-K1-H4
tcgctagaacgcgatctacaagtagctggtctgaatgtaaaccaagtccttacaaggtgtcttttcgctggactgtgtttccatgcataccaacaggtgtcttacatgattttggcgatggtgtctcctgtcactcattctgtgggcaactgtgttaaacgtgttgtggtcattggaacatcagtgctgttcttcaggacacctgtttctcctatcaactc

SEQ ID NO: 72289 - DNA, 445 bp, Zea mays
  Clone ID: LIB3078-006-Q1-K1-H5
ctccgccctctgcgaggccaccggcgcgaatgtgactgaggtggcttacgccgtgggcaaggacacgaggattggccccaagttcctgaacgccagtgttgggttcggtgggtcttgcttccagaaggacatcctgaacctggtgtacatctgcgagtgcaatggccttgccgaggtggccaactactggaagcaggtgatcaagatcaacgactaccagaagagccggttcgtgaaccgcgtcgtgtcgtccatgttcaacaccgttgccggcaagaagatcgccgtcctcggcttcgccttcaagaaagacaccggcgacaccagggagaccccggccatcgatgtctgcaaaggcctgctgggtgacaaggcccagatcagcatctacgacccccaggtgacggaggaccagatccagcgggacctagccatgaacaagttc

SEQ ID NO: 72290 - DNA, 415 bp, Zea mays
  Clone ID: LIB3078-006-Q1-K1-H7
caagcatataccagcgactgagcgagcgttatgcagtacacactgtacgcagctcgctgtgagcatctgcggcggctctgatggcggcctgcatgatctgctagttagctctcgcggtggcgctttacggcctgcccggcttctgacaccgcgactgctgacttcacgtcatctgctcccagaagaagatcaagaccgacaagccctaccggattgggggtggcctgaccgtcgtacttcacgccaactgcataaagggctaggtcaagtgcttgtaccacttcttcgaccaatactgcccgaacgtcgacggattcagcctaatctacaacgaggatgactgggctcccaccggacacatctacctctggggaactactgggcttctgatctgggccgttaccctttatgggat

SEQ ID NO: 72291 - DNA, 323 bp, Zea mays
  Clone ID: LIB3078-006-Q1-K1-H8
tcgctaggatgcgatctagaactagctggtctttatgtaaaccaagtccttacaaggtgtcgggtcgctggactgtgtttccatgcataccaacaggtgtcttacatgattttggcgatggtgtctcctgtcactcattctgtgggcaactgtgttaaacgtgttgtggtcattgtaacatcagtgctgttcttcaggacacctgtttctcctatcaactctctcggtactgcgattgcacttgccggagttttcctgtactcacagctcaagcgacttaagcccaagccgaagaccggttaaataagggattgtattttcca

SEQ ID NO: 72292 - DNA, 426 bp, Zea mays
  Clone ID: LIB3078-006-Q1-K1-H9
ggtatggcagctaccctcgccggtgtatgcaaggtgcctctgacatctgtcctactaggttttgagcttacacaagactatcgtatagttctacctttgctcggggctgttgggttatcatcctggattgcttctcctcaaaggttctctaaaagaattaggagtaagctggattcttgggaggataaatcgagtattcctcagcaagcaaacgacatgctcactgaaaacaaagaggccacttccatggatgcagctgatttgtcgttagaattatataaaattgaaagctccctttgtgtctatgatgccaacgacagcaatatgttcaaaaatcttactgttggtgaggccatgaaaactaactacttctctgtctcaatgacaaccccattaattgaggcactagatcttatgcttgccgag

SEQ ID NO: 72293 - DNA, 367 bp, Zea mays
  Clone ID: LIB3078-007-Q1-K1-A10
ctaacacccgttacccggtggtggtgcggttcaacaaggtgaactacgccggcgggtcggccaacaactatgcctgggacgagatcctcgaggtgaaatgagtgaggccagtctgctcaaggaccccatgctcctgtgtgatttgtagttgtgaagtgaggctgctgcctagctgctacgttagctgctagcgtcacaacatcaatcttgtaatggcttaatctccacagtcatcatgtaatttattgcatgcttcattcaccgtggactcaataatctctcttgctctaaaatcgatgtattcgtttttcttgtgattttgtacatgcacataaatgtctctctggaaacattgtttgtgctaaca

SEQ ID NO: 72294 - DNA, 480 bp, Zea mays
  Clone ID: LIB3078-007-Q1-K1-A12
cccacgcgtccgcccacgcgtccgcgaagccgcccgcacccatggcctccggtgggctggcctgcacctacgccggcctcatcctcagcgacgacggcatcgccatcaccgccgagaagatcgccaccatcgtgaaggcggccaacatcaaggtcgagtcctactggccggcgctcttcgctaagctcctggagaagcgcagtgttgaggatctaatcctctccgttggatctggtggtggcgctgctccagttgctgctgccgccccagctggaggtgctgcagctgctgctgcccctgctgcagaggagaagaaggaagagcccaaggaggagtctgatgacgacatgggcttcagcctgttcgactgaggaggccctcgctacccagccattagcaaattcccttatgctgtccaagacttatcttacgctatgtctgtagccttttggtattacaagtactcaagttttgagtttt

SEQ ID NO: 72295 - DNA, 299 bp, Zea mays
  unsure at all n locations
  Clone ID: LIB3078-007-Q1-K1-A2
ctcacgagcagcagaccggccgtatgcactgcgacgccgcccaataagcgcgcgaggaggccgtcgaggatctcgtgcagggcgtccggcgatgacaaggacaaggtcccgtcgtcggaagggagcgatcttggggtcaagcagctcgggaagctggccatggtcgcgctggccgccggcgtgctggtgctcggccccgtcgacggtgccgtggcggccaagtccggcggcagggtcggcgggcaggcgttccggtccgngccccggtcgtccggccctcggatcaacaactccaggac

SEQ ID NO: 72296 - DNA, 152 bp, Zea mays
  Clone ID: LIB3078-007-Q1-K1-A3
tcgcgacccgtcaattttcggttggccttttaaaacctgaaaggggcccactgtttaacggcctttggaacctggggtttttaccttcggtttcgggatttcggggttaaatgggccccttttatttttatttaccttaattccttttaagg

SEQ ID NO: 72297 - DNA, 136 bp, Zea mays
  unsure at all n locations
  Clone ID: LIB3078-007-Q1-K1-A4
gcggccaaggtgggcatcatgggccgtagcgccagcagcaggggcaggctgcgcgcgcaggccacctacaacgtgaagctgatcacgccgganggggaggtggagctgcaggtgcccgacgacgtgtacattctgg

SEQ ID NO: 72298 - DNA, 448 bp, Zea mays
  unsure at all n locations
  Clone ID: LIB3078-006-Q1-K1-G5
cccacgcgtccgcccacgcgtccggcatcagcctcgcccgccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaaaagactaaacataaaggcactgagggtattattcagattgaaaatccaaacttggtgaaagccaagaatataaaggccaaggaagttgattttggcaagacaactgaactctcaaggcgtgaaagagaggagcttgagaaacanaaagctcatgaacgttatatgaagcttcaggagcaaggaaaaacagaacaagcacgnaaagatttggaac

SEQ ID NO: 72299 - DNA, 347 bp, Zea mays
  unsure at all n locations
  Clone ID: LIB3078-012-Q1-K1-A11
cggacgcgtgggcggacgcgtgggctgactcgtgggcggacgcgtgggcggacgcgtgggcggacgcgtgggttgagaggtttgatcgtnatcgaagtggcaggatcgacatgtcagaactgcgcgatgctcttctcagtctcggatattctgtgtctccaactgtccttgatctgcttgtgtctaaatttgacaagactgtgggcaagagcaaagcaatcgaatatgacaacttcattgaatgctgcctcactgttaatgggctgacagagaagttcatggagaacgacaccgcctactttggttcggctactttcacctacgaggcccttcatgctgaccgtgct

SEQ ID NO: 72300 - DNA, 438 bp, Zea mays
  Clone ID: LIB3078-012-Q1-K1-A12
cgggagtctccgcagggctcaccgggaccgcgggtccacgatggccgccaacttctgggcgtcgtcgcactgcaagcaggtgctggaccccgaggacgtggacctggtgccggcggcggaccgggagcgaggcatcacgccggaagagttccgcctcatcaagatccatatgtcgttccatatctggaggctagcacagcaggttaaagttaggcaaagagttgtagctacagcaatagcttacttcaggcgtgtgtatacaaggaagagcatgtcagactatgatcctcgtttggttgcacctacttgtttgtatttggcatctaaggtggaggagagtacagtgcaagccagacttcttgtattttatataaaaaagatgtgtggttccgatgataagtatcggtttgaaaataaggatattcttgaaatgaaatg

SEQ ID NO: 72301 - DNA, 413 bp, Zea mays
  Clone ID: LIB3078-012-Q1-K1-A2
gcctcgaggaggcgttcaacataaccgtcgacgaaacaagcgcacaggacatcgcgacggtgcaggacgctgcagacctcatcgagaagctcatgctggaggcgcctccaaaggtcgtctagatcgatccatcagccttgtgatcggcgacttggcattttatgttaaattgttcatgttacccaatttgttctttattgatggttcaagatgagatttttgtatggatgttgctgaggtataaattagatgctccaaaggctgcatggagcagatgaagacgatgtattccacttcccatttgcatgttgtactaccatagagagatcaatgaactgttatgaagagtcactgcaactatggcttttgatctttgggaagtcaaaaaaaaaaaattaaaaaaaagggcgggc

SEQ ID NO: 72302 - DNA, 373 bp, Zea mays
  Clone ID: LIB3078-012-Q1-K1-A3
cgacgatgcgctcgccggacggcaagaagctggacatgctagcggaggaggacctcgggagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagccggaggagttcatgccggagcggttcgtgcaggaaccgggcgccgtggacgttcacatgaagggcaaggacctcaggttcatcccgttcggctccggccggaggatctgccccgggatgaacttcggattcgc

SEQ ID NO: 72303 - DNA, 308 bp, Zea mays
  Clone ID: LIB3078-012-Q1-K1-A4
gggacacgatcgccatggccgccacatctaccgccgtcgtcgtgctgtgcccgccgtcgatggccgggctccgcctggcgccgtctaccggccgggcgcgcgtgtcgttccgcgcggcgccggtgccggcgcggtagtccgtggcggcgcgcgcggagctgagctcggcgctggagatcagcctgagcacgggcgtgtcgctcttcctgggccgcttcgtcttcttcaacttccagcgggagaacgtggccaagcaggtgcccgcgcagaacgtgcagacgcacttcgacgccggcgacaagcgcgcc

SEQ ID NO: 72304 - DNA, 361 bp, Zea mays
  unsure at all n locations
  Clone ID: LIB3078-012-Q1-K1-B1
ccccaagctacctgaccggcgagttccccggcgactacggctgggacaccgcggggctgtgcgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggttcaaggccgggtcccagatcttcagcgagggcgggcttgactacctcggcaacccgagcctgatccacgcgcagagcatcctggccatctgggcgtgccaggtggtgctcatgggcgccgtcgaggggtaccgcatcgncggtggcccgctcggggaggtggt

SEQ ID NO: 72305 - DNA, 439 bp, Zea mays
  Clone ID: LIB3078-012-Q1-K1-B12
cccacgcgtccggcggtggcgggcgccgtgatggcggcggcggctacggcggtggcgggggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaaggaaaaaatggtgcttcttggtgctgcaaa

SEQ ID NO: 72306 - DNA, 358 bp, Zea mays
  Clone ID: LIB3078-012-Q1-K1-B2
gcggcaagcgaagacgcgcaggatgggccgctgccggtgcttgagctaccgcagccggggagagctgctgagctacctggtgctcagggcgtgcggcgacacggccgccacggagaacgtcaagatcaacgtggagcgcactgcgcctgagtccgtgctgtccgaactcgacgtgcagcagctcaccgagatcccgtgcgagaatagcaagttccagaggacctactacagctacgagacgtgctacctgctgaacgtgaaggactatgtgtacgaccgacgcgcacgccaaggagcacgccgagcacggcgcgggataccttgtcggcttccccatcggcatgagcctctcctggga

SEQ ID NO: 72307 - DNA, 420 bp, Zea mays
  unsure at all n locations
  Clone ID: LIB3078-012-Q1-K1-B3
cccacgcgtccggcatttctggcgctgcggctgaattgctggcgccggctggttcctgcaacctgcagcccgagccggagtttcggccgccgatgtgggaagtcttgcagtcgctggtgcgccagcgcttggtgcaaagggcgaacatggcgaggacgcagtcgcactcgcggcgccacggcgaacccgttactgcttcaagagatgttctcgtggtatgctcatctactggatggacagatgaaaagcacatgctttatcttcgattattggaagaaacatttgtgcaccaattacatgggaagtgttgcatttttaagggactgtttaattgctctncaagatattgtaggcaaatgaaatcatctaagcaaatngttaaatacactacgcctgggtcagggtgtgccatagttgagg

SEQ ID NO: 72308 - DNA, 266 bp, Zea mays
  Clone ID: LIB3078-012-Q1-K1-B4
ccctcgcctagtgctcagcagcggccgatgcatactcgttcgcgtccgtcggttcgggcgtatgtgctgcacacgatgaactctcggttgccgagcctctagagagccatggctggggctctgcagccgtcgtgccgactggcagctgtcgcgtgtacctagctcgattagcagcagctatagtaactgagcgagggcgtacatcaagcggagtcggccagctccgtctccgtatgcgaatctgagtcgcgcactcgtgatcttga

SEQ ID NO: 72309 - DNA, 240 bp, Zea mays
  Clone ID: LIB3078-012-Q1-K1-B5
gctacctgaccggcgagttcctctgcgactacagctgggacaccgtgttgctgtacgtttaccctgagactttggcctagaaccgcgagctggaggtgatccactgcctctgggccctgctgttcgcgctcaggggcaactttgcggagatgctcgcccactacggcgtccagttcggaaacgccgcgtggttcaaagacgggttccagatcttcatctaggacggacttgactacctaa

SEQ ID NO: 72310 - DNA, 282 bp, Zea mays
  Clone ID: LIB3078-012-Q1-K1-B6
gcggccacgcatccggtgaaacccgcgcctctgttcaaggaattgaaatatgaatacgtggcggcttcatagagaaagtaggcggggagtcaagcttgagagaagctcataagcagcagctgatgctcaagcctacaaagttgctaaccagctcaagggcacaaaattatctgatggaggaacaaaaaaggaaccgaagaaacaatctggtggctcaaaatcgaagacagctgatgctgacattacagtagcaaagatggatattataatggggcttatcag

SEQ ID NO: 72311 - DNA, 286 bp, Zea mays
  Clone ID: LIB3078-012-Q1-K1-B7
tactcctccgaccactcctgcgtcacatgcgctcattgtctattgcacgagcccgcttgcactagcgccttacttcctgaccgaggattctagcgccaacctgagcagcaccataaccgcccgtacgaccaacattagctccaacggcgaacttcgggcggacgcactcatacttgcagctcaacctgtaaaccaggactgctatctgagaaataccgcccggatgctcaacaaccctatggacaaacgaaaaacacatgcgttatcatacaacctttgcataaac

SEQ ID NO: 72312 - DNA, 155 bp, Zea mays
  Clone ID: LIB3078-012-Q1-K1-B8
cccacgcgtccggtcccgctgaagttgtcagtcaagcaggcattgtatgttgcaccggtgatgtcctatgtgcatgggcgtgcgttcattcatatagatcttacatcgcacaacctcctgatttctgctgataaagccattactattgctgactt

SEQ ID NO: 72313 - DNA, 403 bp, Zea mays
  Clone ID: LIB3078-012-Q1-K1-C1
ctggactacctggggaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgtcgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactac

SEQ ID NO: 72314 - DNA, 435 bp, Zea mays
  Clone ID: LIB3078-012-Q1-K1-C10
ggccatccttccgccgccgcggactgcgtctaatcttccttctccagcagccgggcgtgcccgtcgtcctcgatcgtcccctggactggatcgcaacggagatccagccggacctgcggtggtcccttccttttctcgatagcataatgagctcgccaatggagaggtgattcgtcaggctggtatcaagttcctagtccatggtgcctggatgagcagtagagatgctactggccgtggaaggaggagggttcttctcgtcttcagctacaggttacagccatggcctcgccctcttgctgcttggacgcaaagctgaggagaagcccgtaaaggtctcgccgtggaaccagtaccggctagtcgaccgggagaccgagcaggtgtaccacctgcccttcgccaaggaccaggcttctgggaaatgtgctccct

SEQ ID NO: 72315 - DNA, 435 bp, Zea mays
  Clone ID: LIB3078-012-Q1-K1-C11
aaaagaaagagtaaataataaaacaggatattctgtttcataattctgaaatagaggtgttttttttagtattactcctcattaggatgtatatattaatcatcctattttaatatatattaatcatcctattttaattaggttctaatccaattagtagtaagtattttcttttttatttaatagtctctgactatcattaaataaagggtagagcaattcttttttctagagattctagagaaagtgagacaaagtgaagcgaaagagttttctttgtataagaattaggtctatatcatatctaaatagaagggaaatcaaaaagaagggaagtggggattacattggatgaatccttaaggaagacatatcacaaaagaaataaaggctaaagtaagcgctccttgcctttggtttgagcaaaacagattc

SEQ ID NO: 72316 - DNA, 442 bp, Zea mays
  unsure at all n locations
  Clone ID: LIB3078-011-Q1-K1-G3
gtctatcagaacctacctctgggtctatttgcattcagaagtatgatgatactgggaagcctattggcttgcctgaactgctaacttctcaacgagttggaattgtatttcagtttcctgagaggtatttcttagcggatactgtacttgaagaagttacttttggatggcctaggcaaaaggcagacctcctattaaaagaacagctcgctttaaatcttcaaaatgcttttaactcggttggtctgacaaccatctcattagatgaaaatccgcaagctctaagtggtggatttaagaggcgacttgctttggcaattcaactggttcaaattcctgatctgttgctgcttgatgagccacttgctggtctagattggaaggctcgagctgatgttgtgaatctnctaaaggacctgaagaaacatcatactatactggt

SEQ ID NO: 72317 - DNA, 329 bp, Zea mays
  Clone ID: LIB3078-011-Q1-K1-G5
cgcgcacatcgaccgcctccgccgtgccgtccacgacgtccgtggccgggctacgcctggcgccttctaaaggacgggcgggcgtttcataccgcgcattaccggctctcctctcgctacatcacggcgcagctcacaactttcacttcgtcgctaactatcataatatccacttccctgccaatattaaggtgacgaatgaccacgcataactgccagtcgatgaccagggctatattctagagaatgaagccctgaaccatgcactggaaaaccttaagacctaactctatggaaaggaagggcttgcctacgggacactcaatctt

SEQ ID NO: 72318 - DNA, 443 bp, Zea mays
  Clone ID: LIB3078-011-Q1-K1-G6
gctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtccggcctgctccttatctctgggcctttcaagatcaatggagtaccgatccgccgtgtgaaccagacctatgtcattgctacatcaaccaaaagtgacatctctggtggtgatgtc

SEQ ID NO: 72319 - DNA, 318 bp, Zea mays
  Clone ID: LIB3078-011-Q1-K1-G7
agccacgcgtgcggttcagaagacgatgacacacatactgtattaagctgcatactcccacgaggcaccatgagcggattgtatgcagaggaggggggtgaaagagagacgtccgagctattcgttctgaaatcccaaactacgtgtttgtcgtgaagaagtcaaacatttttggacaatctcaagatatggtcttcttcagaacatatcctgatgtatgtctcccattcaagagcggagcgttgattcttcagtgtcatggcaagagctgtgaagtgatactagaagttcggaacgatcaaggtgaattcaaaaagc

SEQ ID NO: 72320 - DNA, 439 bp, Zea mays
  Clone ID: LIB3078-011-Q1-K1-G8
acgcgtccgcggacgcgtggggcctcatatatatagtttctctcctgccacttttgcgagcttacccggagcactccgacggtacagggggcacctcgtttcctctcccgtctccgagatgacgaagcgaaccaagaaggccggaattgttggcaaatatggaaccaggtatggtgctagcttgcgtaagcaaatcaagaagatggaggtatctcagcactccaagtatttctgtgagttctgcgggaagtttgctgtgaagaggaaagcggttgggatttggtgatgcaatgactgtgggaaggtcaaggccggtggtgcttacaccatgaacactgctagtgcggtcactgtcatgagcacgatccgtctgttgagggagcagactgaagcatgatcggtcgcttgtcaggcatactgggggtcactatattggctg

SEQ ID NO: 72321 - DNA, 292 bp, Zea mays
  Clone ID: LIB3078-011-Q1-K1-G9
cactttaataaacactctcctaactatttcaacacattcttcaaccacccccccctcaagcacaagctccgcatctttcttcaaaaaaaaactctgaaaatattcccccgcccgacttcttgtcctctaccccccattgttcaattccagactttaaagtacaacattaagtcaatggcttggagaagctttaccctttaggaacttaaagctgcttgcatcccaaagaaacttgctccaaccatttgtatttctgttgatcacccccgcaaaaacaaattcctttaaggac

SEQ ID NO: 72322 - DNA, 158 bp, Zea mays
  Clone ID: LIB3078-011-Q1-K1-H1
gttcagaagacgatgaagcacattctggttctaggtgcatacttccacgaggcaccattcgtgatagtatgccgaggaaggaagtggaagagagacttccagctatttggtctggaattccaatctaccgggttgtcctgaaaaaatccaaccttttt

SEQ ID NO: 72323 - DNA, 445 bp, Zea mays
  Clone ID: LIB3078-011-Q1-K1-H10
ctttcctaccttcttccctccgtctcccatctcgcgcaggcaggcgacacagcgacgctgagaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaagctccaggagattcaggacgagctcgagaaggttaatgaggaagcaagtgacaaggttatggaggtggagcagaaatacagtgagattcgcagacctgtctatctcaagaggggtgacattatcaagaccatcccggacttttggctcacagcgtttttgagccatcctctactaagtgagcttctgactgaagaggatcagaagatattcaagtacttggactccattgatgtcgatgatt

SEQ ID NO: 72324 - DNA, 368 bp, Zea mays
  Clone ID: LIB3078-011-Q1-K1-H11
ccgagaccttcgccaagaaccgcgagctgtaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaag

SEQ ID NO: 72325 - DNA, 329 bp, Zea mays
  Clone ID: LIB3078-011-Q1-K1-H12
cgtccgcccacgccttcgcccacacgtacgcgtgtgatttaagccccacggaacaccacatattttggagtctaccgcggggaggtgggccaactcatcgcctaaatcttcttatggatggtcaagttctgtaacgacaatgtggcataggagatgccctgatcttcgtacgtcactttgcctactaagcattcacaaaatctcattataagttctgagaacgccaagccaattgttcagtatattacaaaagtcaggttggagaactcccttgttcaggctttagtctttcttctgcacaacgagagataacctgctgcatgacatga

SEQ ID NO: 72326 - DNA, 423 bp, Zea mays
  Clone ID: LIB3078-011-Q1-K1-H2
cggacgcgtggggcctcatatatatagtttctctcctgccacttttgcgagcttacccggagcacgccgccgctacagcccgcacctcgtttcctctcccgtctccgagatgacgaagcgaaccaagaaggccggaattgttggcaaatatggaaccaggtatggtgctagcttgcgtaagcaaatcaagaagatggaggtatctcagcactccaagtatttctgtgagttctgtgggaagtttgctgtgaagaggaaagcggttgggatttggggatgcaaggactgtgggaaggtcaaggccggtggtgcttacaccatgaacactgctagtgcggtcactgtcaagagcacgatccgtcgcttgagggagcagactgaagcatgatcggtcgcttgtcaggcatactgtggtccactata

SEQ ID NO: 72327 - DNA, 390 bp, Zea mays
  unsure at all n locations
  Clone ID: LIB3078-011-Q1-K1-H4
ggctggcggagtggttcaagagggacgttttcacgtcaccgttcgaggagctgcacggggcgactctgttccacgagagcatggggagcctcgacgcagatttccacgacatggcgagcgaggccttggacgcccacgacaacttcggcatcgagatagctatgcgggagttcagggacttgttcgaggggatccagtccatgacctactgctgcggtaacttcggtgatgacaagggtgccagggccattgtcaaagccttcccacacataaaatgcactgtgctggccccttccaagatcattgccaccaaaccgggcgatggagcgatgatnaactatgtcgaaagtgacatgttcagtttcattccacctgctcaaactgtcgtgc

SEQ ID NO: 72328 - DNA, 436 bp, Zea mays
  unsure at all n locations
  Clone ID: LIB3078-011-Q1-K1-H5
cccacgcgtccggcttctcgcccgcaacttcgtcaagttcggcgaggccgtgtggttgagggccggctcccagatcttcagcgagggcgggctggactacctcgggaacccgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctngctgaccacattgccgaccccgtcaacaacaacgcttgggcctac

SEQ ID NO: 72329 - DNA, 430 bp, Zea mays
  unsure at all n locations
  Clone ID: LIB3078-011-Q1-K1-H6
gtcttcttcctggagagaaaaagcagtttacaatacaaagatgtccaagatggcggaggagaaggcggcggcagtgggcggactcggaggagccggggcggcggacgcggcgcagcagcagcagctggcagcaggggaggccgcggcggctcgggtgcggcccgtggaaacgctgcttcgcgcggcaccgctggggctctgcgtggccgccatgaccgtcatgctacgtaaccagcagagcaacgagtatggcgccgtcgcctactccgacctgggaggcttcaagtacctcgtctacgccaacggcctctgcgccgnctactcgctggtatccgcgttctacactgccgtgccgaggcctgccaccgtgtcgcgctcctggctcgtcttccttctcgaccaggtgttcacgtacctgatcctggcggcg

SEQ ID NO: 72330 - DNA, 60 bp, Zea mays
  Clone ID: LIB3078-011-Q1-K1-H8
gccgggggggcggagtgggtcaagagggacgcgtgtacgtcaccggtcgaggagctgcac

SEQ ID NO: 72331 - DNA, 363 bp, Zea mays
  unsure at all n locations
  Clone ID: LIB3078-011-Q1-K1-H9
gtccgcccacgcgtccgacatcacttcanccattttatttttctataaacatagatctnaacagtcgtccgaatttttaaaatacctagcctcaaaacgncttcaaccttcctgggaccaaccttcttatatcacatcttctgaatttttatctccaagatgttgttccatgatactgtcatgattgtcgatacacatcctgacaagactgatcatgattttgtacccatgctattaaagattcctccgatgtttgatccatgtggtggatacaacatcataggctctggtgatatccttcttcctgagctgttggttgctattgcattaacgcatgattgggctgccaagaagacctttcaa

SEQ ID NO: 72332 - DNA, 501 bp, Zea mays
  unsure at all n locations
  Clone ID: LIB3078-011-Q1-K1-G2
tcgtctcgtcggatctntngtgggtcgactccaaacgcgtccgttctcacgnnngtccgcccacgtcgtctcgtcggaccgcggtgggtgtggctttggcaagagccatggctctggatctgcnatgagaactggctcaaggctcaactcataccttataaaggatnactggagcttggtcttgtaaaactanntggagcatgctgctttgcaccacgtaacatgatatcgcatgtngctggtgtaactaggtgagaaatatgggtgtggaatgtggagaganngagagaaaaaacaacggtagtgtagtccaacagtctctgatcattggatgtgagaggcatcgagatctctgggatggctcatgcatngggtcaatgggtgtggcttgagaatctggaacttttgtagcccatcaacttggtttcccagaaaccatgtaataagggtgacctgtgtatagctatgagacatcaacatatcttgctgctntgtgtgtca

SEQ ID NO: 72333 - DNA, 523 bp, Zea mays
  unsure at all n locations
  Clone ID: LIB3078-011-Q1-K1-E4
tgctcgtactcggtctcggaanttnncccgggtcgactccacgtcgnntccgagcagtgcaacaagggcaagatttaacctgcttcanntcgatcatatcgtcaactggggtccggcaggtgtcgcgaacaccatnngagctccacggagtggcggcgnngcggcggcnggcggcgccaagacagtcgtggccctgaggggtggtcgggcttganngcgtggaggggacgccaagaagggtggatcctcaaggggacaagccgnngacgccgacatcgtggtgggctgcccgtcggcttccgtggtggaccgcggattnatcgcccttaaccgtnngtccgcatcttcgtcgacatttcgtcgcccagacccgccccacatcggcttgagtaatatanntaagctagccgctttatttcctttcctttgcnncccagaactttggaaatannaatatattataccgnnatgaaatataccgcgggcattgcnncgaataatggganntgtgtgannattctca

SEQ ID NO: 72334 - DNA, 436 bp, Zea mays
  Clone ID: LIB3078-011-Q1-K1-E5
ccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagca

SEQ ID NO: 72335 - DNA, 444 bp, Zea mays
  Clone ID: LIB3078-011-Q1-K1-E6
cggacgcgtggggcagcaccgcggcgatataatgagcagcctgtcctccggcatcggtgcctcgccatctgcagcgcccagcaccgctcggcgccgccatgacgcagcgccgcagcagctgagggtgaaggcggcggcgcggccacagctgctgcacgccggccgccggcgttcgagtgtcgggaggaggccgggcggcggcgcggtggtggtgagggccgggcctgggccgctgtcggagatcgagccggacctggaggaggacgccatcgacgtgtaccgcaccaacggcatcagcccggaggacttcgagtacgggaagtatgacggacaccacacctatttcgaaggccaagacaagaagggcttctgggaggatgtctccgagtggtaccaagaagctgagcctcctcagggctttcaagcactcatctcctgggcatt

SEQ ID NO: 72336 - DNA, 293 bp, Zea mays
  Clone ID: LIB3078-011-Q1-K1-F1
cggacgcgtgggctaccaatgggtgcatatttacaggaccacattttaatccaaacaatgggacacacggtgcaccagaagacgaaatccgtcatgcgggtgacctgggaaacattgttgcaaatgctgagggcatatccgaggcaaccattgttgatacccagatttctttgactgggccaaattcaaatgttgggagagcgtttgggggtcatgagctttgaaatgatttggggaaaaggggccatgagctcagactctctactgggaatgctggtggaagactggcatgt

SEQ ID NO: 72337 - DNA, 423 bp, Zea mays
  Clone ID: LIB3078-011-Q1-K1-F11
ggaattaccggccggacgcgcacgcgtccgaattgactgccttcacaatagtgctgttatttagcttatgagaggactgataaatcaggttgcggaacttataactgggttgggtgcacaagaccttgatccaatgagcttgagattgtcccacagcttgtctaggtataagctgaagttcacccctcagaaggttgatacaatgatcattcaagccattggattattggatgatcttgacaaggagcttaacacttatgccatgagagttcttgaatggtatggctggcacttttcagagctcaccaaaatagttacagataatatacagtatgccaaacttgtgaacatgatgggcaacacagttaatgcactcaaccttgacttctctgagatattgtcacatgaatagctaaacacaca

SEQ ID NO: 72338 - DNA, 377 bp, Zea mays
  unsure at all n locations
  Clone ID: LIB3078-011-Q1-K1-F12
gcctgcaccaccatcatctggatcgcgtttgtgctccacgcggccgtcaacttcnggcggggcccgtacgccgggtacctcccgaaccgcccgtccgtcagccggaagccgatgccgacgccgggcagcgacgagtacgcggagctggagcgcaagccggagaaggtgttcgtgcgcaccatcaccagccagttccaggccctcgtcggcatctcgctgctggagatcctgtccagccactcctccgacgaggtgtacctcggccagcgcgacaccaaggagtggacgtcggacgccaaggcgcaggaggcgttcaagcggttcggcgcgcggctgaccgagatcgagaaacgcgtcgtcaccatgaacgcggaccc

SEQ ID NO: 72339 - DNA, 242 bp, Zea mays
  Clone ID: LIB3078-011-Q1-K1-F2
cccacgcgtccgatcggattcaagggctttaccgaggactacttcgagaagtgaagcgggtaagatcctatccatcatccctggtgctgcgctgcgttgcgttgcgtgcgtgctcgccgctatcgaacctttgctgtatagggttccgatttcgtcgaatgtaatgtatgatgctacttttgagcttcaatgtaaaatctatgccgtccggccccaacgcgctcaggtttaatttgatgcac

SEQ ID NO: 72340 - DNA, 443 bp, Zea mays
  Clone ID: LIB3078-011-Q1-K1-F3
cggacgcgtggcagattcaagatgatgatttaagagctaagaaatgagctacaaagtcggaactctcggatttgcttgacaactaatctttggacctcaaatcagaagttgggttatctttgcttgacagcccactacattaatgcagactttatcttgaaaaaaaagattattgcgttcaaatatttgaaatatccacatacaggcctagcaatcaaagaaggaattacagagtgtctcaaagagtgggggataaaagagaagatgtttactatcacattagataatgtttctaacaatctgtcagtgcgtgaccttcgagaaagtgggctatttggaggcgatcttcgtattgtccaatgttgtgcacacatattgattctcttagttcaagatggaatggcaattgctcatggagcaatctataagattcgtgagctggt

SEQ ID NO: 72341 - DNA, 303 bp, Zea mays
  Clone ID: LIB3078-011-Q1-K1-F4
cgcacgcataggctcgggtgagcgctggttcctctgctcggcgctgtccctgctcgccggtgaagctcactacctggagcggctcagcctttaaggatgcttcctaagcccagcccaaagtgctctacatgagctacgaaacgcccgcgtgatgcgcgcagccgcattcctcgagatcagcccatctcggcaccacctacagactccctggaaccagcgccctgctccctgctgccatgagctccaactcggattcatcccagctgacccttacccatagaccgcgtgtttctctaatcccag

SEQ ID NO: 72342 - DNA, 290 bp, Zea mays
  Clone ID: LIB3078-011-Q1-K1-F5
cccacgcgtccgtcctaatgagcgcctgttagcacatgaagctctacaacaccctttgtttaccagatgcatcagaagatgtggtttctgaggctacactgagattgaaaatgtcaatgctgtatttcttcattttgatgtgtaagaactacaaaaaagtggagatgttctacgaaaaatgaaatatgctaacttgcattctgttcaatgatttgaaaggtaattggtgtatataagcagagttctctgacactcgatccattttaactggatgtcattttccaattgat

SEQ ID NO: 72343 - DNA, 316 bp, Zea mays
  Clone ID: LIB3078-011-Q1-K1-F7
ggaggttgaagacaagattgaggggagtgtcaggtaaattgatttgccagatcggtcgagcgatcggttccagcattcggcccataacgagcttggaactcttctgcctcattgggactcttgtacaatgtctgggtgtgtgacttatatatatataaagttgtaacatgtaatactggaggatacaatctttaacaaacagggtggcggttgttccaaaaaaacaactgctcgaatctaaactaggtggccgtaaaccaatacgttgagcacccaatgaactgggcggtcgttatagatgggcctgccttacgta

SEQ ID NO: 72344 - DNA, 355 bp, Zea mays
  Clone ID: LIB3078-011-Q1-K1-F8
ctcacgcgtacgtccacgcgtccgcatacagttgggttttcttgcaagagcgtggccggatctgcatagaactgctcaagctcaaccatacttaaaaggaactggagcttgtcttgtaaactatggagcatgctgcttgcaccacgaacatgaacgcatggctggttaactaggtagatatgggtgtggatgggagagagagagaaaaaacaaggtatgtagtccacgtttttgatcttggatggagaggcatgagatcttgggatgctcatgcatgggtcatgggtgtggctgagatctggaacttttgtagccatcaacttgtttcccagaaaccatgtaataagggttacct

SEQ ID NO: 72345 - DNA, 162 bp, Zea mays
  Clone ID: LIB3078-011-Q1-K1-G1
tcgctagaactagtcccggcatcgggtccgccatcgagtacgccgtgtgcgcgctcaaggtggaggtcctcgtggtcattggccacagctgctgcggtggcatcagggcgctcctctcccttcaggacggcgcacctgacaactttcacttcgttgagaact

SEQ ID NO: 72346 - DNA, 370 bp, Zea mays
  Clone ID: LIB3078-011-Q1-K1-G11
ccacgcgtccgcccacgcgtccggacccacgcgtccgtgttattcttgctgctttttttaacggcatacgtggctgtgatgtgtggtcatgatcatttttttctcctgttattttagttgtcgtatcataaatgccatgtttgcattggtgttccaacatgtcaatattattgaataaatgtttgcattggcggcagcggggacgacgctaagtcgagcaatggcgaaacggcccgtggtggcagtaacggtggagagaagcagggggatgaatccaacggtggcgggatacttagcgctgtggcttccaggattggcgtggtcgtgtccagcgccaacggggaccgcaacggcagcgctgaggatggtg

SEQ ID NO: 72347 - DNA, 403 bp, Zea mays
  Clone ID: LIB3078-011-Q1-K1-G12
cccacgcgtccgcccacgcgtccgggctgtatcagcagcatttgttgtttggatagctattgtgggcaatgcagactggaagcctttgcagttcctatgttttgctttcttctacagaatactacagaagctaagagctactgaaccaccaattactccaatatacaatgaatatggtgaggtcgaaggacgagggataagaatggcaaaaagagtagtccgtgctttgggtttgatatttggatgtgtgttcgctgcatccctgggttatacagcagctattaacttgatcgagctttcaatgcagtacactccccgccttgtttattactaccaagagctgattgttacggcggctacctccgttcttctgtgcatcacagcctcatactaccgatgaaca

SEQ ID NO: 72348 - DNA, 440 bp, Zea mays
  unsure at all n locations
  Clone ID: LIB3078-011-Q1-K1-E3
cgcaagccctaggcgttctgtgtcacctgtaaaggaaaaggagcgcagccgcacacctgatggcagtaggagccccagcccaagggacaaggtgagcccaccaccaaaggataatggtgcccacaatggctcggaccgtgaagacagccctgggggcagggagatgagcaagaggagtcggagcccgtctgatggctaccgtagccctgtgggcaatgggcgcagcccgagccgtagcccaagccccaaggtcaacaatggtgatgacccaagccccaagggcaacaatggtgacgacccaagccccaagggcaacaatggtgatgacgagcaccgcggttcaccaagaggaagtcagtccccctgaactgaaaaactccccgtgcaatttgnggagcagtgtgcctgatttgagaaaacanactgtattttgccatttc

SEQ ID NO: 72349 - DNA, 221 bp, Zea mays
  Clone ID: LIB3078-011-Q1-K1-C7
acgcgtacgcccactcgtccggccggtggtctgcgggctgtttaagatggcccaggtgttcctttagtagatattgggtggccaacatatatacgagtacgtaattagcttcaaaataatgttcccctcgcctttatttgctgttcaagtccctgtaataaccgagaacgttaattgtagcagtgtgttttttatatgattaaataagtactatgttgtat

SEQ ID NO: 72350 - DNA, 422 bp, Zea mays
  Clone ID: LIB3078-011-Q1-K1-C9
tcgcggggccgcacctcctccggatgcttctttgttcatatcaacatgaagcccacactcgggcggaaggataaagagcgtgcggactggaggctgtccatgctggcgttcctggacttcctgatccagcacaacgtcaccggcaaggggcccttcgacaacctgctgcagcacctgtccgacccatggcacaacaccatcatccagaccctgtctggttgagtcgacggtccatcaggtcatgtggtccgagctgaaaggcctagactcgaagacagttcgtgtgatgcgttcttaatcgactgagggctaaggaatgtgacgtactggtatatgtacattagttgaagcggaggctataaagggtgtagagattgtttcatcaatgtatatcatctgtcccgatgggttttgttttgtgc

SEQ ID NO: 72351 - DNA, 364 bp, Zea mays
  unsure at all n locations
  Clone ID: LIB3078-011-Q1-K1-D1
ggagaagaaatctgggaagtgcatctaatgtagtctgattccacagagacctactgttggggatgtcaatggagatggccacactgatgttgtggtcccaactgtgtcaggaaacatctatgttcttagtggaaaggatgggtcaaaaatccaacctttcccatatagaacacatggaagaatcatgagtcctgttctacttctcgacatgagcaaacatggagacaatgcaaaagggctaactcttgcaacaacgtnctttgatgggtatttatatttgattgagggatcgagtggctgtgcagatgtngttgacattggagagacctcgtacactatggggtttggctgataacgtggatgg

SEQ ID NO: 72352 - DNA, 427 bp, Zea mays
  unsure at all n locations
  Clone ID: LIB3078-011-Q1-K1-D10
ggcggcccgagaccgcgggcggcggcggttgagccgtcgccgccgccgtagctgcngggcgcgaganggcggcggcgcccaagggatccggccgcagggtggtggttgtcaggcccgtcgacgaggacctttaccgcgtgccgccgccggacgacaacgacggcgccgccgctgtctcccgccttcccagacgccggaagcgtgcggcgaggaggagcttgtggatgggttgcttgggcctcaactgcgtggcctgaagcctgaagccagtagtagtagtacgtaggttttacaaggtgcattcgggcggctaattaagctcagtagtactactgattagttaagctgtatacgtatagtaagtatgtcgtgccgtgcgtatgggatctgggcaagtgtactagtactagtagttagtgggagagtc

SEQ ID NO: 72353 - DNA, 229 bp, Zea mays
  Clone ID: LIB3078-011-Q1-K1-D11
cccatgaagatcttccagaggcacctcacaaacatgaggccctcatccaactaggctcatcctgatggattgtctgcctcatgacaaacatcaatacatacatttcttacgatactgtggggggcctgtccagagacgtcaacctcaaatggagacacggcccgggctcaggcgaacaccatgtctgcaacaaagacggcgcctacgtatggggatacaggccaatcta

SEQ ID NO: 72354 - DNA, 381 bp, Zea mays
  unsure at all n locations
  Clone ID: LIB3078-011-Q1-K1-D12
gaataaatcatggattgaagattgattcctactaataatattatgtagacaagagaagtctgaggaaagtttaactcgaactccatttcttagacatagatatacgtctgaacattctccaaaatcaattaacacacaggggatatagcaccaccagtcgatacagacagcacaggcacaggacaggacacaggcgagacgatcgatacgatggattccgatcaggccctcttgacggggtcgaagttggagacggcgacaacggcgccgacaataccaacgagcacgaccccaccggacacgatgctgaggaggaagttcttgagcgacggcgtgagcccgccggactgcgcggnctccgcgacgtccggcagcaccagc

SEQ ID NO: 72355 - DNA, 372 bp, Zea mays
  Clone ID: LIB3078-011-Q1-K1-D4
cggacgcgtggggcgagctcatccacggttgctgggccatgctcgccaccctcggcgcgctctccgtcgagtggctcaccggcgtcacctggcaggacgccggcaaggtggagctggtggacgggtcctcctacctgggccagccgctgccgttctccatctcgacgctcatctggatcgaggtgctcgtgatcggctacatcgagttccagcgcaacgccgagctcgacccggagaagaggctgtaccccggcggctcctacttcgacccgctcggcctggcggccgaccctgagaagaaggagcggctgcagctggcggagatcaagcacgcgcgcctcgccatggtcgccttcctcggcttcgccgtgc

SEQ ID NO: 72356 - DNA, 305 bp, Zea mays
  Clone ID: LIB3078-011-Q1-K1-D5
gcgcaactgaccggggcgcgcgcaaatcttgcatacatagccgaaaggtcctgcctggccagcatctgcatgagaccggactcgatgcagggtatgacacttagctccatgtgcagaaggaagctaagacgtcatcaggccgtgacagcgatccatgagcaggcacgctcacaacagcctggagtgccaggtacagcaacgggagcggatgctgagaactgggtcacatcagctacactaccaggcagtgggaccgctacagtttagaacctcgatggtgatacagctcgcttcagagcaagtca

SEQ ID NO: 72357 - DNA, 347 bp, Zea mays
  Clone ID: LIB3078-011-Q1-K1-D7
tgacctgggctaaggcgtcacaatcgacagcacgaacagtaccagcgaacggtgatttagactgcagaaggcgggtgcataccagcctgcagtgtcgcaattgaggctgctggcacagcatttcagctctacagctcgggtatcttcactggaagctgtggaacagcgctggaccatggtgtcacggccgccggctacgggacagagaacggcaaggactactgcatcgtgaagaactcatggggcagcagctgtagcgagtccgggtacgtgaggatggagcgcaacatcaaggcgtccagcggcaagtgcggcatcgcggctgagccgacatacgccgatgaagg

SEQ ID NO: 72358 - DNA, 387 bp, Zea mays
  Clone ID: LIB3078-011-Q1-K1-D8
aatccggggggcgacacacgcgcgcgagcggactctcgtcggtggtcgcgcgtcttagatggcatggacgaaggtgggaggcgcgcaatgcatacccgccgacggcaacgccgacggtcctttcctaacccgcagcccccggccacagtctctctcttccggtccagtgggggctgctagcttccaggaatattggagatgtgccttcaacactctagggctcgattgtctccagataagcaatttgctgcagaaaaaagttttgccttgtattgcaagccagttgaattatacaatattatccagaagcgagctattaaaaatgtaaattttatcttacagttgcactcctatcataacattgttcatatattgggtcttatcagt

SEQ ID NO: 72359 - DNA, 351 bp, Zea mays
  unsure at all n locations
  Clone ID: LIB3078-011-Q1-K1-D9
ccgaaaagannnagtaaataataaaacatgagtctctttttcataattctcaaataaagntgttttttttaatattactcctgactaagatgtatatattaatcatcctattttaatatatattaatcatcctattttaattaggttctaatccaattaatactaactattttcttttttatttaataaccatctgactatcatataataaagggtagaacaattctttcttctacagattctacaaaaactgaaacaaaatgcatcgaaaaaattttctttgtataaaaattatctctatatcatatctaaataaaaaggaaatcaaaaagaacggaagttgggattaca

SEQ ID NO: 72360 - DNA, 215 bp, Zea mays
  Clone ID: LIB3078-011-Q1-K1-E1
cgttccccagagcatatggtacgggccttttcggcccaagtaccttggcccgttcttcgagcagactccgtcgtacctgaccggcgagtttcccggcgactattggtgggacaccgcgggcctcttgggcgacccggagacctttgcgcgcaaaccggagctagaagtgatccacttccggtgggccatgcttggggcccttggctgcgtgttcc

SEQ ID NO: 72361 - DNA, 444 bp, Zea mays
  Clone ID: LIB3078-011-Q1-K1-E10
gcttccttccccgccggccgccgccgcctacaactaacacttcacgtgcccccatcctggggcgcctcaagtcaagtgttcacggtccatcctctcgagagtctaggcccttctcccgaagccgcagacgcagaaaacggctctgcatatggaggcgaagaagaagccgtcggcccccgccgccgtcggagccgcgccgccgccgccgggtaacgggtacttcagcaccgtcttctccgcgccgactgcgggaagcgcaagtgacgcaaagcatgcggacttgtacacgatgctgaacaagcagagctccagagggcagaatggcagagatggcaaatcccacagccgccctacttacaaggatggcaaacatgctcatccaaatgagccatcagaatctccttactttggctcatacgtgcattacggtggtcgggagttcta

SEQ ID NO: 72362 - DNA, 399 bp, Zea mays
  Clone ID: LIB3078-011-Q1-K1-E11
ggatgtcaggagaagcatacagtgacaatctctgctatcgttcgggtgttgaggccgggatgcagcagctcctcctcaagggtcctgcgggtgaggccatagagacccgtccattggagcatctcctcaaccgtggcaaacacagggcgagactccatgccattgttccaaatctgtgcatcctatttggggaaagagaaggaaggaagaattcgcctaacctggacaaacttgtccatctttagcagggacagaccatatcgcctgagcagcagcagcgagttgacgagactgtgcagcttgcgccgccaccaggagctgccgacaggaggtgggcgggccgtctggaagacgaagcttttgccgtcccagatccctagccagtcgtcgccgccggtc

SEQ ID NO: 72363 - DNA, 418 bp, Zea mays
  Clone ID: LIB3078-011-Q1-K1-E12
cccacgcgtccggaccaacccggtccactccttcccggaatccggcgccaccgccgacggcggcgtccccttccggcggctgaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctctgtggcggcgagggccacaacgggtgggtctcctgcgtcaggttctccccaaacacatttcagcccaccattgtc

SEQ ID NO: 72364 - DNA, 364 bp, Zea mays
  unsure at all n locations
  Clone ID: LIB3078-011-Q1-K1-E2
ggagcggactcttgtcggtggtcgcgcgttcgagatggcatggacgaaggtgggaggcgtccaatgcatncccgccgacctcaacgccgacggtcctttcctaacccgcagcccccggccacagtctctctcttccggtccagagggggctgctagcttccaggaatattggagatgtgccttcaacactctaaggctcgatagtctccagataagcaatttgctgcagaaaaaagagttgccgtgtattgcgagccagttgaattatacactattatccagaagcgagctactaaaaatgtgaattttatcttacagatgcactcctatcataacattgtgcatatatagggtcttatcagtg

SEQ ID NO: 72365 - DNA, 439 bp, Zea mays
  Clone ID: LIB3078-011-Q1-K1-C6
cggacgcgtgggcggacgcgtggggtctttaaacaactcccggccatggcgaccgcgggccgggtcgccgccaccttcctctcctctttccccactcaccatccccgccccttttcctccgtttccctcgtgacaaaccctgtcctacccgtctcccttcgggccgctgtcacaggtggcccacggctcgcctcccgtctccgggtccaccgcgtcggcgccgccgtcgcccagcttcccaccacgaatccggaggtagcttctggggagaagaagatcagatggtcatcaagggctgtgcggtcttttgcgatggcagagctggaggcccggaagatgaggtaccctaccacaggcaccgaggggctcctcatgggcattcttgttgaaggaactagtggcgcagcaaaacttttgcgtgctaatggaaccacacttc

SEQ ID NO: 72366 - DNA, 408 bp, Zea mays
  Clone ID: LIB3078-011-Q1-K1-A9
atgaacttcatgcacagggacgaagaggtgaactacttcccttcgaggtttgatcccggccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgtaagatcgacgaggaagaaagcaggcaccggtggccaaggatgcaacgcaacatggagcgtgtgatgtttac

SEQ ID NO: 72367 - DNA, 147 bp, Zea mays
  unsure at all n locations
  Clone ID: LIB3078-011-Q1-K1-B1
nccacgcgttcggccacgcgttcggccactcgttcggttcctggtctcgtcgccgcccggggtgcacaacgcgcccgcgaagcacctgcttggctttcagaaagtgtcgctggagccccggcacgcgcgcgtggtggcgttcaaagt

SEQ ID NO: 72368 - DNA, 442 bp, Zea mays
  Clone ID: LIB3078-011-Q1-K1-B11
aggcctacctccgccaggtcgggctcgacgtcaactccgcgctcgcttttctccagggaaggttgcagcagtacaaaatagtggagatgaagcttctagcacaacaaagggatcttcaggcaaagattcctgatatagagaagtgcttggatattgttgcaacattacaagctaaaaaggatttgggtgaggcactcatagctgatttcgaattgtccgaggggatctactcccgtgcgaaaattgaggatactgactcggtgtgcctgtggttgggtgcaaatgtgatgctggagtactcttgcgatgaggccaatgccctcttgaagaaaaacttggaaaatgccaaggccagcttagaagtccttgttgctgatctccatttcctgcgagaccagcaaaccatcactcaggttacaatttctcgggtattcaactggga

SEQ ID NO: 72369 - DNA, 406 bp, Zea mays
  Clone ID: LIB3078-011-Q1-K1-B12
accacgcgttcgcccacgcgtccggttgtgttatcttttgaggttgtcaactgcaatggcggtgaggtccaatgggagggtacgtcaccgaccatatcaattgacaacacatctggatgtcaattatacttaatcaaaaattcactgggagcttcaattacttctgctaaatctaatgaaatcaatgtgatggctccaagtggcagtactgactgtgattgggatgagcatgcattgcctaagcagtacatccataatttcaaagattggcaattcaccactataccaagctcacactctggggcgtaaataccaattgttactgatgtgtttgctttttatttcacgtttgccttgtttttgaaaatgaacgtttgatgaggtttgtaacagctttgggtctctc

SEQ ID NO: 72370 - DNA, 378 bp, Zea mays
  Clone ID: LIB3078-011-Q1-K1-B2
cccgcagtcgcccaccagatcacttgttaaactttgttgaggggtgatggcggtttctggcgcaaacctcagctccgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcgtcagcagttccttcagccccaactccagatgttgctgaagcacaggccccagttgctgaggaggacgacgacgatgatgttgacctttt

SEQ ID NO: 72371 - DNA, 439 bp, Zea mays
  Clone ID: LIB3078-011-Q1-K1-B3
cggacgcgtgggcgttgatggtcctaatgatgagggtgaaatgttcacccgccctggtgaactcagcgatcgctttccacagccttatgcaaatgagcaagcagcccgatttgctaatggtggcgcctacccgccggaccttagtcttatcacaaaggcaaggcacaatggtcagaactatgttttcgctcttcttactggataccgtgatccacctgctggtgttcagattcgtgagggtctgcactacaacccctacttccctggtggtgccatagccatgcccaagatgctcaatgatggagctgttgagtatgaggatggtactcctgcaactgaagcccagatgggtaaggatgttgtatcattcctttcatgggcagctgagcctgagatgggagagagaaagctgatgggagtgaaatggatccttctacta

SEQ ID NO: 72372 - DNA, 421 bp, Zea mays
  unsure at all n locations
  Clone ID: LIB3078-011-Q1-K1-B4
gtggtgggtcgcgcgctgccgaccccaaccgatgagcaccccaagatctaccgcatgagagctctgggccaccaacgaggttcgcgccaagtccaagttctggtacttcctgagaaagctcaagaaggtgaagaagagcaatggccagatgcttgccatcaacgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctnccgccaccgcgtgaggtccccctgcatacagatcatcaagacagcgacggtccacttcaagctgtgcaagagggacaacaccaaacagttccacaacttcgagatcaag

SEQ ID NO: 72373 - DNA, 434 bp, Zea mays
  unsure at all n locations
  Clone ID: LIB3078-011-Q1-K1-B6
gcactttctcctcgtcccagacaagccaatcgaagccgagatacgaccatggactcgagcggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgngaagctgttgggcggcgtgaccatcgctcacggcggtgtgctccccaatatcaaccctgttct

SEQ ID NO: 72374 - DNA, 158 bp, Zea mays
  Clone ID: LIB3078-011-Q1-K1-B9
cccacgcgtacggaaaatctcgcgctgatgttttctccagggtctccgtcttttcctgagagggtgctacacaagacgaagtgggggattacgagcctataacaactgatggctgtggtgctgcagccctctgacctacagggaactatggcgtgtac

SEQ ID NO: 72375 - DNA, 453 bp, Zea mays
  unsure at all n locations
  Clone ID: LIB3078-011-Q1-K1-C10
attcccgggtgcgacgccagcgccgtccgcgccgaaataaccttnntaggttttgttgatttattgtcgcgatgattttatntgaaaaagatcgggggtcgcggtatncttgttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcacatntgatggtttcaaagcgatggataccattat

SEQ ID NO: 72376 - DNA, 402 bp, Zea mays
  Clone ID: LIB3078-011-Q1-K1-C12
cccacgcgttcgatgcaccacacctcttcttcttcttcctcctcctcctagcacagctagcggctgctccccttcgcctgtgatcatgtcttgcaccaacggcaagtgcgactgtggctccagctgctcctgcggcagctcatgcaactgcatgtcccctaatgtggagaccgccgccgccagcagcatcaagaccacggtcctcgccgcgccgaccaccaaggccagcgcctgcggcttcgaggcggacaccgagggcggcggctgcgactgcaacacctgcaactgcggcaccagctgcggctgctcctgctgcagctgcaactgaaccggtcaagcgatggcccacgagagtcgagaggactacgaccagtcgtataaatataatagcggcgtctaaat

SEQ ID NO: 72377 - DNA, 431 bp, Zea mays
  Clone ID: LIB3078-011-Q1-K1-C2
tgaatacacaaaggcagaaagaggaggattgaaaagagcttgaaaagcaacagaagagagaggtagagaagaaagagctggataagcaaaagcaaagggaggaagagaggatggagatggagaaggagaagaaaaggcagcgagagagggaggaagagagacagagggagagagagcaatacgaaaggaaaggtggaaatgatgtggagagagacaacaaaaggaaactgatagatgatcggtatgatccaaattcaagtagagatagagaagagggatacagagactctcagaacagagatgacaatagaaggcaagaagagcatggtcaacacaatagatatatggatagtcatgattccaagaggtcaaggcatgactcgcattaccattcaaggagggattatgaacaacgctattctagagacgaa

SEQ ID NO: 72378 - DNA, 223 bp, Zea mays
  Clone ID: LIB3078-011-Q1-K1-C3
cccacgcgtccgcccacgcgtccggccgtcggcggtgggctgtttaagatggcccagggcttcctcaagtagatattgtctggccaacgtatatacgagtacgtaattagcttcaaaataatgttcccctcgcctttatttgctgttcaagtccctgtaataaccgagaacgttaattgtagcagtgtgttttttatatgattaaataagtactatgttgtat

SEQ ID NO: 72379 - DNA, 435 bp, Zea mays
  unsure at all n locations
  Clone ID: LIB3078-011-Q1-K1-C4
ggcggggatgacgagcccaatggtggccaccccggtccagttccacacaaccggccgcgtcagcttctgctccttttcctttcccagcgcatcagggaggcggcgattcgcggcggtgagggcgtccgcggagacgatggcgacggagaagctgggcatcaaggtggagcgcaacccgcccgagtcccgtctctccgagctcggcgtccgccagtggcccaagtgggggtgcgagaagagcaagttcccgtggacctactccgccaaggagacgtgctacctgctgcaggggaaggtgaaggtgtaccccgaaggccacggngaggagttcgtggagatcggcgcgggagaccttgtcgtcttccccaagggcatgagctgcacctgggacgtcgccgaggccgtcgacaagcactacaacttcgagtagccgcc

SEQ ID NO: 72380 - DNA, 477 bp, Zea mays
  unsure at all n locations
  Clone ID: LIB3078-011-Q1-K1-C5
cgtactcggtctcggnaattcccgggntcgactccacgtccgtctcgggagcacccaagcacaagtncagcacctcggtctaggccntgtgcgccatcnngccgctcggcgccttgcgctnactctacganngaagcacgaggggcgaagaagggactctccgagctacgtcgctatcaggcacatatgatcacggagggagggtcgctgcnctgcggcggcccggtcggcgctcggcgtgctaccgtnnattccacgagcactcacgaagaagggaagaaggggacctacaaggacccgccgaaggagggctagcngtgtcgagaagaaagcactctatccaccttcttcgggctgaaaccgtaagtaccggccccggcgcgccgactncgagctaagctaagctccgggcgcacaaacataccacacaacctggtttaaaattctgtactggcatgccgtgtgtaaatttggatg

SEQ ID NO: 72381 - DNA, 459 bp, Zea mays
  Clone ID: LIB3078-011-Q1-K1-A8
aaacccgggtggagccacgcgtgcgcgcgcagtcgcccaccagatcactagctttactttgttgaggggtgatggcgcgtcgtggcgaaacctcagctacgaggcagggcttaaaaagcttgatgagtaccttctcactcgcagctacatcactggctaccaagcttccaaggatgacttggctgtctacacttcgttttcgtctgctccctcgtccaagtatatcaacgtagcaaggtggtttaatcacattgatgcgctcgtgaggctgagcggaattactgcagagggccaaggtgtgaaggttgaatcgtcagcagttccttcagccccaactccagatgttgctgaagcacaggccccagttgctgaagaggacgacgacgatgatgttgacctttttggtgaggagaccgaagatgagaagaaagctgctgaaaagcgtgctgcaactggcca

SEQ ID NO: 72382 - DNA, 244 bp, Zea mays
  Clone ID: LIB3078-009-Q1-K1-G9
cgccaacccgtccgttttccccgtgcttttcccccgtcgaggccggttcccatggcaaaaagactccgactaaaatggccggccgttggttccggcccgaggtgtacccgttgttcccggggacggccatggccgccggcatttgcgggtttaactttttccggaacataactggaaacccggaagtcagggtaaacaaggccgggagggaacctggggtgcttgaaaaccatgaggaggggag

SEQ ID NO: 72383 - DNA, 307 bp, Zea mays
  Clone ID: LIB3078-009-Q1-K1-H1
cccacgcgtccgcccacgcgtccggcccacccagcgtgcaacctatgcgagaaccggctgggcctccgctccttccagcccgctctgtaatctgcaccaccctcgcccgccgccgtcgccgccatggggaggggaaagttcaaggggaagcccacaagccgccgcaacttcttcacacccgaggggatcgctgctggtactttaggtcgggcacgcacccttaaaaaaaaaggggaagaggaagacgaggaaaaagtagaaagagaagagtctgacgaaaaatcttgaaaagattctgattaaaaga

SEQ ID NO: 72384 - DNA, 207 bp, Zea mays
  Clone ID: LIB3078-009-Q1-K1-H11
cgcgtacggcctcgccgaggtccccgtcgacgtgccgtcctcccagaccgcgctcgactgcagcgtcactttcgaccccggcaacaaggtcagcctctcccactcgctaggctccggcggctgccggctcaagtacacctacgcgcacggtgtcgaccggtctaccaccatcgagacgcctttcgacaccgacaagaacgcatggga

SEQ ID NO: 72385 - DNA, 325 bp, Zea mays
  Clone ID: LIB3078-009-Q1-K1-H2
ggcggctacggtggcggcggcggctacagtggtggtggcggcggctacggcggtggcaaccgtggcggcggctacagcaactccgacgggaactggaggaactgagcggtggggcccgcgcggccaaattatcctgttcgctaccgtgatgtttaccctagtccagaaggtttatcttcgctcgtgtcgggtttggtgttgcccatctgtgtttttgattgcaaggtcgctctgtgtcagttgttagtgctgtgttcatcctcggcttcagcagacccatgcatcaaacagcatggactgcggatcgatggatgctgttaccccc

SEQ ID NO: 72386 - DNA, 262 bp, Zea mays
  Clone ID: LIB3078-009-Q1-K1-H3
tgccattctctcaagctcaagtagtgatgaagatggtcgtgggaggcggaggagatcttatggttctactatcatcattccgacggatatgttttggtacttggatgcagattattatagaagacgtcgagtagaaaacgaaaatgggatgaactttattgaatctgtattttcatttgtgtttggggatggtgatccaaacgatgggcttgaagaaaagcggtggaagatgattggacagtatatttcatcaaatggtgga

SEQ ID NO: 72387 - DNA, 195 bp, Zea mays
  Clone ID: LIB3078-009-Q1-K1-H4
cccacgcgtccggcacaaggagcacctcggcgagatgggcgccctcgccgtcggcgcctgcgccctgtacgagaggcacgaggcgaataacgacccggagcacgcgcagcggcacaagatcgatgagggcgtggcggcggtggctgccctgtgcagcggcagcttcgcgttccacgagcaccacgacaagaagga

SEQ ID NO: 72388 - DNA, 128 bp, Zea mays
  Clone ID: LIB3078-009-Q1-K1-H5
ccaaaaaatgccctgttacatgccgtgtgggattttaccgggataaaaagctgtatgtgagggtctgaagaatgcgcaatgcccacgcgtgtaaatattcgagagggggaacatagccttttcatttc

SEQ ID NO: 72389 - DNA, 201 bp, Zea mays
  Clone ID: LIB3078-009-Q1-K1-H6
acgcatgcgcgaacgcgacttgcagttttcctgtgcctgctagcaagaggcagcatgcgagccaccgatgacgacgaagccatcgagccggcggatgtgctgtccaggcagatgatccagtgcacagcggcagatttggcgctcgaggacaccatctacgcgctcgacaaggcaatccatgaaggatccgtgccctttgac

SEQ ID NO: 72390 - DNA, 421 bp, Zea mays
  unsure at all n locations
  Clone ID: LIB3078-009-Q1-K1-H7
aagaaatagaggaactgtgtanggattatcctgcaactaccgttattcttgaccatatggctttctgcaagccaccaacgaacgatgaagaagagaaggcattctcttcatttctaagcttatccagattcccacaggtttatgtcaaatacagtgctcttttccgcataacaagagaagcatatccatatgaagacactgctcagcttctttccagtgtgatatctcattatggagccagtcgagtaatgtggggaagtgacttcccctatgttgttcctgaatgtggttacaaaggaggaagggaggcgatttctcatgtcgccagcaagataccagtttcccagtcagatttggaatggatcttgggaaaaacagtgagccaattattccaaggtgcatgggttactccatgatcact

SEQ ID NO: 72391 - DNA, 418 bp, Zea mays
  Clone ID: LIB3078-009-Q1-K1-H8
cccacgcgtccgcccacgcgtccgcgccgggcactcgtcgagggcgtcatcagaggctcctcctaggcacgagcccgaccaggagaatcaggtggcgtctgggtcatcggtggacgcgggtcctaacagtaacggcatgccgctgtctgaagttaaccccactccacctgaaagcaacagccagacagtgaggaagcagcagccagggccctgcaaatagcagctgcctggagtcggcgaggcgagctcgctgttatgcagcggtctgctgcagggcgagcaaacacctgtacagtggcagatggctgtctggctgctgtaagttgtgagttgagggtatggtgtaaatatgagaaatcattcagatttggtgttgaaaccaaacacacttcatcttgtcagtatttgatgctgaaac

SEQ ID NO: 72392 - DNA, 175 bp, Zea mays
  Clone ID: LIB3078-009-Q1-K1-H9
ccaagccttccggccttggcttgccgaacccccaactttttgggcgcccctttcggaaggaagggttcattccggttaacaacttacttcggaacttaaaaatccgggaattccttcatttccaaggggaacgggccctccacaaaggggttgccgaccaagttttacaacggcc

SEQ ID NO: 72393 - DNA, 250 bp, Zea mays
  Clone ID: LIB3078-010-Q1-K1-A1
aaaggaatgggtttgtgaacaaggattttgtcaaagcatgcaaagtgatggaaccaggaaagatattgttcatgggtgaacaaatgtcttggatgccaaacaggtcaagaaaggggatgaagacaggatcatcatcctctcagctctcacagtcgtggcctaaagatgataggaaaagcaaaaactatcagagcatgccacgtgaaaagaagcagcatatgaaggaactcattgcaaaagaagcgtcaac

SEQ ID NO: 72394 - DNA, 405 bp, Zea mays
  Clone ID: LIB3078-011-Q1-K1-A11
gagaggaagaggttcccggcgcctccactaccatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgggtgacatgttggcgttggtgaaaaaggaaagcgccgagcgtcagtcactgggagccctttcactataccagaagacac

SEQ ID NO: 72395 - DNA, 413 bp, Zea mays
  Clone ID: LIB3078-011-Q1-K1-A12
ctcctaccccgcagccgccgcgcaggtagtcctagcacccgcgacgagcaggatctgcccaggtgctctttgagtagttgccccaactgtcaccatgcataacgaggagggtaagactgtggacctctatgtccctaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttggacaggctgtggcagaagaagaaagctgatatcaagcagtagattttacatctagtttaccaagatatggacactgccttagctatgttttgaattcatgtcactatatgcaatg

SEQ ID NO: 72396 - DNA, 238 bp, Zea mays
  Clone ID: LIB3078-011-Q1-K1-A2
cgccacctcaacccaggaacagagcgaggcgacgccgcggcacctcttctccggcgaagggaaatggcaaccgttccaggggatctgatctggcaagttgtgaaggaagaacaactccttccttgtgaagcagttcggcaacggcaatgccaaagtgcagttcaccaaagagccgaacaacctctacaacatccactccttcaaacactcgggtttggcgaacaagaagactgtgacg

SEQ ID NO: 72397 - DNA, 388 bp, Zea mays
  unsure at all n locations
  Clone ID: LIB3078-011-Q1-K1-A3
cccacgcgtccgacatgggcaacggcggttgcgccaacgtcgtcgcgcccggctacacgaagggcgacggcctcggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtgatttacaaccagcaccatgcctgggctgaccactggatcttctgggtcggccccttcatcggcgctgcgctggctgccatctaccaccaggtgatcatcanggcgatccccgtcaa

SEQ ID NO: 72398 - DNA, 443 bp, Zea mays
  Clone ID: LIB3078-011-Q1-K1-A4
cccacgcgtccggggacgcacgggacagcgcgtcaggctctacgtccggggcaccatcgtgggatacaagaggtccaagtcgaaccagtacgagaccacgtcgctcattcagatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgcgccaagttcaagtccaaccttccgcctgagtccatggggcgcaaggtcagagtgttcatgtacccgagcagcatctaaggttaggtttttgttggagtaaaggtggactctaaatggccatgcttagttcttctctctgagcttaaaatgccatgtgttggcaacttagattgttcat

SEQ ID NO: 72399 - DNA, 370 bp, Zea mays
  Clone ID: LIB3078-011-Q1-K1-A5
cgcggaactggggccagaactggcagttcagcgccatcctcgtcggccaggcgctcgcgttccgcgtcaccggcagcgaccgccgcacctccacctcctggaacgccgccccgcgggactggcgcttcggacagaccttcgagggcaagaacttcagggtctgagctcaggccgcgagtggcggcgagaagaagccagcgctcaaggccttcttccgccgtactattatatataccgtgattactgctactagtagtcggtataaagcgcgtgttagggtggtgggaatgtacgtgaatgcccgtttagggtcacgccgtctcgccctggttcaagtactctctgaaaaaaaaggagcctttttcttctg

SEQ ID NO: 72400 - DNA, 437 bp, Zea mays
  Clone ID: LIB3078-011-Q1-K1-A6
ggggatatctggacatcagagacactgtacagtgcgtggagctagcaatagccaacggagccaaacctggcgagttcagagtcttcaaccagttcaccgagcagttctctgtcaatgagctagccaaactggtgactgcggcaggagcgaagcttgggctagaagtggagaccaaatcgatacccaacccacgagtcgaggctgatgagcactactacaacgccaagcacacgaagcttattgagctcggcctggtgccccacctgctctcggactccctgctcgactcgcttctcaattttgccattcaatacaaggatcgggtcgacacggcacagatcatgcccagtgtgtcgtggaagaagatgggtgccaagccacggacagtctctgtttagagggtgattcaactttccctggggtataatatcaaccat

SEQ ID NO: 72401 - DNA, 189 bp, Zea mays
  Clone ID: LIB3078-009-Q1-K1-G8
ggttcctggagaaaaccaacctcttttggaccccaaaggccaagatggcttggcaccggcggtccagcctggggttgcggttaaacctgcagggccggcaaaaattcccctgccctgtaggaaacaagaaccgccggccaggcaacggtggtcctggcgttggccccgagaaaaaaggccggccccaat

SEQ ID NO: 72402 - DNA, 377 bp, Zea mays
  Clone ID: LIB3078-011-Q1-K1-A7
gagtcgcgctcagtgctcatgtcgctttttcgccggttcgatagccacagccatgcggtgtatactctttggtttgatggcgctcgcaaagcaagattgacattgcctcggaagaacatctcaactgattgtatcagcacatgttgcatcttcacatgccacggatccaattggacgcactagtcttacgaaatgatgcacttgtaagaatgcctacaggcttgaggacctatttattctgctacgtttatgctaatcaagagctgtatataagagatgcatcgaatctgacaccctgacacacataattttgatcggaactgcactgtgctgtcattgactgccgattatatttgaaaagtcactgaaggatcttg

SEQ ID NO: 72403 - DNA, 413 bp, Zea mays
  unsure at all n locations
  Clone ID: LIB3078-009-Q1-K1-E4
ggctgtgcctgaagacctgaccagcctccacctctgattagcgtgagtgggtacgtggactgaagaatgtaagctggcgaagtagtaccatgtatgtatggagagggttaaatgtaattctttccaatggtccaaggcggatgctgcttccgatgtatcagcatgcgattctttggacaagaggtatactattacagtgaaaagtgaaaaaagagagagttagctacatagaaagctttctgagctctatacgtactacctccgttctcagatatttttgtcgtcagctcggtcatttttgaactaaacggcgataaataaataaaatgaacggaggagtatatcttatttaacaaccactgatattttatacaaatncaaccaaataactatttcatgcatatgctacgctc

SEQ ID NO: 72404 - DNA, 338 bp, Zea mays
  Clone ID: LIB3078-009-Q1-K1-E5
agcgtcccccctcgctcgcctaatctctcgccgcggccttgccggtgccgcagacggccatgggtctgcgaaggtgcccttgtggaaagatccgttgagcccgagcaagtggaaggaagagcactttgttctaacaagcctctcaatgtggggggttattttttatggtggttacaagctttttagtggaaagaaggaagccaagactgaggcggcatcaccccatgcataggtggcggagatggagttctacccatatctgtggcctggcaacaatgttaaataaaaggaatgctttatgttgtgctttcaagttgataaattgtggcaacaggaga

SEQ ID NO: 72405 - DNA, 339 bp, Zea mays
  Clone ID: LIB3078-009-Q1-K1-E6
cgacttgtttcattgattcttgaagagatcgagcttcttttgcaccacaaggtcgaggatgtcttgcaactgcggatcaagctgcggctgcggctcaagctgcaagtgcggcaagaagtaccctgacctggaagagacgagcaccgccgcgcaagccaccgtcgtcctcggcgtggccccggagaaaaaagccgcgcccgagttcgtcgaagccgcggcggagtccggcgaggccgcccacagctgcagctgccgtggcaacttgaagtgcgacccctgcaactgctgatcacatcgatcgacgaccatggatatgaatattatctatctagcctgggg

SEQ ID NO: 72406 - DNA, 373 bp, Zea mays
  Clone ID: LIB3078-009-Q1-K1-E7
agcggcgcctcgagggacgagggaggcagaaacgccccggtggggtcctggcgcccgacgtggaccaagaccccgcggaaggcggggtggcttaatgggaaagggaacccctgggggtcgaggggtcgacggagcccattccggggctggcaaaaccggagacgcccgacttctgggagggacctcagtgggaggccctcggcttcttcgtgcagtacatgtgggcgttcggcgtcgtcttcggcctcattgcttgcggtgtcgcttgggccacttacaacgatggtgcaacagatttcaaagacacgcctgcttacaaggagtcccaatcacaggagttccctgaggagtcagaatcatcaagcgctgatgt

SEQ ID NO: 72407 - DNA, 336 bp, Zea mays
  Clone ID: LIB3078-009-Q1-K1-F1
cggacgcgtgggccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcaggaggagtacctcaacgcgccaggcgagacctac

SEQ ID NO: 72408 - DNA, 127 bp, Zea mays
  Clone ID: LIB3078-009-Q1-K1-F10
accaccggcaaggggcgccgaatcccccccgttaagtccaaccggattcaaaacaccttggacctggtgggaacttaaggcctcacccggccagtcaacggagtcaacaaggacacctttttgccca

SEQ ID NO: 72409 - DNA, 272 bp, Zea mays
  Clone ID: LIB3078-009-Q1-K1-F12
ccctacactcccggcggcggcgcaggagcagcagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctggccaagtaccccaagaaggtggtccgcagggactcggccaagaagacggcgaagaagtcgcgcgtcaagtgcttcatcaagctcgtcaact

SEQ ID NO: 72410 - DNA, 123 bp, Zea mays
  Clone ID: LIB3078-009-Q1-K1-F2
cccacgcgtccgggcactcgcgcaagagctctactgccaatagttggttaagatactcaagaccttgtggtacttgatcctgctacatgtgcaattcacactaaggaaatgggtgatagtacg

SEQ ID NO: 72411 - DNA, 300 bp, Zea mays
  Clone ID: LIB3078-009-Q1-K1-F3
gccaatttcttttggtgattagtgcttgataaaatagtggaacagaagtaaatggtaagcttgttatcataatggttggaaagagctaacgtcacactcttgataacagaaaatcagtaaataaaattgctaggtatgacaacagaaaagtaatgataatcttcagaattgtagcgctgtgtttgatagtactctcgtgtgatgccatctaagacccgaccactatgctgaaaacttcttcaaacatttttctttctttcggatctacttaggtttcaaggtctataggtgatgcatact

SEQ ID NO: 72412 - DNA, 147 bp, Zea mays
  Clone ID: LIB3078-009-Q1-K1-F4
ctcatgcgtgcacgaacgcaacaccagacaccgaccaatttgaagcggaggcgaccggactccttggtcggtcatgtcatgccggggctagggcagatgggggctcggttagggctgagcgaagcgtcatccggaggggatgggcga

SEQ ID NO: 72413 - DNA, 81 bp, Zea mays
  Clone ID: LIB3078-009-Q1-K1-F5
gccacgccgtcgtggacgcgtgggggactattcggagaagccaccatctgtcagattccactcaagaatcaacatgacatg

SEQ ID NO: 72414 - DNA, 283 bp, Zea mays
  Clone ID: LIB3078-009-Q1-K1-F6
cccacgcgtccggcttgcagctcactcgggccgttgtgtgctatgaagttcgctacactggcctgtcagttatcttttgcatgcatatgcattatcatatacgcagtcgcgtagcaagttttcttatggttatcgcttgaactgaggggggagggaaggagctgtttgcttttgctgaagaataatggtgtagtcggctggggtgaagcgatgtgccgtgccagatacaggtttggcttgttgactctacttatctgattatcatttggaaagcgatttgctc

SEQ ID NO: 72415 - DNA, 373 bp, Zea mays
  Clone ID: LIB3078-009-Q1-K1-F7
gtgaggtccgttcagtttggccagaagggcatcccctacctgaacacctacgacggccgtaccatccgctaccccgacccgctcatcaaggccaacgacaccatcaagatcgatctggagaccaacaagatcatggacttcatcaagtttgacgtcggcaacgtggtcatggtgaccggcgggaggaacaccgggcgtgtaggtgtgatcaagaacagggagaagcacaagggcggcttcgataccatccacgtcgaggactccatgggccaccagttcgccacccgcatgggcaacgtgttcaccattggcaagggcaacaagccgtgggtgagcctgcccaagggcaagggtatcaagctcagcatcatcg

SEQ ID NO: 72416 - DNA, 213 bp, Zea mays
  Clone ID: LIB3078-009-Q1-K1-F9
tcggttcacaaaagcagtacccaattatttggtcttcgtctaagacgggaaaaagacccactcgatgcaggggcaatatatcggcgccagaaatggctggcaaggtctataaaaaggttgaggcaacccccaacgggagggtcttcttgattaaatccaaagcatttcccaaaccgggatacggaggcttgcttataaaggcggcgttaaacc

SEQ ID NO: 72417 - DNA, 411 bp, Zea mays
  Clone ID: LIB3078-009-Q1-K1-G1
cccaatcgtttttggtgattagtgcttgataaaataccggaacagaagtaaatggggagcgtgttatcataatggttggaaagagctaacgtcacactcttgataacagaaaatcattaaataaaattgctaggtgtgacaacagaaaagtaatgataatctttagaattgtagcgctgtgtttgatagtactatcgtgtgatgccatctaagacccgaccactatactgaaaacttcttcaaacatttttctttctttcggatctacttatgtttcaaggtctataggtgatgcatactttaagaatcgagaattctctgatgatccatgcacagctcgtctccacctctaggaacctctccgccatgctgttctgacgtcagaaccatctatatcttgaagaattcttg

SEQ ID NO: 72418 - DNA, 330 bp, Zea mays
  Clone ID: LIB3078-009-Q1-K1-G2
cccacgcgtgcgcggacgcgtggggccaggacggcaacaccaggacgcgcatggaggaggagtggaacatcgaggaggtggacttcaacatctggggcctctgcatggactgctttctgccggccagcgacctcagggagggcaaggagagccaggacgtcgccgtcgtcaaggccgacgcgcgcccgccgccgctgaggataccggccgtcaccgtgcgcgtctggccctcgcaggtggctgccgtcaacatggacgactcagactcgctcgtcgcgaggtcatgactactcgtcacgtaccgtacgtacgtacatacttgcagtgctg

SEQ ID NO: 72419 - DNA, 318 bp, Zea mays
  Clone ID: LIB3078-009-Q1-K1-G3
cccacgcgtccgcccacgcgtccggcccacccagcgtgcaacctaggcgagaaccggctggccctccgctccttccagcccgctctgtaatctggaccagcctcgcccgccgccgtcgccgccatggggaggggaaagttcaaggggaagcccacaggccgccgcaacttctccacacccgaggagatcgctgctggtacttcaggtcgggcacgcacctttaagaagaacgaggaagaggaagatgaggaagaggtagaaagagaagagtctgaggaaaaatctgaagaggattctgatgaaaagacttaacataaa

SEQ ID NO: 72420 - DNA, 338 bp, Zea mays
  Clone ID: LIB3078-009-Q1-K1-E3
cccacgcgtccggccaggtggtgctcatgggcgccgtcgaggggtaccgcgtcgccggcggcccgctcggggaggtggtcgacccgctgtaccctggcggcagcttcgacccgctcgggctcgccgacgacccggaggcgttcgccgagctcaaggtgaaggagatcaagaacggccgcctcgccatgttctccatgttcggcttcttcgtgcaggctatcgtcaccggcaagggccccctcgagaacctcgccgaccacattggccgacccgtcaacaacaacgcctgggcttacgccaccaacttcgttcccggcaagtgagcgagggcatgatgc

SEQ ID NO: 72421 - DNA, 209 bp, Zea mays
  Clone ID: LIB3078-009-Q1-K1-G4
cccacgcgtccgcccacgcgttcggggcagtccatcggcatcatcgctgatggcgaagacaagaacggcaagccgcacaagctcatgctatactccatcgacagcagcgccctcggagatttcggcgactccaagacggtatcgctttgcgtgaagaagctagtctacaccaacgatcaaggggagattggcaaaggagtctggtcaaa

SEQ ID NO: 72422 - DNA, 282 bp, Zea mays
  Clone ID: LIB3078-009-Q1-K1-G5
ctgacttcacctgggaggtggtgaagccactcaagtcggagaaaccttctgcctaaggcggcctttttttcagtaagaagcttttggtggtctgctgtgcttaatcatgcttttatatggcttctacatgttgtggttctttcttgatctgcaccgcgcttatcgtttgtgttgtacttgcctaataagtggtgcttatgaggactgtttctggttttgctgcttatgttgtaatgctttgaaacaatgaaagaagctacaggccacagctattttgagaag

SEQ ID NO: 72423 - DNA, 256 bp, Zea mays
  Clone ID: LIB3078-009-Q1-K1-G6
aatacattggtcatattacttgcgacttacagttagctttacctatgttcttgtattgtggagttgaaaatgaagcgagtgttgtaatgccctatgtcataatgtcatacgttcggattatttcttctttaatgggtgcgcaaaaccttgctagggtaagaagttaataaacttgatatcccccttaatttgattatttggggtccaaagctagttagtcaaaatattgtactaggttatctggcagagtaattta

SEQ ID NO: 72424 - DNA, 343 bp, Zea mays
  Clone ID: LIB3078-009-Q1-K1-G7
cggacgcgtgggcgcaccacacacgagcatacgcgacgactgacaaggcgaggggagcactcggcggcgatgggcggcggcggcgcacatggcggcaccacctaacaaggctacaccatcccgacaacaagcgctggcacaccgtcgccggcaagggcctctgcgccgtgatgtggttctgggttttctacaaggctaaacaggatggtgctacgctcttgggtttgcgtcatccttgggatggacatgatgaccactctcatggtcatggacacgggcatgaggcatcatcatcgtcatcttcacattaagttccttactggctgcggacgatgcttggcat

SEQ ID NO: 72425 - DNA, 414 bp, Zea mays
  Clone ID: LIB3078-009-Q1-K1-C2
cccacgcgtccgccggaatcaggaaggaagttgctgacttgatccacaaacgtgatggaggtcctagtgacccagaactcatttacctgacagacggcgccagcaaaggtgtgatgcaaatgctgaatgccatcattagaaacgagagggatgggatcttggttcctgttcctcagtacccactttattctgctatcatttccctctttggtgggtctctggtcccatactacttggaagaagacgctaactggaaccttgactttgcaaacatccgacaagcagtggccgaggcacgttcgaagggaatcactgttcgagcgacggtgattataaatgcaagaaatcccactggccagtgccttagtgaagcaaatataagggaacttgtgcgatattgctaccatgaaaact

SEQ ID NO: 72426 - DNA, 333 bp, Zea mays
  Clone ID: LIB3078-009-Q1-K1-C3
ccgcacgcaacgcaacgcaacgcatcctcgacctcaccgacgccatggcgagcaagcagacccgccgcctcctcgtccttgccgccgtcgccgtatgcctcctcctccccgccgcctctgtcgccaccgacgtcgattactgcagtaaaaaggagtacccggtgaaggtgagcggggtgcagatcgtgcccgatcctgtcgagcccggcaagcccgccactttcaagatctccgcttctactgataaaaccatcgagaaggggaagctggtgatcgacgtcaagtacttcttcttctacgtgcactcggaaacgcgcgacatctgcggagaga

SEQ ID NO: 72427 - DNA, 343 bp, Zea mays
  Clone ID: LIB3078-009-Q1-K1-C4
ctccctcccatctggggatgagatagtcatagaagaaagatcaccaaaggagttgctgaactctgaaggtggtctgggaaagcaagttgctgcatccggtatatcagtctggaacccagctttcgatgttactccagcaaatctgatcactgcaatcataacagaaaagggtgtgatcacaaaaactgatgctgatggatctttcgacatcaaaggattccttctgcccgcaaaataatactctctagcgtggcttccattctgaatgacataaatgtctggatcaacgcatgtgtattctgttttctctattatacacaataataaagtcatgtcctctcat

SEQ ID NO: 72428 - DNA, 253 bp, Zea mays
  Clone ID: LIB3078-009-Q1-K1-C6
ctcatcggctgggccgagggccgccgttgggctgacatcatcaagcccggaagcgtgaacgccgatcccatcttccccagcaacaagctcaccggcaccgacgtcgggtaccctggtggcctgtggtttgacccgctcggctggggctccggctcgccggagaagatcaaggagctgcgcaccaaggagatcaagaacggacgcctcgccatgctcgccgtcatgggcgcttggttccaggccgagtacaccg

SEQ ID NO: 72429 - DNA, 394 bp, Zea mays
  Clone ID: LIB3078-009-Q1-K1-C8
cgttacgcctggacctgcccccacttgagaatcccattcacctgggggtctagcaccgccggcctgtgccagacccaaccgcctagggggcccgtctacaccggccacggcttagaaatgagcgtccgcgtaaaccaacctgggcattttctcctttgccgcgagctcctcagcgacctacagtcctccgactacccctcttagcgcctcatgatcgtgggctccatcaccgggaacacgaacacgcttgccgggtacgtgcccccgaaggcgaacctgggcgacctgcgcggactacccggcggccttaacggcgttggcagctcggtgatgatcgacggcggggagttcgacggcgcctaggcatacatggacagcatggtgtgcaacatgc

SEQ ID NO: 72430 - DNA, 264 bp, Zea mays
  unsure at all n locations
  Clone ID: LIB3078-009-Q1-K1-C9
ccacgcgtnccccaaaaaaaaggttccgttatcggggcccggcccgaaaacacactgggtacatgcatcgaaaaatttgtcgagagttaaaatgcctagtggatctcttgagcgggttcctttaaatcaaaaggtcatttcgagaccacttgggccatacagaacaattctataactgtctctagatgatgggattatatgattatatgtatattatatattccggtattattggttgaagaaagcggcatgaaatttgtgtcc

SEQ ID NO: 72431 - DNA, 225 bp, Zea mays
  Clone ID: LIB3078-009-Q1-K1-D1
ggcggccgacctacagcagcggtggcgacggcagcgggtttgcctcgtcgtcgttcgcgccggccgtgaggatccagggcttcgacgtcgccgcgtgccgcgcgtgaaaacgagctccggccgggcggggctttggcttttcgatctattaaattaaattaacagcaggtggggtcaggtcaaatcagatcataataaggaggaaagcgaagaaggcgggaggga

SEQ ID NO: 72432 - DNA, 313 bp, Zea mays
  Clone ID: LIB3078-009-Q1-K1-D11
cttccgaaggtccgcgaaggcgtgttgtttaaaggccgcgccccaatctttttggaaggccggcttgaactacctgggaaacccaaacttgttgcacccacaaagattcttggcattttggccgtgcaaggggtggctaatggccttctccaagggctaccgcttcggcgggggccggttcggggaaggcttcgacaaggtgtaccccggcggcgctttcgacccgctgggcctggccacgacccgacacccgcgcgactcaagggaagagctcagaacggcgcttgcatgtctcatgtcgctttcggcagca

SEQ ID NO: 72433 - DNA, 161 bp, Zea mays
  Clone ID: LIB3078-009-Q1-K1-D2
gcgccaggagtttgcggtggagccattctagacttgaatacatcttaattagttcgtcagacacaatcagaaaatggtcacggactttgagactcaccatcaagattacattgatgaatggtaccagcagggggatctgaactatgataatgaccaggcgc

SEQ ID NO: 72434 - DNA, 363 bp, Zea mays
  unsure at all n locations
  Clone ID: LIB3078-009-Q1-K1-D4
ctttctgctgagctcaggaaatcccctctggtctccccgtcccccattccacccgccgtcgccgacgcgccgcgcctgttcaagatgaatgtggagaagctcaagaagatggcgggtgctgtgcgcactggaggaaagggcagcatgcgcaggaagaagaaggcagtccacaagaccgcaaccaccgatgacaagcggcttcagagcacgttgaaaagaattggagtgaacactattcctggtattgaggaggtcaacatcttcaaggatgatattgttatccaattccagaaccctaaagtgcaagcatccattcctgcanatacatgggtagtcaggtgagtaccccagacaaaaagtcta

SEQ ID NO: 72435 - DNA, 302 bp, Zea mays
  Clone ID: LIB3078-009-Q1-K1-D6
cccacgcgtccggcagcagcggcagcggcaggacgaaggcaggagcaagagcaacggcggccctcggctcaagtcacatggcgacgacggcgagcggatcaggacccgggaccgggacggcggcgctgtgctttctcgtggcctgtctcctcctggcctcgccgtcgtcgttcgttgctgggactgaagcggcggcggcctacggtgcaagtgcaggcgcatgtgcaagcaggaagctgatgcagacatctgcgggagctatgggataccccggaactaatctaccaccagcgacatacccc

SEQ ID NO: 72436 - DNA, 431 bp, Zea mays
  unsure at all n locations
  Clone ID: LIB3078-009-Q1-K1-D7
atctggtgcaataaaaggaatggcttacatagacttcaaggatcaggactctgtgtctaaagcccttgagctcagtggctctgacattggtggtggctatgagctntatgttgatgaagccaaaccaagaggcgatggccagcgtggtggtggtagatctggtggccgttctggtgggagatttggtgaccgttctggtggccggcgtggtggtggtagatttggtgaaagatctgggggcagggatggtggcggcagattcggtggccgacgtggtggtagggatggcggccgaggacgtggtggccgtggctttggtaacaagcacagcgctggcactcccagtgcaggaaagaagactacttttggtgatgattgatgatgaacgcggaggatgcggcaaaaggatccaatgaaattgtgtttttttg

SEQ ID NO: 72437 - DNA, 358 bp, Zea mays
  Clone ID: LIB3078-009-Q1-K1-D8
actggaacaagggagaaggattggagaggattgcatgaagaatgtaaagcattccgtgtaccacattaagggacttcttatcaaacgtgggcttgcaaaaaatcctggtttagcccatggaaattgggacagatttcttcccaaggtcaagaaaaaaaatgtccagccgaaaaaggcctaaacttaggggaagaaaccggtcacacccttttcaacggcttaacaggcttaacagaatgatctttgacttgggaacggtgagtatttcatgagtgacaaaaagaaatcagcaaagaaatgggcagagaagctggacaagcaatctgggagagctgaagaaaataaaagaaaaagagag

SEQ ID NO: 72438 - DNA, 384 bp, Zea mays
  Clone ID: LIB3078-009-Q1-K1-D9
gaccaacccggcaccgaggaggaaccaaaggaaagggaatatgtcgaggccgcccaccaggaacgacgcgcacctctccggcgaggacgaggccgcgctggagccgatgtgcgggagtactacgacgacgcggcgccaaagcgccacaccaagcccttccgcagcgagcactccgccgtgtacgtcgacgcgctcgtcccggacgtcggcggcaactcccacccggagctggacaagttccaagagctggaagcacacaccgagaggttggtgtacgagggcgccaatgtgggagatgagttcgtggagacggagtactacaaagacctcggcggcgtcggcgagcagcaccacacgaccggaacgggtttcatcaagatggac

SEQ ID NO: 72439 - DNA, 123 bp, Zea mays
  Clone ID: LIB3078-009-Q1-K1-E1
cccactcgtccgcccactcgttctttcactcgttcggacccactcgtcctcccacgcgtgcgcggactctttaattgtcaccgactatccaaataaagataaagttaactttgttttatcaaa

SEQ ID NO: 72440 - DNA, 161 bp, Zea mays
  Clone ID: LIB3078-009-Q1-K1-E10
cgaccccttggccgaccccttggccgaccccttggccttattatcccttgcctggaaaatattaacaagggccccaggcttaaggcctgtgaccttggtaccggtttccatgggaaaaccattggaggtaattacccttgccccaaaaggaaggctaccct

SEQ ID NO: 72441 - DNA, 203 bp, Zea mays
  Clone ID: LIB3078-009-Q1-K1-E11
ggaccccttggtcccgaccccttggccgaccccttgggcgggactttccaatgcgcgcggtaaggttggttaacttggcggcatgggcttccttggcggcgttttcgtgaaggccgtggccattaagggtcttgcccgcagcttcattttcgggagggaacttgccgttgccagggcctcgggccggttcattcggaaggccc

SEQ ID NO: 72442 - DNA, 306 bp, Zea mays
  Clone ID: LIB3078-009-Q1-K1-C12
gagccttaggctgatcataataaagaggcaccgcacaaggatgttcctacaacctgcaggagaccatggcaagggctgaggagctcgcctttgagggggtcatcgacgaggccaacgggagctctgatatctccaagttcgcggcgctggtgaacacggtggacgttatgatgggcgtccatggagctgggctcacaaactgcgtgttcttgccgaaaaacgccacgctgatccaaattgtgccgtggggagggttgaaatgggtgttccgcaccgacttgtgcaaccccgcggagctgatggggc

SEQ ID NO: 72443 - DNA, 225 bp, Zea mays
  Clone ID: LIB3078-009-Q1-K1-E12
ccgcagccagagccggttgcaagacctccaccacggggcggcaaatcagcaaaatgcggcccaccaaaaggctcaggataacccgaaccaggaagctgaggaccgccgccagataatgcttgctcaaattttatcttctgaagcaggaaaaaggctttccggattagctttggtcaaacctgacaaaccaggagggggggaggatgttttgctgaaagctgctca

SEQ ID NO: 72444 - DNA, 227 bp, Zea mays
  Clone ID: LIB3078-009-Q1-K1-E2
gccaccacacctgacgctcaagaacttcgaaggtctggacctcggcaaaatggaccaggctgctgattcagggctggcttcctatgtcgccggccaagtcgaccgcaccctgagctggaaagacgtcaagtggttgcagaccatcaccacgctgccgatcctcgtcaagggagtgctcaccgctgaagacacgaggcttgcggtggcgaacggcgcggcggggatca

SEQ ID NO: 72445 - DNA, 392 bp, Zea mays
  Clone ID: LIB3078-008-Q1-K1-H9
cccacacagcctcactaggggtctaccggcggcggcaacgagatggtgcagcgcctcacctaccgaaagcgtcacagctactcgacaaaatccaatcagacccgggtcgtgaagaccccaggtgggaagcttgtgtaccaatacaccaagaagagggcgagcggtcccaagtgccccgtcaccgggaagaagatccaggggatcccccacttgagacctgccgagtacaagaggtccaggttgtctaggaaccacaggactgttaaccgtccttatggtggagtactctctggaattgctgttagggagagaattatccgtgctttcttggttgaagagcagaagattgtcaagaaggtcctgaaaatacagaaaaccaaggacaagacagc

SEQ ID NO: 72446 - DNA, 326 bp, Zea mays
  unsure at all n locations
  Clone ID: LIB3078-009-Q1-K1-A1
cccacgcgtncgctgattcagtttatgatactgagaaattggccgagagaattgctaagcttgccggtggtgttgctgttatcaaggttggagctgcaactgagactgagcttgaggaccgccagctaagaattgaggatgcaaaaaatgccacttttgcagctatagaggagggcattgttccaggaggtggtgcggcatatgtgcacctatctacggttgtccctaagatcaaagaagcaattgaggaccctgatgagcgtcttggcgctgatattattcaaaaggcattggtagcacctgcttcattgattgcacacaatgct

SEQ ID NO: 72447 - DNA, 138 bp, Zea mays
  Clone ID: LIB3078-009-Q1-K1-A2
cggatttccagttccaggctcgacccacgctttcgacgaggtttgcgcatgataaaaggaaatatgctgtaccttgcggaaaaattcctccgtatggttgaattgtggattttgtcaacaaaaaagggccagtggaac

SEQ ID NO: 72448 - DNA, 247 bp, Zea mays
  Clone ID: LIB3078-009-Q1-K1-A3
tcgagctggttttttgagaaaagaccattgacccaccttgggcccgaaaggaatgttggaaggtaatattttgatcaacctcatctggggcattcttggattttgctttgctattggactctactaccgtactggaaaagaaaacttccttgtcacaccaatttctggtttccacgggtggcttggtggctttcttggggccctgaaacaactcttaccaaaccctgagcttcctatgtgctttttc

SEQ ID NO: 72449 - DNA, 306 bp, Zea mays
  Clone ID: LIB3078-009-Q1-K1-A4
gccacgcgcagctccacagcgccgtcaataactcgccttgccctgggcaggagccgctcaggatcgtacccatatcatgcggcaccttattcgtcgtgcctggtaagatgcactacccgtccgaggaatgcgtcgtcgcgtatctctgatgccacatcataaaacacttagtagatttactttacaaggcaccccatccgttgccagatctccacccgatgccttgccacatcaaggcgacgtttccttaataccatcctgttcctgatcacaataagcctgcgccagaataccttgattgcacgc

SEQ ID NO: 72450 - DNA, 130 bp, Zea mays
  Clone ID: LIB3078-009-Q1-K1-A5
cccacgcgtccgcccacgcgtccgcggacgcgtgggcacggcggtggcgccttctccggcaaggaccccaccaaggtggaccgcaacggcgcctacgtggccaggcaagccggcaaaagcatcgtggcca

SEQ ID NO: 72451 - DNA, 357 bp, Zea mays
  Clone ID: LIB3078-009-Q1-K1-A6
cgccgagctcaaggtgaaggagctcaagaacggccgccttgccatgttctccatgttcgggttcttcgtgcaggccatcgtcaccggcaagggccccatcgagaacctcttcgaccacgttgccgaccccgtcgccaacaacgcctgggcatacgccacgaacttcgtgcccggcaactaactgactgagcaacgccgtacatgtgtactaccatcagatccatccattcgttcgtgcgtccgtcgagtgaacagtgtgggcttctctgtactctacttgttcagatcgtaggcgtgtagtagttgcaccagccggcgtatgctcatgatcgatgtgtgctcatcaatcaatgtcaa

SEQ ID NO: 72452 - DNA, 218 bp, Zea mays
  Clone ID: LIB3078-009-Q1-K1-A7
attttgatgagtgctaccacacatgcatcgtgaggttgatggccgatatatatgaaacttcacattttttttggtggggaaggactgctgagtagactgtcaatgatggaatgctggtggtgcgagtgcgatgcatggtgcacttgtactatgttgtaaccagcgtgaaaaggggatactcgctagatgttaaaaaatatcaaatacatatagatacg

SEQ ID NO: 72453 - DNA, 426 bp, Zea mays
  Clone ID: LIB3078-009-Q1-K1-A9
cccacgcgtccgtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacaagatcagctaagttacgacgaccaagctaataagcctaccgaacgtacacgtacgttccgcgcgctgcacgagtgatgaagccaggggagaaataaaataaagccgctgtattgccaggaacagcatgcattatttatcgatctatatatatatatatatat

SEQ ID NO: 72454 - DNA, 391 bp, Zea mays
  unsure at all n locations
  Clone ID: LIB3078-009-Q1-K1-B1
ggggggggggggtaggggaanggggtaggggtccggaattcgaggcacgcgtcacgccgtccgaggcgtccgctccgcgcggaccgatcatcggggtgctcgagaacaaaatgttcgtgtgcaactttggggaccttaagctcgtgcaccagatcgagacggcgcccaaccccaaagggccttgcgctgggtcgcaacagcccgggtcaatcgtgcttggttgccccggggcccaaaaagggcaggttaaggtggaacactatggggcaaggaagaccaagtttatcaatgcacacactttccgcgtctcgtgcttcgcgctgtcgcaagacgggaggctcattgcaactgctagcaccaagggaacacttgttagaatctacaatgcagc

SEQ ID NO: 72455 - DNA, 317 bp, Zea mays
  unsure at all n locations
  Clone ID: LIB3078-009-Q1-K1-B10
ntccggaagttcattccgccaaccgttccatttccttcttgaagtccctcacagtgccaaaaccggtggtggaagggggaaccttggtctctggctcaaggaaggaaacgaggaggcattgcatttcgatgcacatggtcttgagggtcaacggaagcagcatgatattagggggtgcaaatgtgtattccttggtgaatacgatcatgaccaaagccaggaaaaggttagcctgagaagattgtcccggcggccaaagtacttttgaaagctgctcctgttagcctgatgggcatatctattctggaactggaact

SEQ ID NO: 72456 - DNA, 91 bp, Zea mays
  Clone ID: LIB3078-009-Q1-K1-B11
cgtcccggtggctaatttttcaagaaaggggtcggtcctattgggcccgccgaacccaaatccggcccttttgttggccttaaccaaggcc

SEQ ID NO: 72457 - DNA, 392 bp, Zea mays
  Clone ID: LIB3078-009-Q1-K1-B3
gggtccgtgcacagattactgctgtgcgtaaagagctgttctacagaaagttaccaataatggatgactcacttgctgtaaagcttcttccaggatggactacaatagacgaggttcgagagccgattctggaaagatgtaaagaagcggagaaaacggtcatagaacaagcaacagacaacgcgatccttgaccaagtcgggaagttggtcgaggtcgacgtcccacgtgccttgtttcaagagcaagggcagcagctttatggagccaagcttctgcagcttcaggcggaaaggaagctggataaagaccagctagcttcgttatcaaccaagaagtcagtgcaggcgtacctaaaagatgagaagggaaacattacaagaatcattaaa

SEQ ID NO: 72458 - DNA, 287 bp, Zea mays
  Clone ID: LIB3078-009-Q1-K1-B4
ccaagaaccaaaggtagctagctagccgcgactcgttggctagacgattcaagcagcagcgcaggatggtggcgccggtggtgattgcgtcggccgggctgggcatgctggccggcgtggcgatggccaaccggtccctcgggaacgggctcccggcggcctccaggtgggacgcgcgcccgcgctgcgccacgtgcggcggctccggccgcgtggagtgcatctgcaaccgctggtccgacggcgactccggctgccggacctgcgctgggtcggggaggatgccc

SEQ ID NO: 72459 - DNA, 293 bp, Zea mays
  Clone ID: LIB3078-009-Q1-K1-B5
cccacgcgtccgcgccatttctacgagaacccgcgcgtcggcaaggacggcagggtcatgcccaccagggagatgtacttcttcaccagcatcgccaggttccacctctacatgactctcatctacaaggtgccattagagattctgcaccttgtgaatctgctgctctgtggccttctctcgcggctctacaacgacctcaaccgcaagtacaagtttgtgatgcatctggttgacgtctacggcccattcgccttcttcaaaggatgcttcgatgacataaacctggagcg

SEQ ID NO: 72460 - DNA, 302 bp, Zea mays
  Clone ID: LIB3078-009-Q1-K1-B6
cccacgcgtccgtgggccaaagggcgacggcgtcgctgttgaggctggcatgccgaccagtggtgctgacatggatacgattgaaactgctttggaggggcgcggggcaagcgaggatgactcagcagttgatgtgagtggtggcttggatgaggcggcgacttccggtttggaggactccgaagccgcatcggaaggctccactgcacaggatttctacaccgacgttgaaacggattccatcggctacagcagcgacgagcagagagctgagttcggcttttccttaccaccaccggaac

SEQ ID NO: 72461 - DNA, 340 bp, Zea mays
  Clone ID: LIB3078-009-Q1-K1-B7
cccacgcgtccgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaa

SEQ ID NO: 72462 - DNA, 264 bp, Zea mays
  Clone ID: LIB3078-009-Q1-K1-B8
tgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggcgcgctgctcctggacggcaacaccctcaactacttcggcaacagcatcccca

SEQ ID NO: 72463 - DNA, 317 bp, Zea mays
  Clone ID: LIB3078-009-Q1-K1-B9
gcgtcgcgtgagagtggggggctgcacattaagaacccctgtagcgtgaaccatccacccgatcttcaagagctacagcctgccgccgcacgagtgcggctaccccggcagcgtcttcaacccgctcaacttcgcgcccacgctcgaggccaacgagaatgttctcgccaacgagaggctggccacgctggcgctcctggccttactgatgcagcacaacgtcacctgcaaggggccctgcgacaacctactgcagcacctcgccgacccatgtgacaacaccatcatgcagaccctgtcgggttgagtcgacagtc

SEQ ID NO: 72464 - DNA, 273 bp, Zea mays
  Clone ID: LIB3078-008-Q1-K1-H7
gccacgttggtgtcggcgtgggaaaggccaaggaggtcacggaggccatcaccaaggccgccatgaacggccggcgcaaccttgtcacagtgccgctaactaagtactccacattcccgcacagagctgatgcggactatggagcagccaaggtgatgctgaggcctgcttgccctggatctggtgtcattgctggtggagccgtgagggttgtgctggagatggctggtgttgaaaatgctctgggcaagcaactgcgcagcaaggaccccc

SEQ ID NO: 72465 - DNA, 151 bp, Zea mays
  Clone ID: LIB3078-009-Q1-K1-C10
cccacgcgtccgggcggaaggatccggtgcatgcaggtgtggccggcctacggcaacaagaagttcgagacgctgtcgtaccttgccgcgcttgtcacggacgacctggttaagcaagtggactacctggtgggcaacgggtggataccct

SEQ ID NO: 72466 - DNA, 176 bp, Zea mays
  Clone ID: LIB3078-009-Q1-K1-C11
gcagattgtgatcctcgtacgctgctatgagatgtgcatgtggaacggccataatgcgacaggaagatcaagctccgtgggcgcctccgcaagcggatgaacaccaagacgtgccacgggcccatccacttccgcgcctccggcaaaatcctgtggcgcaccatccgcgggatgat

SEQ ID NO: 72467 - DNA, 406 bp, Zea mays
  unsure at all n locations
  Clone ID: LIB3078-008-Q1-K1-G2
acgaaaggcgctggtagccccatggatgttctctgtcaggttggtctggatggaattgggatgcttgatcccaacactggtaggacactaagaatatatccccttgaaactgtaactagatgtgatgtattagattcctctatttttgccttttggtccaagagttcagtagatgttgaaggaaaaagaataaggctgaaatcaaacagctatacatccaacaccattcttgacactgtcacagctgcgactgtgcaattcaaggagattggtgaaagcagcatttcaagaagtatagcaattgctgatgcatccaagcccgctgagcagccaaatgagaggaagaaaaatgtccttgattggaggaatttaatgaagcctatgaatgangaagaagatcactggg

SEQ ID NO: 72468 - DNA, 366 bp, Zea mays
  Clone ID: LIB3078-008-Q1-K1-G3
ggacgccatcgtcgacgttcccgccgggctgagggacgagcgctgcctgcgcgccgagctgttggagaggctgcatccgagcggatagttagcagcttggtatcctcgtcgccggccgtcctgaaaagcttgagctgatctacttcgtctgcggcaaatcaagccagcacacctagcgtttcgatgccggattgcttgtactgcgttctcaggcgtcaaatcacgctgtctgcatgttatcttcaacctcattattactggtgagtccactgatgatggtgtccgacaatctggcccgcatctatagtgccaagtacttcggttgtggcgttagtcgtatctactcctgttgaggacatatatatt

SEQ ID NO: 72469 - DNA, 422 bp, Zea mays
  unsure at all n locations
  Clone ID: LIB3078-008-Q1-K1-G4
cccacgcgtccgtccacgcgtccgtccacgcgttcgcccacgcgtccgcccacgcgtgcgctggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctncaagaggtacctgaagtacttgaccaagaagtacttgaagaagcacaacgtgcg

SEQ ID NO: 72470 - DNA, 217 bp, Zea mays
  Clone ID: LIB3078-008-Q1-K1-G5
tcccaagccagtaccgagtcctacgagcagtcgcacgcaagtgtcaagagacgaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtcc

SEQ ID NO: 72471 - DNA, 274 bp, Zea mays
  Clone ID: LIB3078-008-Q1-K1-G6
tggaaagccagtacctagtcctacgagcagtcgaacgcaagtgtcaagagacgaatcggtcgacatggctcgcacgctatctatcgtatcggtcgccgtggtggccgaggtgctgctgctggcatccgcggcgacgacctcggaagccgccatcacatgctggcaggtgagcttcggcatcgcgccctgcctatcctacgcccgctgcacggggtccgcccaatcctcgtcctgctgtaacgtcgtcaggaacctgaagagcgccttcagcacc

SEQ ID NO: 72472 - DNA, 271 bp, Zea mays
  Clone ID: LIB3078-008-Q1-K1-G7
gggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacg

SEQ ID NO: 72473 - DNA, 328 bp, Zea mays
  Clone ID: LIB3078-008-Q1-K1-G8
gccactcgtccgcccacgcgtgcgcccacgcgtccgctcggacgacgaactaataaagcgcgcgcgcgcactcggagaggctcggagagctgaatgagatggcacaggccatggcgtgcatgaccggcctatcgcagggcgttctgtccagcaggcgcgccgccaacagggccaggacggccgacgtcgatagggcgtacggcgaggcgcaggcgcaggcgcaggcgggccggcgagccatgctcggactggtggccactggcatcgtcggcggcgccttgtcgcatgcggtgcacgccgagaccgtcaagaccatcaagatcggagc

SEQ ID NO: 72474 - DNA, 335 bp, Zea mays
  Clone ID: LIB3078-008-Q1-K1-H1
ggtttgttgataagttcaatatcatcatgcgcaaatctttgggcaatcattatggatgcaggaactggcttctcagctcaagtttatgagctatcttcacactttcttcataaggagtggatcatggaacaatgggataaaagtttctacatcagttctgttgctggctccaacaatggaagttctattgtagtgatgtcaaaaggcacaccatatacacagcaatcttataaagtcagtgattcctttccatttaagtggataaacaagaaatggaaagaaaggtttcatgggactgcaatggcaacatcaggcaatcgatgggctatagtcat

SEQ ID NO: 72475 - DNA, 429 bp, Zea mays
  unsure at all n locations
  Clone ID: LIB3078-008-Q1-K1-H10
acgccattcaacgacacactgtggcggacatgggttaacgatgagaaattcctcatcgacaccgactcctccaactacatggtgtggtcgtccagtggccggattgcttatcccaagggtagcaagcagatgacaagagaagtggctcctgacaatgtctacaactctgcaagatccgtgaggccaggggtgaatgtgacttggggtttccctgtgcctgctagcagccggtaccttgtgcgtatgcacttctgtgacattgctagcaaggctctgtatgagctctacttcaatatctacgtcaatggtgatcttgcagtcaaggatttcgatctctccagtgcaactggattcttggcctatccttattacattgactntatcgtcgatgtgaaggatgaggggatactgaaattggcgattggtggc

SEQ ID NO: 72476 - DNA, 398 bp, Zea mays
  Clone ID: LIB3078-008-Q1-K1-H11
ccgattggaaaggccaagctcaaaaatggtttttatttaggcttactggaaatgacgatgagattaaccttaatggtgatggatctgagaagccagagtttggtgaatggacatggatgacacccaaggaagttatcgaaaaggcagttgatttcaagaaacctgtatatgaggaagcattgaaacactttgccccctacctgcagtcagatccagccgcttcatcatagaagatttggccaatttgcttgcatccctgctgtatctggacccccaataatttgacacgacgcaatgtagccatgaggtgtgctatacaatttgatagtgtgtggcctgtttgagtgaattatatatgccagcattggatcctcgccctctacttagtcacataagta

SEQ ID NO: 72477 - DNA, 401 bp, Zea mays
  unsure at all n locations
  Clone ID: LIB3078-008-Q1-K1-H12
cttcacgctgccgctgcgctctgtgtcggcgccggcgccagcgaggcgggtcttcgagcccgttgccgtcgcggtgtcgtcggagtacgggaccgatggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgncacctagagatggatccgcaccaagagcac

SEQ ID NO: 72478 - DNA, 401 bp, Zea mays
  Clone ID: LIB3078-008-Q1-K1-H2
aggccacgcgtccgaccacgcgttcgcccacgctggtcgcggacgacgtggtcgagaaagaggcataggtgctgagaacatgcacagcaacagcttgaacagggggatcagagaggcccacgacaccattggctttggcataaacgccggcgtcaaagacgacctcgactcggcgcacccgctccagtctaccatccaatctgataccaagttctgggcggacatgaagaagatcgggacagatgccatatacagatacgtcctcaatatccgcaaggatctcgatgccctaatcctctacaggatccaaaggctccctgtagctttgacgttatctgtgctcggatacgaggcactgtcaagttccctggatgatgttggacttgaagactatcctaaca

SEQ ID NO: 72479 - DNA, 310 bp, Zea mays
  Clone ID: LIB3078-008-Q1-K1-H3
gccgccaccggcaaggggccactcaacaactgggccacccaccttagcgacccactccgtaccggcatcttcgacgttcggaggatcctcttaagcccgccattgatccgctccgtccatcgatcgaaacgtggtcttgaattaactatgatagatctctatgagcctggagatggatcaacccgtcgtgcgtagtttcattttgtgatgaatgggagagagggtatgggacaagattgatcaacccgtcgtgcttacgttttggtaattaggagagctaccgctcggatttggagaattggaatatatg

SEQ ID NO: 72480 - DNA, 436 bp, Zea mays
  Clone ID: LIB3078-008-Q1-K1-H4
gcctgcttggtgtctgctggtttctctcttgcatttgctatctctatcattccacggcaggttgtgccatggacaggtttgctactgatgcttgagtggacctttgtggcattcttcttattgtttgggagttatctccgttttgtctaccggtggggaagtatcagtgcaaaccatgtgggatttagcaattctgactcatcggagaatcatatgggtccaggccatcagcgaaatatgtctgactgcgacatggatgcaacattttactggacagggatggcatctatagctactattactgtactgttaccgactatcttgggcataactgcattgttcacaaagctaggattaatggtcgctggtggtattgtgctggcatcttttatgacatactcagcggagcatcttgcaatctcagtcttcaacaagg

SEQ ID NO: 72481 - DNA, 378 bp, Zea mays
  Clone ID: LIB3078-008-Q1-K1-H5
agatcacctaccagttctaccgcgtcttccccaacggcgaggtgcagtacctccaccccaaggacggcgtctacccggagaaggtcaaccccggcagggagggcgtcggccagaacttccgcagcatcggcaagaacgtcaaccccatcgacgtcaagttcaccggcaaggccaccttcgactaatcacacttcacgtacgccgcacgccccagccgggatccaaattaaagaacttcttcttctattaattacagtatattggaatttggctgctggtacggtggtggcatgatttgagatgggcatgatgatccctggggaattttattaccaagtcttttcttatatttacatggtcatttgcttgcttcttgcg

SEQ ID NO: 72482 - DNA, 438 bp, Zea mays
  unsure at all n locations
  Clone ID: LIB3078-008-Q1-K1-H6
cgcacaccaagagatagagattgctggtcgagaagaagagatgttacatatataataactactgtaggcagcggcatctcctgctgggacgaaggttcaagaagctagctaagagagaagggcataacgagataataagcagcgcgcgaagatgcaagactgggcgccggtgttcgtctcgctggtgctcttcatcctgctgtcgccgggcctgctgttccagatgccgggcaagtgccggatcatcgagttcggcaacttccagaccagcgccatctccatcctcgtccacgccatcctcttcttcgccctcgccgncatcttcctcgtcgccgtcggggtgcacatgtacctcggctcctaggcggcggcgcggngcgccgtaccttctctctctcgccgngcgcgccattcgtctcttcttttatggtctctctc

SEQ ID NO: 72483 - DNA, 395 bp, Zea mays
  Clone ID: LIB3078-008-Q1-K1-G12
gtagtacctattactcaagcaaatttccttctactttctaaggttgatcgatgctctggaactgatgaggcatggagtgaagcgctttcttgttcgcaagagtgggagctggaaaggcattaccaagagattttcagtgctttataatggtaagtggctgaagaacatggaatcaacatctccaagtgcagccagcagcagcagcacgcagctatccccacgttctggttctgcagaaaagttctgctgcctatcaagggaagatgttctccggtttctcattggatgccttggtgctcttgctcccatcccgctgactcagatatcttcccttggagccatcaatccgcagtacagttacgtggaagcatctgcgcctgcgatggaagcaattc

SEQ ID NO: 72484 - DNA, 206 bp, Zea mays
  Clone ID: LIB3078-008-Q1-K1-E3
tccactcgtgcggtcatgacgctctggttgtctgtatctgggatagagacgcaataatacatgggctgtttactgccaacaaggtgaccacgatcttattgtatcgctgtgaattgcttatccctgtggtcgctgtatgccgtacttattgtcgcactgcttgatacttgtccaaatatactgctgcggtcccatgtactcgagtc

SEQ ID NO: 72485 - DNA, 242 bp, Zea mays
  Clone ID: LIB3078-008-Q1-K1-E4
gccgtcactctgaatccgcgggcgctgcggcggcgcgcttcctcgggcagcggctgccacaggagcagcccccagcagccactgatgagcgacctgctacccccggctaccgtcgcctgccgagctcgctctcagtctgcttcctcgtctaatgtgaactctgggagaggggatgacgacgacaagttgctcgaggatttgctcaaacagcatggcgaggcggtgtacagctccggtggacc

SEQ ID NO: 72486 - DNA, 158 bp, Zea mays
  unsure at all n locations
  Clone ID: LIB3078-008-Q1-K1-E6
tcgtctcgtgatgtgtcaactggtttggctttggattggtcgtgcttcaatggggtgtcatttttacgttgcgtggctgggactaaaggggtaacgaaggtactttggcatgtccaaatgtcgtaggattatcgnaatccatcagtccatttcaggtg

SEQ ID NO: 72487 - DNA, 340 bp, Zea mays
  Clone ID: LIB3078-008-Q1-K1-E7
cggacgcgtgggcggacgcgtgggctagtagtgggtgtcgtatactgcctcatcagctggagtgtcggtctccccaagcgagcgcctatcaatggcacgctcctcaagcttctctttccagtcgccctgtgccatggtattggtcacatcactagcaatgtgtccttcgctgctgttgcagtctcatttgctcacactatcaaagctctggagcccttcttcagcgcagcggctactcagtttatccttggacagcaagttcccttctctctggggctttctcttgcccctggggtcattggtggttcaatggcattccttactgagctttcattcaact

SEQ ID NO: 72488 - DNA, 341 bp, Zea mays
  Clone ID: LIB3078-008-Q1-K1-E8
cccacgcgtccgtgaaatttgtcaggactagccatgctgagggcgcaatggattcatcagttgacgaagcctcagcaggagatggttcgatgctgaacaatctcatttctcaagatgactctggtgcgtcttcttcaaaagcttctcagtccttctccctactgtcaccgttccgcagcatgcacatggtgattgttctgtgagcacaaggtaatcaatttgagacgagaggcatataatggcgcagcacagtacatacttttggtttttcccttctagtatatattcacacacacgtatacataaatacatacatactatatgacggacttgtcattaga

SEQ ID NO: 72489 - DNA, 293 bp, Zea mays
  Clone ID: LIB3078-008-Q1-K1-F1
gccgaccaggccgccatcctcaacgcgaaggctatcaagaacggtcggatcgtcatgtggctccatgttcgccttcttcatccaagcctacgttaccggcgaaagcctcgtcgagaacctctccaagcacctcatctaccccttcgtcaacaacctgcttaccgtcatctccggcgccgccgataggacgcccagcctgagaagactcgccacaaggccggcagttatgccaagtcatgcgctgttaccgtacttgattttaccggggaaagatctgtgtgtgacggtctgaa

SEQ ID NO: 72490 - DNA, 417 bp, Zea mays
  Clone ID: LIB3078-008-Q1-K1-F10
cgcgctgccgtggttcaagacgggcgtcatcccgcccgcgggcacgtacaactactgggccgactcctacacgctcttcgtcttcaacatggcgctcatgggcttcgccgagcaccgtcggctccaggactggtacaacccgggctccatgggcaagcagtacttcctcggcctcgagaagttcctcgccggctccggcgacccgtcctaccccggcgggcccctcttcaacccgctcggcttcggcaagaccgagaaggagatgaatgagctcaagctcaaggagatcaagaacggcaggctcgccatgctcgccatcctcggttacttcatccaggggctcgtcaccggcgtcggcccgttccagaacctgctcgaccacctcgccgaccccgtcaacaacaacgtgctcaccag

SEQ ID NO: 72491 - DNA, 315 bp, Zea mays
  Clone ID: LIB3078-008-Q1-K1-F11
ctttgctgttgagccatggactaagggctttagcacgtcgtgtgcggcaccatattcggctggagccacagagcatcaattatcgatcgatgagaaggtggataactccaccgttgcatctgattctgatgggaagtcaccagtttctgaaaaattgaagtttctctctggttcatgttacttgcctcaccctgataaggaggctactggtggtgaggatgcacatttcattagcattgatgagcatgtgattggtgtagcagatggtgttggtggttgggcaaatgttggtatcgaagctggactatattccaa

SEQ ID NO: 72492 - DNA, 403 bp, Zea mays
  unsure at all n locations
  Clone ID: LIB3078-008-Q1-K1-F12
ggcaagcagtacttcctcggcctcgagaagttcctcgccggctccggcgacccgtcctgccccggcgggcccctcttcaacccgctcggcttcggcaagaccgagaaggagatgaatgagctcaagctcaaggagatcaagaacggcaggctcgccatgctcgccatcctcggttacttcatccaggggctcgtcaccggcgtcggcccgttccagaacctgctcgaccacctcgccgaccccgtcaacaacaacgtgctcaccagcctcaagttccactagaacgtggtgcatcagcatacctgctgctgccgtcgncgtcgncagttgtttgctgtggaaagctagatgcatgcgtgttgtaaaggaacctgaagcgttgcatcggtcatgattcatgcat

SEQ ID NO: 72493 - DNA, 369 bp, Zea mays
  Clone ID: LIB3078-008-Q1-K1-F2
caaacaccatagttctatctgggcttagtggcagtggcaaaaccactatttactaccagcttcgggatggatcatcacatcaaggaactgttacttcaatggaagaaaacagtgatacttttgtgctgcattcggagcaagaaaggaaagacaaagtaaaacctgtgcatattattgatgttcctggtcatgctaggctcaaacccaaacttgatgaagtcctgcctaaagctgctgcggttgtctttgttgttgatgctcaagatttcttgtctagcatgcaagctgctgcagagtacctttatgacattctgacaaaagcaactgtagtgaagaaaaaagtccctgtgcttatattctgcaacaaga

SEQ ID NO: 72494 - DNA, 228 bp, Zea mays
  Clone ID: LIB3078-008-Q1-K1-F3
gcggcagcgtattgtatctacgctaattggcatttaggaaaccactatctactatcacgttggggatggatcatcacatcaaggaaacgtatcatcaatggaagaaaacactgatgcttatttactacattatcctcaagaattgaaagactcaactgaacctatgcataatattgctgatcctggaaatgctaacctcagacccaaacttgatgaagtcctccctaa

SEQ ID NO: 72495 - DNA, 323 bp, Zea mays
  Clone ID: LIB3078-008-Q1-K1-F4
gtcgcagctgacggacgactgaaccaccgacagacaacatggccgcctccgcctccaccgtctgcggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatc

SEQ ID NO: 72496 - DNA, 244 bp, Zea mays
  Clone ID: LIB3078-008-Q1-K1-F5
cgcaacgtcaagctacgcgtccacataactaacaatgcttagatcaacatgcacagtgaccgcgacaaggcgatacaccatggtctcatggttaaccagagctaccttgcgcaagctcaggatcatactcagcgcaattactgtatcaactctactgtgcactcaccgtgtctgcatgacagcactgcaactgcacacgaccacagatgcatatgtttatgcaacggatgccattgcaacaacc

SEQ ID NO: 72497 - DNA, 373 bp, Zea mays
  Clone ID: LIB3078-008-Q1-K1-F6
cccacgcgtccggacatttttttcgctgtcaaggcatttgcagccggtgtcatcctggccacgggcatggtccacattctgccagcagcatttgatgggctgacatccccatgcctctacaaaggtggcagtggtgggaacattttcccctttgcaggactcattgcaatgtctgctgcaatggccactatggtgatagactcactagctgctgggtactaccgccggtctcacttcaagaaggcacggccaatcgacatcctagagatccatgaacaaccaggagatgaagaaaggtctgggcatgcacaacatgtgcatgtgcacacccatgcaacacatgggcattcacacggaaaggtggatgtcatca

SEQ ID NO: 72498 - DNA, 430 bp, Zea mays
  Clone ID: LIB3078-008-Q1-K1-F8
gcggcggcggtgtgcgacatgagcaacgagcagttcatgtcgtgccagcccgcggcggccaagacgacggacccgccggccgcgccgtcgcaggcgtgctgcgacgcgctggcggtggcggacctcaagtgcctgtgcggctacaagaactcgccgtggatgggcgtctacaacatcgaccccaagcgcgccatggagcttccggccaagtgcggcctcgccacgccgtccgactgctagcagtgtgctagccaagccaagccaagcaggaaggcccccggcattgctagctgtacgtgtctgtgtgtgcatctgcagcagggtgcaggcaggggcccgtacgtacgtgtctctttctctctctcatcttgtcaccgtacctatctagagtgtgtgtggtcgtactaattaaaatggtcctggcgtcgtc

SEQ ID NO: 72499 - DNA, 336 bp, Zea mays
  Clone ID: LIB3078-008-Q1-K1-F9
cctgatcattgatgagaccacagtattgtttaacaccccgctcataggaatattattggggctgctactggaggtcttccgcatgtacgcaatcacacacgatgctccatataggctatatgccactgtccatgctgaattgcctgatgctcttacgaactctacatggtcccacatgcgtaatggatcaggactatgacatggagctgtactaaagctccaatgtggacatctataatgcagtgcagatcgaacttctcaatcctgaaatatatgaccaagatccctttaaagactatgactatgctgactcgtaacgctttaagtgagctgact

SEQ ID NO: 72500 - DNA, 170 bp, Zea mays
  Clone ID: LIB3078-008-Q1-K1-G1
aggccacgcgtccaaccaagcatacatttgtaatacttcatagaacgccaagtcaatcaccggataggaccttttgaactacatgccaactcattatacagatcccaaaacggatatgacaaatttaatgggcgttacacataagcacattgatgtacatgccaagaaat

SEQ ID NO: 72501 - DNA, 317 bp, Zea mays
  Clone ID: LIB3078-008-Q1-K1-E2
gagttcttagcaaagtcaaatgtatcaaggtgtgttgacttcaaggagactgccgatggtattgcgaagcttggcttcaaaatgttcttgggcgtgactgcaaccgtgaccaattgggatgctgagggtacaagttgcagccttgtcctggaagacaaccctcttgttgatttcgttgagctccctgacacttgccaaggccttcagtattgcaatttgttaagtggagttattaggggggcattggaaatggtgtctatgaaggctgaagtgacatgggtgcgtgacatgcttcgcggtgactattcctatgatat

SEQ ID NO: 72502 - DNA, 289 bp, Zea mays
  Clone ID: LIB3078-008-Q1-K1-G10
cacaaactggaatttgcacgtccattgccatagctggtgttgctaggtactcttacatgaaggctaggattgaagaggagaaaaggaaaaagagcgcatgactgctgtgaataatattatcgggaccttcctcggacacaacatcgtcgacaatcacgacctacttctataccttgttttgttttcatcttgagtcagtcggtccattgtttgttcccagtctggtgattaaaagtctgcaaattctgtttgtggaattggcagcgatacaaatttggcttctttaagt

SEQ ID NO: 72503 - DNA, 382 bp, Zea mays
  Clone ID: LIB3078-008-Q1-K1-G11
gcttggtcaaagtaaaaggccagatgacatgagcagagttgctgggttagataaccaaggaattgttggccttcagaggcaaattatgaaagagcaagatgagggtctcgagaagctggaagagacagtgctgagcacgaagcatattgcattagcagtcaacgaagaactttccctgcacacaagattgatagatgaccttgaagatcatgttgatgttacaaattcacgtcttcagcgtgtgcaaaagaggcttgcaattctgaacaagcgcaccaaaggtggctgctcatgcacgtgcctgctcctatctgtcgttgccattgtgattcttgcaatcatcgtttggcttctcgtcaagtatctgtaaagaaaagaaaga

SEQ ID NO: 72504 - DNA, 334 bp, Zea mays
  Clone ID: LIB3078-008-Q1-K1-C8
cccacgcgtccgcccacgcgtccgcccacgcgtccgcggacgcgtgggctgatgaagatatagaaaatctgcagcttgctgaagatcttgccaaaacatgtgttgagatgtacttcgtgacctctaccggccttgctcctgaaatagcttatttccacattgagggtgatacagaaggggggcctgatggtgggaataaaagctccaaatatatcaatgatatcgtaataaaaccacttgaccgtcacaatcttctacgcccagagactgtggaatcactatttgttttgtatagaatcacagaagattccaagtataaggagtggggttggca

SEQ ID NO: 72505 - DNA, 348 bp, Zea mays
  Clone ID: LIB3078-008-Q1-K1-C9
cccacgcgtccggaggatgcccccatggaaattgtggatgaggaagccaccaagcctgagggatggttggatgatgaacccgaggagattgatgatcctgaggcagccaagcccgaggactgggactatgaagaggatggtgaatgggaggcaccaaagattgacaaccccaagtgtgaagaggcacctggatgtggcgagtggaagaggccgatgaagcagaatcctgcttacaaaggcaagtggcatgcacctatgattgacaaccccaactacaagggaatctggaagcctcaggagatacccaaccctgagtactttgagcttgacaggcctgattttgatcca

SEQ ID NO: 72506 - DNA, 187 bp, Zea mays
  Clone ID: LIB3078-008-Q1-K1-D1
cttctgatacgggcctaagactcagctgatcgcctaaggattggtacttgtgtggccaaagacctattcacatgacagggtacggggagcctcgagtggtggtaacctattcatactttgctacgatgtgatacggatgcactgtctatacgaggaactgctggccttaatgttcattcatcacatg

SEQ ID NO: 72507 - DNA, 421 bp, Zea mays
  Clone ID: LIB3078-008-Q1-K1-D10
cagtgttgcatctgttgtcacagctgcagataagggaggtgcaacacatgttgacatagcatgtgacaaggacttagtaaagcttgccatggatcttaccaaccttccgatctgtgtctcatctgtagatccttcagcgttccattctgcagtacaagcaggagctaaaatggttgagattggaaactatgattctttttatgagatgggcattgagttctcctctgagcagatactgaaactaacaagggaaacatggaagatgcttccagacatcaccttatcagtaacagttcctcacacacttagtttgccagatcagatgagactagcagagctactcgaagaggaaggagctgatataatccaaactgagggtgggaaatgttctagcccgacaaaacctggagtgcttggattg

SEQ ID NO: 72508 - DNA, 430 bp, Zea mays
  Clone ID: LIB3078-008-Q1-K1-D11
agactgttttaactgcttgccagtgtcagcattgatagatgaaaagattctctgtatgcatggtggtctatctccggagttgaacaagcttgagcaaatactcaacctgaatcgccccacagacgtgcctgatactggattgctctgtgatcttctttggtctgatccttccaatgaagcaacaggctgggccatcaatgatcgtggtgtttcattcacatttggtcctgataaagtttctgaatttcttgagaagcatgatttggaccttatctgccgagcacatcaggttgtcgaagatggatacgagtttttcgctagccgtcaactcgtaacaatattttcagcccctaactactgtggagaattcgacaacgctggtgccatgatgagtgtagatgatacattgatgtgctcgttccaaatattg

SEQ ID NO: 72509 - DNA, 410 bp, Zea mays
  Clone ID: LIB3078-008-Q1-K1-D12
cgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtctggatcaagcagcgtcacatcagggttggcaggcaaattgtcaacgtcccatcattcatg

SEQ ID NO: 72510 - DNA, 316 bp, Zea mays
  Clone ID: LIB3078-008-Q1-K1-D2
gccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaagctttggctttgtgaactacttcgacagtga

SEQ ID NO: 72511 - DNA, 307 bp, Zea mays
  Clone ID: LIB3078-008-Q1-K1-D3
agcatccaaaacaactccactcctgccaccccaagtccgaagcttcctcctcctccaaggcctccgcctccccgtcccgcagtcgcactcgcaccgcacggcagcaggtagctagctagctagctgcgggcttctgtagccaagcagggccggagcacgcacgcacgcgcgagcgcgagcgcatggcggcgtccgcgagccgggcccgcgccggcgccggcggcgctggcgaggagtacgaggacctgctgccggtgatgggcgagcggctgggcgtggcggggctgctggcggaactgcgcgcggg

SEQ ID NO: 72512 - DNA, 362 bp, Zea mays
  Clone ID: LIB3078-008-Q1-K1-D4
cagaaggtaaaatgtgtaatggttatgatatcatcctgatggctgagactgtttacgcggtatcttgtcttccaaatctctacaggctcatcaagaagtgcttgcgctaccctgggggtgtggtttacatggcagggaagaagcattactttggagtaggtggtggcacaaggcagtttctgcgcttggttgaaaaagacggcgccatgcatcctgagcggctcaatgatgttgctgatggatcatccaatgttagggaggtttggaaattctcattcaaatagattagcactgcccctgcgattgtcgggagaactggaaacatgtactggactccatattgggtgatagggaagtcttat

SEQ ID NO: 72513 - DNA, 329 bp, Zea mays
  Clone ID: LIB3078-008-Q1-K1-D6
caagaagctggcgcccatcttggacgaggcagccaccactctccagagcgacgaggaagtcgtgattgctaagatggacgcgactgccaatgacgttcccagtgagtttgacgtccaaggctacccgaccttgtacttcgtgaccccgagcgggaaggtgacatcctacgacagcggcaggacggcggacgacatcgtcgacttcatcaagaagagcaaggagaccgcaggcgccgtcaccaccaccaccacccaggcgccaccggcatccgagaaggcagccgtcgtcgagcccgtcaaggacgagctgtgagcatccaaagtgtgga

SEQ ID NO: 72514 - DNA, 363 bp, Zea mays
  Clone ID: LIB3078-008-Q1-K1-D7
atctgatttctatcacagagcttcagaattataccgtgaatgtggaaggccacaacctgcatctgatgctctagcaaagggtgccagtgcattggaggagaaatctccagaagaagctatcaaaatgtatgatgaggcttgttcagttctagaagaagatgggaaggaacagatggcttttgacttgtaccgtgccgcagcagctttgtatatcaagatggagaaatattcagatgccgctgctttgtttttaagacttggttcagctgctgataagtgcaatgccatcaatagccaatgcaaggcctatctgaatgcgatcatcatctatctttacacacatgaatttcaagaaggttaaaa

SEQ ID NO: 72515 - DNA, 392 bp, Zea mays
  Clone ID: LIB3078-008-Q1-K1-D8
cccacgcgtccgtccacgcgtccggcctggtcacgtgccgccaacggtcgcccctcaggaaatacgggagcaccagagcttcgcttgcagtgcgatgacgggcatgtgatctcgaagattacatttgcgagttacgggacccctacaggaggttgccagaacttctctgtagggaattgccatgcatcgactactctagacttggtggtagaggcctgcgaaggcatgaacagatgcgcgatcagtgttaccaacgaagtattcggagatccatgccgcaaagtcgtcaaggatttggcagttgaagccgagtgcttcccgccatcggttaacccagaacctcgatacgatgtatgatcacgggtccggaatggggtgcctaagtcttggaa

SEQ ID NO: 72516 - DNA, 341 bp, Zea mays
  Clone ID: LIB3078-008-Q1-K1-D9
cgcatccgccggcgcgtgccctgtcgcctcgcgcgcctaggaggccctcgccggggtcgccggcgcggtagccaggaagctacccgcagccagcctcgcattcccggcgaaatccttcttcggcgcgccgctggccgtcaccgcggcctccgtcgcgtcgccgctcccgcgcaagccggccaccttcaccacctcgctcgaggtcgtcgcggcggggaagaagggctacaagatgaagacgcacaaggcgtcggcgaagcggttccgggtgacggtgaagggcaagatcgtgcggcggtgcgccgggaagcagcactggctcgccaagaagtacacccagc

SEQ ID NO: 72517 - DNA, 350 bp, Zea mays
  Clone ID: LIB3078-008-Q1-K1-E1
gccagggccagccggccaaaacacagaaaagctatacccgacctccgctcgccggcgcccggcaggatggcttcgtcggcggcgtaccctgatgcggacgagaacctggaggccatcatcacccgcatagagcagaagtcccgaaagatcgagacccttctcaagcagtcgaagccggtggaggccctaaagacggcgctcgaggggtcaccgctcaagacccgcgacgagcgatgcaagtcggcgaactggatcgtggtgcaccgcgcgttgatggcgattagggacgtagacggcatgttcaacttcctggatcccgagtactacgacatccttatgaagtaccttta

SEQ ID NO: 72518 - DNA, 422 bp, Zea mays
  unsure at all n locations
  Clone ID: LIB3078-008-Q1-K1-E10
ccctctctctgccgataacgatgaagttgattcggggtcgccacaggagaacggatggagcaaagtggggaacatcggtgatcttacagaacagatgggccttctgtcatcaacaaatcaccgcgactcagggaatgggctgtagtgtatcttaattaatatacggtagactgggattatcggtaataagcgtcgcctgcagtttttgttatttttccttttggccaaaaaatgatatgccggtatatcaaccactcgctcgacctatatgcgcgggaggggcagtcttccagctgagctctgaatgccacagccacctgcttgtatcaatctatgatgttggcagtcttgagaacaccactgtgacttgttaaatctgtatgcttattcccactctagttgctgatatntgttagtttgtt

SEQ ID NO: 72519 - DNA, 383 bp, Zea mays
  Clone ID: LIB3078-008-Q1-K1-E11
ctaccagcgactcagcgagcgagagcagcacacacgcagctagctaggagcagcagcagcggcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatct

SEQ ID NO: 72520 - DNA, 405 bp, Zea mays
  Clone ID: LIB3078-008-Q1-K1-E12
tgccaaggaggctgccagcttcacctcccaggtcatcatcatgaaccaccctgggcagagtggcaacggctatgccccagtgctggactgccacacctcccacatcgccgtcaagtttgctgagctcattaccaagatcgacaggcgatctggcaaggagctcgagaaggagcccaagttcctgaagaacggtgatgctggtatggtgaagatgattcccaccaagcctatggtggtggagacattctccgcgtatcctcccctgggtaggtttgccgtccgcgacatgaggcagacggttgctggtggagtcatcaagagtgtggagaagaaggacccaaccggcgccaaggtgaccaaggcggccgccaagaagaaatgatgcgatcccgtgtctgcttttgc

SEQ ID NO: 72521 - DNA, 360 bp, Zea mays
  Clone ID: LIB3078-008-Q1-K1-C7
cccacgcgtccggctctgcaagcggaccctcaagctcgtgcgacgagcctccgaggcgaagtgcctcaagcgcggagtcaaagaggtagtcaagagcattcgccgcgggaacaaaggattgtgtgtgatcgctggaaatatttctcctattgatgtgattacacatgttccgatactatgtgaggaagctaatgttccttacgtatatgttccatcaaaagaggatcttgcgaccgcaggaaccactaagaggccgacttgttgcgtcttggttctgaccaaaccaaacaagggggagctcagtggagaggtgaaggataaactgaagtcggactatgaccaagttgtaacggaagtcgc

SEQ ID NO: 72522 - DNA, 256 bp, Zea mays
  Clone ID: LIB3078-013-Q1-K1-C6
cccgcatggcggagttgaagagttaggccggagtggttctacatttctgtgccgcgagacgcaacattagtttttctgcccatgagtgatcatggtaattattttttccagttcgtaaagtggttactgtcgaatttgcttcaatgcggttggccattattcactgggatatgtatttttaggatttcaaatctagtacattttgtgttgtcaaaatatagaacaaagaaattcagaggaaagcttctgccttgac

SEQ ID NO: 72523 - DNA, 440 bp, Zea mays
  Clone ID: LIB3078-013-Q1-K1-C7
cccacgcgtccggcttcaacagcatgcaccagtgagtggcacatccaaaggaaaggctaagctcaaagcaggtcagcctttgaagcgttccaccattggagcaaagaaaggggcaccttccgctgctggtggcggcggtggtcgtggtcgtcgtgaggccattgagcgcattattcagatttccgagtcatgtctcaatgcatctactccgttgcggcacttgcccctcaaggagcgtcttcgtgaggccaaacgtgaggaactgggtcttgtctccaaggagaggcaacgagagcttgatatagccaaagccaaatctaaagccaaatctaaaggtcctggtggagatgatggagaccgtgtgcttatgggtccaccgggccttgactatatcagtcttgggctagttgatgaggaggcaatccccaagtatgaactca

SEQ ID NO: 72524 - DNA, 412 bp, Zea mays
  Clone ID: LIB3078-013-Q1-K1-C8
gaaaagcttgggaaggctggattagtcagagagaaatcattcggaacaacaaagggcgagaatgctttacattgagcagtgtgccaattccagagctgtaactatcttcattcgtggtggaaacaaaatgatgattgaggagaccaagcgcagtcttcatgatgctctttgtgtggcaaggaatctgatccggaacaactcaatcgtgtacggcggtggctcagcagagatatcttgctcaattgctgttgaaactgctgcagatcggcaccctggagttgagcagtacgctatcaggtcattcgctgatgcattagatgctgttccactagccttggctgaaaacagtggtttgtcgccaattgataccttgacggcggtaaaagctcagcaagttaatgggagcaacccc

SEQ ID NO: 72525 - DNA, 433 bp, Zea mays
  Clone ID: LIB3078-013-Q1-K1-C9
ccgcctctctcaatctgataccgcagatccgtcgtccggtgagtggaagccgcacgaacgcatggcctccggcgagcttgcctgcacctacgccgctctcatcctcagcgacgatggcatcgccatcaccgccgagaagatcgccacgatcgtgaaggcggccaacatcaaggtcgagtcctactggccggccctcttcgccaagctcctggagaagcgcaacgtcgaggacctcatcctctccgttggatctggtggcggagctgctccagttgctgctgccgcacctgctggtggtgctgcggctgctgctgccccggctgtcgaggagaagaaggaagaggccaaggaggagtctgatgacgacatgggcttcagcctgttcgactgaggagaccccctcacccagccattagcaaatttcacttgtgct

SEQ ID NO: 72526 - DNA, 436 bp, Zea mays
  Clone ID: LIB3078-013-Q1-K1-D1
cccacgcgtccggcggtattgctgcaggccagggcgcgagctgcgggttcggtatgcgcgggcagaaatcgcgctcggggcccggcgtccggcgcgggttcgagggagggcagatgccgctctaccgccgtctccccaagctacggggcattgccggcgggatgcacattggcctgccgaagtatgtgccattcaatttaaaagacatagtgcgcggcggattcaaagatggtgacgaaatatcactggaaagcctgaaatcacggggtctgatcaatccatcaggcaaggaaaggaagctgccgctgaagatcttaagagatggggatgtatcagttaagttgaatatcaaggctggagcgttttcagcttcagctaaagagaagcttgaagcagctggttgttccctaactctgttacctaaacgaaagaaatg

SEQ ID NO: 72527 - DNA, 432 bp, Zea mays
  Clone ID: LIB3078-013-Q1-K1-D10
cggacgcgtgggcgccgacggctgcgtcgccttctccgacgacatcgacatgctcaaaggcgtcatgcggcaagtcgctcgcgccgttcccgcaaggctgcttctactccaacgccctcggagggctcaagtgctacgagaaccccaagcacaaggtcaccgctgtccccgccgacgaagaagagatctgcggtgccactttcaaggtggtggaagggtctactgtcctgacggcgctgcactgatctatcatcatcaggcggaggcgatgcgatgatgatgcagaactttgtacatgcgttggtggatggtggtgtaacatagtggctgccaacaagtcatgctcatgcaaaccgatgaatctatctctgtatcatcgatctcggttgcttgctagtccagactccagacatggctatatatatatagctg

SEQ ID NO: 72528 - DNA, 369 bp, Zea mays
  Clone ID: LIB3078-013-Q1-K1-D11
aacacgcatccggcggcgcttgctcgggacacgctcgctccagcgatggctacggcaccagttgttgctgacgccgtcatgcctcacatcgtgccacctgtcacggctcccgtaccagatccgcgtttctccggccccaagttcaagctgcattcctagaccgcagttccgacagaagtctttaccaatgaccccacagaggacccaacacacgtatccaacgctggagcctacactgctactgctgagctaacgagatgatagcctcgagctggcaccggagcccgagctcgatcacgatgacgaagtggcggcgccaagctcgctcactgtcgtcgtcgcggacctggtggacgacgggctcgtcat

SEQ ID NO: 72529 - DNA, 234 bp, Zea mays
  Clone ID: LIB3078-013-Q1-K1-D12
ggccgcccttttttttttttttttttttttaatgataaaataagaacggtttcaaccgaattcagttgtgcagtgcacttgatattcttacagctccgaggccgtcagaaagcaattaagcggcctcacgtcaggcatgcatctaaagctcgaaccaacaatagggacaacaacaccgtggcacgtacattaattatataccaccccccggccctgcacccacgcgtccggcga

SEQ ID NO: 72530 - DNA, 412 bp, Zea mays
  Clone ID: LIB3078-013-Q1-K1-D2
gtttaaaatcaatttgtcgagtattaataggtgacaaaggaaggccttgcagcaagggtggtggatagacagcaagtttcaagaaccatctccaaagaagagatgctgcatctttttgaatttggtgaagaggaattaatggaacagaacgagaatggttctactatgattgagaagccatccacttctaacactattaaaacctctgtgcctgttcctgtcgacagtctcatgctgagcctgctcagtgagcaaactcggtggatttcaggttaccatgaacatgaagctctcctccaagaaaatgaagaagaaaagcttacaaaggaggagcaggacctggctttgtccgaatgggagtcattgaggaaagctgcatctgatcctgagagaaaatcaagcatgagcgcag

SEQ ID NO: 72531 - DNA, 362 bp, Zea mays
  Clone ID: LIB3078-013-Q1-K1-D3
cttgtgggtaaagggtacaacctctgtgagtgtcaaactggtatactagcccagcggacggtcatgaacagctcaggactctctgatgattaaattatggaacttaaattcaattttgacatttgcatatgcatgggtttgatattaattttgatctattactttacttatggattggtatttacttacacttagtaactgctaataaaattttgaccaactacgtaaaagccatgctcagctctaaccgctatcattgatcagccttacacttcacatgagctaccatctttggcgagttcgtgtcacattatttcccacaacttggttagcgatgaacgtttttgagcttacttttgctt

SEQ ID NO: 72532 - DNA, 400 bp, Zea mays
  Clone ID: LIB3078-013-Q1-K1-D4
ccgcaagcaagtgacatctgcactgtcatgtacacgagtgggacaagcggacagcccgaaggtgtgatgctgacccatgaaagccacgccatgtatgtgaaaggggtggacctcttcatggaccagtttgatgataagatgacaacagatgatgtcttcctgtcgtttctcccgcttgctcacatccttgaccgcatgatcgaagagtatttctttcacaaaggggcctcaattggctactaccacggagatctgaatgccttgagggacgacattgtggagctgaagccgactctactggttggggtgccccgagtgtacgaaaggatttatgaaggtatcttgaaggccattgcggaactcagacctctaagaagggtcatctttaatgctttgtaca

SEQ ID NO: 72533 - DNA, 390 bp, Zea mays
  Clone ID: LIB3078-013-Q1-K1-D6
cccacgcgtccgcccacgcgtccgcacacaggctctgtcccatagatgtcggccaccacatggtgttcacgaccgcgctcgccgtcaggtggtagtcccggcgagcgagacctcccgactccaggctccctcccataggtcgccgccgcctcatgatcccgagcactacagcctccggagccgcgggctgtgcctggtgccggtggaccagacactgtagctgacccagagcaacggggccgacctgtgggcgccggcgaacacgaccaggcgcaggtgaggaggagcctgctgccggcctgtgccttcgcggtggacaaagccttcctcctctccggcaatgagggcatcgtcgctaacgtgagcacgttgcaaagctcgcttgcccat

SEQ ID NO: 72534 - DNA, 168 bp, Zea mays
  Clone ID: LIB3078-013-Q1-K1-D8
gcgcaagcgagccaggagactgccggagccagcgcggaggaggagaggcccaagggaaagtgagtcatcagcgagacgtgcctcagtcaatttttacttgctggacatacgcatgcttcggcataatgtaagcagtcagcgcctgtgaaacgtcattgcgcttggggt

SEQ ID NO: 72535 - DNA, 428 bp, Zea mays
  unsure at all n locations
  Clone ID: LIB3078-013-Q1-K1-D9
cccacgcgtccgcatcatcaagatcttgacaaattctctcgatgttctgaaatcaaattacgtgcgtcgtcagaatctcagaactgcagaaacatatacgcctctcttttttttctctctatctctctctctctctctttattagaacgcgcctgattccatcagggctggtcgcgttgcaggtgcctccgttcctgatctgcaagatgttcacgcaagtcttctcgtttatcaatgtgcagctttttaacagccttctgctgcggcgtgagtgctgctcgttcagtaacggagagtacgtgaaggctgggctggatgagctagagcattggtgcttttggctgactgaagagtacgcaggatctgcatgggacgagctgaagcatatcangcaagcagttaccctcttgatacttgacgacaagcat

SEQ ID NO: 72536 - DNA, 437 bp, Zea mays
  Clone ID: LIB3078-013-Q1-K1-E10
ctcgcctcttgactaggccagggttccatcccacccccgccgccatccgatccgatggagggcggcgactcgtccggcgccggcgccggctccggtggcgccgtggcggcggcggccaagtggcggagcgacgcgtcgcggtcgttccagtactacctggaccgctccacgcctcacgccacggggcggtggctcggcacgctcgccgccgcggcaatctacgcgctgcgggtctacatggcgcagggcttctacatcgtcacctacgggcttgggatctacctcctcaacctcctcatcggtttcctctcccccatggtcgaccccgagctcgacccctccgccgccgccgaggggccggcgctgcccacccgggggtctgacgagttcaagcccttcatcaggcgtctccccgagttcaagttctggtatgcaat

SEQ ID NO: 72537 - DNA, 442 bp, Zea mays
  unsure at all n locations
  Clone ID: LIB3078-013-Q1-K1-C5
ccgcatcggcaagcacaggaagcacccgggaggtcgcggtaacgccggtggcatgcgaccaccaccgtatcctcttcgacaagtaccatccgggctacttcggcaaggttggcatgcgttacttccataagctccgcaacaagttctactgccccgcggtcaacatcgagcgcctctggtcgatggtgcccgccgacaaggcggcggaggccggcctcgacaaggccccgcagatcgacgtcacgcagttcggctacttcaaggtgctcgggaagggggtgctgccgcccaagcccattgtcgtcaaggccaagctcatctccaaggtcgccgagaagaagatcaaggcagcaggcggngccgtcgtgctcaccgnctaggtttcagtccttgttcgcctcctgggtttgaaatctatatctgaactgatagtgctttcctg

SEQ ID NO: 72538 - DNA, 88 bp, Zea mays
  Clone ID: LIB3078-013-Q1-K1-B11
cccacgcgtccggttatgtatgcactcctcctatatatactatatattattatgatgtgcgtatactagtactgtgcaactctttgtc

SEQ ID NO: 72539 - DNA, 430 bp, Zea mays
  Clone ID: LIB3078-013-Q1-K1-B12
cccacgcgtccgctacactacaccacaccacacacacccgacgacgatcacacacacgtagaagatcgagttcgttcgatcgtgaccgtgacgcatgaagctataagctagccaagacaggaataataatggcggcgtcgacggtggcgagcctctctgtcccggtgacgacgacgaccttcgcggcggcgggcggcgccgacgtgctgatcgtcgtcccgaggagggcgggcgccgggcgcgtcgtctggttccccgcggcggcgcgccgcggcggcggcagcgggcggttggtcgccgtgcggtccagcgggccggccacgccggcggagatctccgacaaggtgtctgagagcatcaagcaggcggaggagacgtgcgcggacgaccagaagggcgacgccgagtgcgcggcggcgtgggacgaggt

SEQ ID NO: 72540 - DNA, 408 bp, Zea mays
  Clone ID: LIB3078-013-Q1-K1-B2
gttcgtgcgcaagcacaccgcccccggtgtgctctccatggccaacgccgggcccaagaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaacccca

SEQ ID NO: 72541 - DNA, 437 bp, Zea mays
  Clone ID: LIB3078-013-Q1-K1-B3
caaagtcttccggctcctcaagtgggtcaatgatctgcatgctcttatcagcccggcggccaaagggactccgctcaccctcgttctgcttggcaaatccaaaaacgcgctgctttcgacgttcttgttcttggatcagtttgtgtggctcggacgaacggggatcgtcaagaacaaggaggcgacggaccgcgttgccaggttatccctgtactgctggatggcttcttctgcctgtgcaggtctagttgagcttggagagcttaaaaggctatcgagatcgatgaggaagcttgcaagagagctgagggacacagataaatatgagaacgagcagtaccaggacaaaatgaggcagtcagatgaacggctcctggccctggtcaaggcggccatggacgtggtcgtggccgtcgggcttcttcagctggcgccca

SEQ ID NO: 72542 - DNA, 410 bp, Zea mays
  Clone ID: LIB3078-013-Q1-K1-B4
cccacgcgtccgagggtatcaaaatctttggatgctgttgggatgttgagctactcggagaggccaatccaaactctgagtggtgggcagaaacagagagttgcaattgctggtgcgttagctgaagcatccaaagtattactgctggacgaactgaccacattcttagatgaacatgaccagataggcgtgataaatgcagtgagggactctgtggctgccgatggggaggtcgccgcattatgggtgactcatcggttggaagagctgaaatatgcagatggtgccatctatatggaagatggccagataatcgttcaaggcgacgtctctaccatatcaaaatttataaagaaaaaacaggcacgctactttggtcattttgaactctaaatccccaaagctttttg

SEQ ID NO: 72543 - DNA, 416 bp, Zea mays
  Clone ID: LIB3078-013-Q1-K1-B6
cccaaggtcgtgcgcatccagcgccagcgtcgcatcctcaagcagcgcctcaaggtgcctccggcgctcaaccagttcacccgcaccctcgacaagaacctcgctaccaacctgttcaagatgcttcttaagtaccggcccgaagacaaggctgccaagaaggagaggcttctgaagagggcccaggctgagaatgaaggaaaaactgttgaatccaagaaaccaattgttgtgaagtatggccttaaccatgtgacttacctcattgagcagaacaaggctcagctcgttgtcatcgctcatgatgtggatccgattgaactggttgtttggcttccagccctgtgcaggaagatggaggtcccatactgcattgttaaaggaaaggctcgccttggatcgatcgttcacaagaa

SEQ ID NO: 72544 - DNA, 424 bp, Zea mays
  Clone ID: LIB3078-013-Q1-K1-B7
agaggacgttgctattgcttatggattcaacaatgtgccaaaatcaaagccgaagtgtatgacaataggaggaaggcaaccattaaacagattctcagataaaattcgtgctgaggttgcaagagctggttatatggaggtgctcacatttatcttgtcttcacacgaagagaactttgacatgttaaacaggacagatgacaaaagtaaagcagtcattattgcaaaccctcgcacttctgaattcgaggttgttagaactagcctgatgtcgtgtttattaaaaacactgaaacataatatagaccatccaagacctataaagatttttgaagttggtgatgttgtgatgctggactcgtcacgtgatgttggtgcctctaataatcgcaggcttgcagctttgtactgcaatagggtttct

SEQ ID NO: 72545 - DNA, 387 bp, Zea mays
  Clone ID: LIB3078-013-Q1-K1-B8
cggacgcgtgggcaacaccagggctgaagaccatcttaagctttgctgttcctgatgagagatctggaaaggttgagctccagtatttgcatgattatgctggagttaatgcaagcatcggtctgacagccaatcctgtagtcaacctctctgctgcctttggtactaaggctgttgcagttggtgccgatatctcacttgatactgcaactgggaacttgactaaatacaatgctgcactgaggttcactcatgaagaccttgtggcatccctgaacctgaacaacaagggcgacagccttactggagcctactatcacaaggtgagcgaattgaccaacacagctgttggggcagagcttacccacagcttctcgaccaatgaaa

SEQ ID NO: 72546 - DNA, 370 bp, Zea mays
  Clone ID: LIB3078-013-Q1-K1-B9
cccacgcgtccggaacaacgccggcttcccgcacaacgtcgtcttcgacgaagacgaggtgccgagcggcgtcgacgccaccaagatctcgcaggaggagtacctcaacgcgccaggcgagacctactccgtcaccctcaccgtgccgggaacctacggcttctactgcgagccgcatcaaggagccggaatggtcggcaagatcaccgtcaactaattaagctagctatcgatcgatatccattcatgtattagctgttgcttcctgctttgtactccgccgatctgtccatctctacatgttttcgtcttcacacaacaacctctgctacgactacgtatatatgcatgctactagctgattgatttt

SEQ ID NO: 72547 - DNA, 441 bp, Zea mays
  Clone ID: LIB3078-013-Q1-K1-C1
cgcgccgccgccgcctacaacgaccacttcacgtgacttacctcttctccgcctcaagtgttcacggctccatcctctctagagtctaagcccatctcgcgaagccgctaacgccgaaaacgaccctacatatggaggcgaagaagtcgggtcccgccgctgccggagccgcggcgccgccgccggctaacgggtacttcagcaccgtcttctccgcgtcgcctgcggggagcgcaaatgacgcaaagcaggccgacctgtacacgatgctgaacaagcagagctccagagggcagaatggcagtggcattacagatggcaaatcacacggccgccctacttacaaggatggaaaacatgcttatccaaatgactcgtcagaatccccttacttcggttcgtccgtgcattacggtggtcgggaattctacagcagcacgt

SEQ ID NO: 72548 - DNA, 395 bp, Zea mays
  Clone ID: LIB3078-013-Q1-K1-C10
cccacgcgtccgcccacgcgtccgcggacgcgtgggtgctgatcccggaggtgctgaccagaggccgggctgatcaacgcgccgcagtggtacgacgccggcaagtcggagtacttcgcgtcgtcgtcgacgctgttcgtgatcgagttcatcctgtttcactacgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggaggctggccatgctggcgttcctggccttcctgatccagcacaacgtcaccggcaaggg

SEQ ID NO: 72549 - DNA, 437 bp, Zea mays
  Clone ID: LIB3078-013-Q1-K1-C11
cggacgcgtgggccgctgggccatgcttgccgtccccgggatcctggtgccggaagctctgggcctgggcaactgggtgaaggcgcaggagtgggcggccgtccccggcgggcaggccacgtacctgggcgccccggtgccgtggggcacgctgccgaccatcctggtgatcgagttcgtggccatcgccttcgccgagcaccagcgcaccatggagaaggaccccgagaagaagaagtaccccggcggcgccttcgacccgctcggcttctccaaggaccccgccaagttcgaggagtacaagctcaaggagatcaagaacggccgcctcgccatgctggccttcgtcggcttctgcgtccagcagtcggcgtaccccggcaccggcccgctggagaacctcgccttccacctcgccgacccgtggcacaacaaca

SEQ ID NO: 72550 - DNA, 433 bp, Zea mays
  Clone ID: LIB3078-013-Q1-K1-C12
gcgagcgagagcagcacacacgcagctagctaggagcagcagcagcggcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccct

SEQ ID NO: 72551 - DNA, 406 bp, Zea mays
  Clone ID: LIB3078-013-Q1-K1-C2
aaaccaaagccatcggaggagcagctggacgaccatggcctcgccgctgctcaagtggcactctcagctcgccgccgccgccgccctgcactccgtgaggagagccgaccgctgccctgcgacaatacacctgggcaagttccatgaccacgggctcaggtccggccgttctaagagatccggttcagcgaaggtgggcgccttcccgtcgctggacgtggtgccgctgatggtgacgatggtggagcacgtggacatgtcgcgggactacgtcgtgaccaagtccatctggcatctcagcgacgcagccctcaagagcgtctataccttctacgccatgttcaccgtctggggagtctgcttcttcgcgtccatgaaggatcccttctacgacagcgagacgtac

SEQ ID NO: 72552 - DNA, 443 bp, Zea mays
  Clone ID: LIB3078-013-Q1-K1-C3
cggacgcgtgggtcaacgtctactacaagtccgacgaggccgtggccgccgaccccgagctgagggcgttctgggacgaggtgcgcaacgtggggcacggcgacaagaaggacgagccgtggtggcccgtgctggacacccgcgacagcctggtggagacgctgaccaccatcatgtgggtcacctccggccaccactcggccgtcaacttcgggcagtaccacttcgccggctacttccccaaccggccgaccaccatccggaagaacatgccggtggaggagggcgggccgggcgaggagatggagaagttcctcaagcagccggagacgacgctgctggacatgctgcccacgcagatgcaggccatcaaggtcatgacgacgctggacatcctctcgtcgcactcgcccgacgaggagtacatgggggagttcgcggaa

SEQ ID NO: 72553 - DNA, 379 bp, Zea mays
  Clone ID: LIB3078-013-Q1-K1-C4
attattactgcctcagattgtgaaggagctggggagcagttttacgtgactactttgctttcaaacagcgctgaaggtggttctctactcaaagatattcctgctaccaaggatggaagggttgattggtcacaggatttcttctgcaaaccagcatttctgacagtgtctggacagcttaatggtgaaacatatgcttcagctctatctgatatttacacatttggtccaacgtttagggctgaaaattcaaacacttcaaggcatctggctgaattttggatgattgaacctgagcttgcctttgcggatctgaacgatgacatggcttgtgcaactgcatatctccagtatgtagtaaagtatattctggagaact

SEQ ID NO: 72554 - DNA, 393 bp, Zea mays
  Clone ID: LIB3078-013-Q1-K1-B10
cagtcctgccaggatggacttccgatggttcgcacttggaaacatgattgctatactttcttcccttgcaacacctgagcaatctgttgctataatggatcttattgaggagcgttgggaagagctcattggtgaaatgcctctgaagatatgttatcctgctattgagaaccatgaatggcgaattgtgacgggctgtgatccaaaaaacactagatggagttatcataatggaggatcgtggccagtacttctgtggctgctgactgcagcctgcatcaaaactggacggccacaaatcgcaagaagggcaattgacctagcagaaaggaagctgttgaaagatggatggcctgagtactatgatgggaagcttggtcggtatgttggcaa

SEQ ID NO: 72555 - DNA, 273 bp, Zea mays
  Clone ID: LIB3078-012-Q1-K1-H6
ggaagatgcaatatattggcgaactcgagctcaaggtgcaaaccctgcaaacagaagggacaacattgcagctcagctagcattgctgcagagagacaccactgggctaacaaccgagaatagtgagctgaagattcgcctgcagaccatggaacaacaagtccacttacaagatgctttgaatgacaccctgaaaacagaggtccagcggctgaaggtggcaacaggacaggtgggcaatggtggtggagggatgatgcctaaccttggggg

SEQ ID NO: 72556 - DNA, 407 bp, Zea mays
  Clone ID: LIB3078-012-Q1-K1-H7
ctttgattgagaatacgatgaataagcttcggctatggtcaaattttttagcagcggagcagtgcaatagtaataaatggtgtggtaacttcacacctacccatctatttatatagtgctgcaggtgggaaggtgaatcgtcaagccgctcgcacacgctgaacagtcgcccgcacccactgaacggtggaccacaatgcacgagaaggtgaatcaccagatcgctcgtacccgccgtatggtgggaccacctcgcacttggaatatccaatcgtttctcgacaatgagctcacggaaggtgtttttcggaccttcggcgttctgaagcctaagagaatttttcacgggtcgagctcatcacgaaaaacgatctgggaccgtgaaggggctactgttgagggtttgc

SEQ ID NO: 72557 - DNA, 225 bp, Zea mays
  Clone ID: LIB3078-012-Q1-K1-H8
ctcacacgtacaatactgcgaatctttttctgctagggtcaacttttctatcaggggcggcttactatagtgctgaggtgttcttgatctcaacacctacccatgtatttatatcgttatatagaggcattgtgaatttgtatctacctcgcacacgcgtgatcaacctaccagacctactgattgacgcacttcaatcaacgataaagtgaatgaccgtgatcg

SEQ ID NO: 72558 - DNA, 431 bp, Zea mays
  unsure at all n locations
  Clone ID: LIB3078-013-Q1-K1-A1
cgacgagatgatccgtgaggccgacgtcgacggcgacggccagatcaactacgaggagttcgtcaaggttatgatggccaagtgaggagcggtccccgtgaaataagtatctatggattgaagcgaattatcaggcacacaagctgtactttgtcatgtccctttgagtacgcatcagtgtcatgcaggtggtaatgtcttgtagtggtccgtttaggcggtgtagtcatgggaacgcgacatcagatacctggtttctttttattgtgatgttatcttgcattattgcacctgtaggatttgttgaagctcatattttccagggttttggatcttttgtgctagtcttaagtctttgtgtatggaggcgtggagctaggattatgatataaagggtcaactaattcatcanaaaaaaaaaaaaagggcgg

SEQ ID NO: 72559 - DNA, 447 bp, Zea mays
  Clone ID: LIB3078-013-Q1-K1-A10
ggaggtcagcacgtggacttccccgtcagtgtgtggtcgaagaagtatttttgcagatgttttgtgcccatatttcgtttttcagtttttttgtccctctgtagatagaaacaaggggagaaggggaaaaaagtacttgtatttcttttgttccatggtggtggtggtggtgggcggctcagcctcgtgagtgcagtattgggcaaaccggaggctgcggcaaccttgtgcagttcggccacgaatatactagggaagatcgcgaccaatcaatcaatcgatgaccgagttcaattgttcagcattctttattagttttggtgggtggatacttcaatcggtgagccgaacagacagttgttttgagtatgaattgctctgcatctgcaaagttgttgtttgtcatccgtcgtctcaataaggcgaggggaagagatgcgtgcgttc

SEQ ID NO: 72560 - DNA, 441 bp, Zea mays
  Clone ID: LIB3078-013-Q1-K1-A11
cggacgcgtgggcggacgcgtggggacgaggaaatggaagacggaattcagtctgtcgataccatctcaagtactccaactggtgttgaaacacctgatgttatcgaccttcggaagctgcagaggaaggagactgacaagcaggcagaacggccgctgtaccaggttcttgaacaaaaggaagaaaggatcgcccctgggactctatatgggtcaagccatacgtatgtgttgggaacacaagataaatcatcagctccgaaaagggtggatctgcttaagaatcaaaagtcagacaaggtggacgtcaccatccaacccgaggaactggaagccatggatgatgttctggcagccaagtatgaagaagctcgagaggaagagaagcttcggaaccaaaaggaggacttcagtgacatggtggcagagaatgctcacaag

SEQ ID NO: 72561 - DNA, 430 bp, Zea mays
  unsure at all n locations
  Clone ID: LIB3078-013-Q1-K1-A12
cccacgcgtccgcgcctcctcgtcctccaccaccgccgtcacggcgctccccaggaatgggcagcgggcgtcgtcctgcttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagtttctgaccaagatcggcgtcctcaacacacccttctggtacaccgncggcgagcagcagtacttcaccgacaccaccaccctctta

SEQ ID NO: 72562 - DNA, 426 bp, Zea mays
  Clone ID: LIB3078-013-Q1-K1-A2
gatgatttggcttggaataagggatatgataaatgagttcagaaagaaaaagttgaagctgcgtccagtaacatatctaagtggttctcagggttctggcaatgacatccctcatggatacatttggagtcctcatctagtcccgaaaccaaaagattggggtccaaagatcgatgttgttggattttgcttccttgatcttgcttccaattacgtgcctcctgaaccacttgtgaaatggcttcaagctggtgacaagcccatatatgttggttttggtagccttccagttcaagacccacaaaagatgactgaaattattgtcaaagcgctggaaattactggacagagaggtatcattaacaaaggctggggtggccttggaaccttggcagaaccaaaagattttgtatatctactagacaa

SEQ ID NO: 72563 - DNA, 323 bp, Zea mays
  Clone ID: LIB3078-013-Q1-K1-A3
cggacgcgtgggggaaacaccgccgccgccgcgccttccattccagtactcgcggaggagaggaacaccagccagcgccatggtcacgtcgacgaccgccgccgccgtgctgtccccgccgtccgtggccgggcttcgcctggcgccgtctccccgggcgcgcgtggcgttccgcgcggcgccggcgcggcggtccgtggcggcgcgcgcggagcttaacccgtcgcttgtgatcaacctgagcaccggcctgtcggtttttcttggccggttcgtcttctttaactttcaacgggagaaccttgccaaaccaggtccccaac

SEQ ID NO: 72564 - DNA, 432 bp, Zea mays
  Clone ID: LIB3078-013-Q1-K1-A4
cccacgcgtccgcccacgcgtccgcaacagttccctgtcagaatttgctggtttgggctttgaattgggttacttcattggaaaacccaaactcattggtcttatgggaagctcagtttggtgatttttcaaatggagctcaagtgatatttgatcagttcctgagtagtggggagtcaaaatggctccgccagactggccttgtcgtttgccttcctcatggatatgatggtcaggggcctgaacattctagtgcaagattggaacgctttcttcagatgagtgatgacaacccttatgttatacccgagatggatccaacactgcggaagcaaatccagcagtgcaattggcaggtcgttaatgtaacaactcctgcaaattatttccatgttctgcgtcgccagatacaccgggacttcaggaagcctt

SEQ ID NO: 72565 - DNA, 412 bp, Zea mays
  Clone ID: LIB3078-013-Q1-K1-A5
cggacgcgtgggtcaacgtgtccatactcgctttctcttacttcccaatctccaagatgttacaagaaccatccagcatccttctattcatgaatggtcaagcaatggaacgcaccgaagcatttgtttcgtcaacaaagctacgggttatattctaatcgcagagcccccaagttttttgacgatatatgatgttatcgcaattattgttagtcacaggttaggggcaccaatgatcttgccgattgcctcactgtttgcatgcccagatggttcagagaaagaagtccttcaaattcttcacctgggttcagactttggagtttcaaaacgtgaagggagatacgacgcttcccttggagcagaattgttatctcaggatgctcggcaggtgcaatttcttccattaaga

SEQ ID NO: 72566 - DNA, 426 bp, Zea mays
  unsure at all n locations
  Clone ID: LIB3078-013-Q1-K1-A6
cccacgcgtccgcggcgccagcggtggcgaaggcggaggagacgaaggtgacgaggaggacggtgacgatcaaggaggaccgtcctgcgcaggagggcagcggcggcgcctcgttggagaggaagaagtcgctgttccggaagcggcaggcgtcgtcggtcgccggagcggaggagcagagcggcgcccgggtgccgaggcggagcgggctccggccgcggatgccgcaggcgccaagggtgccgtccaacatcaacgagcgctcctccagcttcatcgaggagcgcaagaagggattcggcggcaagccggcgccggggaactgaacggacgacggcgtangtaggggcccgagcaccgtgcagccgttgccgcgacggtgcaatatgctgncgngccatgtctctctgactcccagggacaggg

SEQ ID NO: 72567 - DNA, 363 bp, Zea mays
  unsure at all n locations
  Clone ID: LIB3078-013-Q1-K1-A7
gtgccggaggtggcgcgcgagctggcggccgaggcgcagcggtcgggcgtgaggggcgcagcccgtgcggcgctcgcgatgacggagccggtggcgcgggacgtgtacggccgcgtggagcccgtggccaaggacctctacgtgcggtacgagcccgcggcggagcacctggccgtctccgcctggcgctcgctgaacggcctgccggtgttcccgcacgtcgcggagatcgtcgtgcccaccgccgcgcactgggccgacaagtacaacagggcggtcgcagccgccgcggagcacggttacgcgggggccaagtacctcccggccatccncaccgaacgcatcgccaaggtgttttcgtcg

SEQ ID NO: 72568 - DNA, 396 bp, Zea mays
  Clone ID: LIB3078-013-Q1-K1-A8
cccacgcgtccgggattgaacatcgaagggtcatttttcatggcagtctcctgtggggaggtttggctctgtacaattcgggcaccgcaagaacgagccggtgacctgggtactgcttacatgattgttaaccatttcaacagccatacgcatctagctgagcttgacttggtagtgaatgtagtctagtcgcttgtcatgtaatagctttgcgattgatagtttgctagcttaggtagctagcctgactgtaatatgcagaataattcttgtcttgtttccgtccattttatccatgtaaaactatgagttctgaatctttctgaaccttgcttttcttgttctccttgtcatcttaatgtctgatcatttttgttgaattttttggttgaagct

SEQ ID NO: 72569 - DNA, 443 bp, Zea mays
  Clone ID: LIB3078-013-Q1-K1-A9
ccggcccatgttccagagcatgctgagccaccgcggcgacagcgggtgccagggcgccttgtacacctacgacgccttcatcgaggccgccagcaagttccccggcttcggcaccaccggcgacgagcagacgcgcaggcgggagctcgccgccttcttcggccagacgtcccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgctgaacctgaacctggtgggcgacccggacctggtggcgagagaccccgtggtagccttcaagacggccatctggttctggatgacgccgcagtcgcccaagccctcgtgccacg

SEQ ID NO: 72570 - DNA, 403 bp, Zea mays
  unsure at all n locations
  Clone ID: LIB3078-013-Q1-K1-B1
cccacgcgtccgaaattaattacttacagaagtcttccagcaattagaacatacaatgcgagttccaaggtatgcaatggaaaccttgatactggggacagatctgtggccatgtggtggattgtatgacctctcccacccactcatgctaagacaaacttgggttgggcgcccacccttcgttcgttgaatcatgagctcgagccttagaggagaattttcagaaaaggaaatctacatgcccgagtgaccatgtaaatatttaccattgcagttcgcggacccatgagtaccaaaaaaaagagatgattcatattgacctgtaacattgtaagatcaacctcaggaatatttgaagcggttagttntcacatgttcatagatcgggtcggtgttacacatg

SEQ ID NO: 72571 - DNA, 369 bp, Zea mays
  Clone ID: LIB3078-012-Q1-K1-H3
cggacgcgtgggcggacgcgtgggcggacgcgtgggcggcaagctgacagcgaggtgagggcttttcaaaacgatattccgagtggaagagaaaagaaaataaaagaaatagcaggttattttagaaaaaaatagttggcccatatgtaacgcgcggtagctttaagattattatgtccagcagcttattcatatattatacatatattcaaatttcactctgtgaatagtagtctaaaatacagtagtgttttgagtaaactatggataaactgctggacaaggtctaagataagtgctgcgtggtggcaacaaacgacacttagtctttgttggtggcaatgatattggaggggctaaaagtttttc

SEQ ID NO: 72572 - DNA, 253 bp, Zea mays
  Clone ID: LIB3078-012-Q1-K1-F8
ataaaacctctcttagtttaaattcacttcacactgcctcatacatttgtgctacagggggatgctcaaccgagacgcggtgcctcaatctattcaattgcgagatacataactgcatcaatagccataggcctttaatacattctccaactgtaaaccacactattgtcctccagtatacgatactcatacgagtgctaaatcttgatctatcgattatctgtatattactattactagcttactccttttg

SEQ ID NO: 72573 - DNA, 439 bp, Zea mays
  Clone ID: LIB3078-012-Q1-K1-F9
cttcccttccaagaagcgcagcgcccatggccatggccacgcaagcctccgccgccacgcgccacctgctggcgcggcggctgggcgccggcggcgaagccgcggcagctgagctcgcagctcgcgctgccgtcgtcgtcctcccgcgggccggccccgctccgcgcgtccaccgaggaggcggtggaggcgcccaaggggttcgtggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagt

SEQ ID NO: 72574 - DNA, 433 bp, Zea mays
  Clone ID: LIB3078-012-Q1-K1-G1
gtagaagcgaagcaagcaggcttcgtgatcaagactgcagggggagggggaggaccaagcgaaatgtgaactagagcgaagatgggcggcgcactgctgcttgcgctcctcctcgtctctgctgctgccgcccctcaggtacttggagttggcaatggagacaatcacatgagaatcatccaggaggacatcatcgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagtttgacgcttgatctgaatgggcccgttgcatcacaatttggaacatactatatcaaggtcact

SEQ ID NO: 72575 - DNA, 439 bp, Zea mays
  Clone ID: LIB3078-012-Q1-K1-G10
cccacgcgtccgcggacgcgtgggtatctctacccaatcagatgggcaaactgaaaagagtatctcaaacccaccacagatggtcatcgagaatatttctctaaaggatcagcttataaaagaacagagcagatctgaggggttgtcggcagagataatgaaactttcagctgagcttaggaaagcagtccatgcacagaataaccttgcacgcttatacagacctgtattaagagacattgagagcaatctgatgaaaatgaaacaagaaacttatgcgacgatccagtgatacatgttgacatgttgtgaaactcagtcctctggcatggccgcatgggctccacgttactgattttcgtcgtggatgtatttatctcatgccatcttcaagatgctggtgcaaagcagttcttttcgtggccaccatttataagta

SEQ ID NO: 72576 - DNA, 251 bp, Zea mays
  unsure at all n locations
  Clone ID: LIB3078-012-Q1-K1-G11
tttctctaaangatcaacttataaaacaacatatcacatcncanggccacccggcaaaaataataaatctttcatctcatcttaccaaaccagtccatacacacaataacctttcacccttatacacacctgtattaacacacattgagagcaaacatatgaaaaatacacaagaaacttattccacaatccacttacacataacaacatgttgtgaaactcaaacctctaacatgaccccatgggctcca

SEQ ID NO: 72577 - DNA, 413 bp, Zea mays
  Clone ID: LIB3078-012-Q1-K1-G12
cccacgcgtccgcccacgcgtccggtcgtcgcaggaggcggcggcggcggcgggaggggctcggctctcgagacgggcgccaagctctacatctccaacctggactttggggtttcgaacgaggatattaaggagcttttctctgagctaggtgatttgaagcgtttttcgataaattatgatcgaagtgggaggtctaagggaacagctgaagttgtatttgcaaggcgttctgatgctgtagcggcggttaagaaatatgacaatgtccaacttgatggtaagcccatgaagatagagatagttggtaccaatactccagctgcagcagctgctcatccagtccctaatggtggtcatgctaggaatgctgcgaggagtgcaccaaaggatgctgctccagcaggtatgtc

SEQ ID NO: 72578 - DNA, 226 bp, Zea mays
  unsure at all n locations
  Clone ID: LIB3078-012-Q1-K1-G2
agcctaataattcaacatagcctttttttataatatgatacataactgttcttcataganttttaacaacagatagatggataatatttttgtttccatccattacaaatttcactcctacacatacatcattactgtaaatctatttcttatctcatccctcattaaatatccaccatctataatctttctaagaaatacaatgacaataatccatccattacat

SEQ ID NO: 72579 - DNA, 287 bp, Zea mays
  Clone ID: LIB3078-012-Q1-K1-G4
actacgcctacagccacgcattctagcattcttatcgaaccgtctgcttcagatgcaaggggcatcactctcaccattgggagcctacactacatctgtcacatcgagacactcaactatcccttgaagccatatgaccatagagcatgccatacgctgccagtacatcctgatcacactgatcacatccatcactgcatatacagatgtgcttactcttatataccactacctctactccgatcttgttatgtaccatttccacaagacgaagacatcacactagc

SEQ ID NO: 72580 - DNA, 290 bp, Zea mays
  Clone ID: LIB3078-012-Q1-K1-G5
tcctactgaagatgcgaagcaagctggcttaaagatcaagactgcatgtgctggtggaggacgtggcgaactgtgaactagagcaagattgccggcacactgctgcttgcgctcctcctagcatatgctgatgccgacattgaagtacttggctttaatattactcacaatctcatgagaacactctagcaggaccttatcatgcactgacataaccgactctacacttactccacagactataaatggacgcactttggactctataccatatgtcagagacatcacat

SEQ ID NO: 72581 - DNA, 387 bp, Zea mays
  unsure at all n locations
  Clone ID: LIB3078-012-Q1-K1-G6
cccacgcgtccgcttgctctccctccaacaagctaattaaggccggtcgtcatccctcgtctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcgaagaaggacccggagcacgcgcaccgtcacaggatcgangaggaggtcgcggc

SEQ ID NO: 72582 - DNA, 395 bp, Zea mays
  Clone ID: LIB3078-012-Q1-K1-G7
cccacgcgtccgcccacgcgtccgcgactcactagtactcagccgccgcaatcaggggggcaggtagctcgagcgcgcgctccacctgcgccgacgcgatgcgggccaagtggaagaagaagaggatgcggaggctcaagaggaagcgccggaaaatgaggcagagatctaagtaggcgcatcttgtgaccgaggatggcgagcttctcctgcaccatggctgtgacgcgttgggatgattgtctccctttgtagacgtgctttgctgtagacgtaggcgatgtaaaccgtcctttttgattaattctagtatgttctgagactgggtttatattgtaatttgaggataaatatatgatgctctaaggttattgataatactggcactcgaatat

SEQ ID NO: 72583 - DNA, 414 bp, Zea mays
  Clone ID: LIB3078-012-Q1-K1-G8
gttatttgttctttccgacgaaggttcatggccaccggcgccaagcgcaagaaggtggggggcgccaagcgcgggctcacccccttcttcgcgtttttggctgagtttaggccgcaatacctggagaagcaccctgagctcaagggcgtaaaggaggtaagttgcttcttctcaccctacgcatgtagctgggtttcgcttaggtggctggtatatgcctttgctcgtcggtgactttgcttataggtgagcaaagcggctggggagaagtggcgctctatgtcggatgacgataatgcgaaatatggcggtagcaagaaacaggatggctaagcaagctagaaggagaacactagctgcaagaaggccatagctgatgttcgggaaggagatgacacacaatgttctaacaag

SEQ ID NO: 72584 - DNA, 441 bp, Zea mays
  Clone ID: LIB3078-012-Q1-K1-G9
cccacgcgtccggacccacgcgtccggctagggcgggctcgactacctcggcaacccgggcctggtccacgcgcagagcgtcctggccatctgggcgtgccaggtggtgctcatgggcgccgtcgaggggtaccgcgtcgccggcggcccgctcggggaggtggtcgacccgctgtaccctggcggcagcttcgacccgctcgggctcgccgacgacccggaggcgttcgccgagctcaaggtgaaggagatcaagaacggccgcctcgccatgttctccatgttcggcttcttcgtgcaggctatcgtcaccggcaagggccccctcgagaacctcgccgaccacatcgccgaccccgtcaacaacaacgcctgggcttacgccaccaacttcgtccccggcaagtgagcgagggcatgatgcttgcatgcgtgtaccgg

SEQ ID NO: 72585 - DNA, 109 bp, Zea mays
  Clone ID: LIB3078-012-Q1-K1-H1
cagaaacctatccactagctcacgcactcgatcgaggggatccagttcatgatctacttatgcactaactaccttgatctcaacgttgccctgaccattgtccaaacct

SEQ ID NO: 72586 - DNA, 430 bp, Zea mays
  Clone ID: LIB3078-012-Q1-K1-H11
ggccggcgtggcgatggccaaccggtccctcgggaacgggctcccggcggcctccaggggggacgcgcgcccgcgctgcgccacgtgcggcggctccggccgcgtggagtgcatctgcaaccgctggtccgacggcgactccggctgccggacctgcgctgggtcggggaggatgccctgccgcagctgcggcggctccggcacgggccgaccgctccctgcacggctcaccgtccagcaccagaagccgccgccgccgccgccgcccggctacaactgatcgatggtggatgattaggtatccgtatccgtggattatatacttctcgcgggcgatttgcgatgcgacccatacaagaaagaaatcagttaaactgcgatatgatgcgctctagctagttaatcatatatacatatatacacgtccgat

SEQ ID NO: 72587 - DNA, 394 bp, Zea mays
  Clone ID: LIB3078-012-Q1-K1-H12
cccacgcgtccggcctaacgcgcgagaggttctggtagggctctacgagcgcacgctcaaagagatcaagggcgtcccggaagacgagggttaccgcaaggccgttgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcatgttcctcagcaccggcctgttgctcttcctgaggagttcttcaaggcactagatgctgtcaaatctgatcct

SEQ ID NO: 72588 - DNA, 391 bp, Zea mays
  Clone ID: LIB3078-012-Q1-K1-H2
cggacgcgtgggccgaccaggtgctcttctccgacgcccggtcgcagcccaccgtggtggcgtgggcgcagaacgccaccggcttcgagcaggccttcgtcgacgccatcaccaggctcggccgcgtcggcgtcaagaccgacccgtcgctcggggacgtccgccgcgactgcgccttcctcaactgaaaaggatggacatggagagctggtttatatctcacacaagtgttcatacacaatctagagtaaagtttttttgttgttgatattattatcatgtcaggtatgagcacaaggttgaattaatggttaatgcgattgatatactgtaagtggcacttgcattggtaggccaagaccgagatgtattccttttccttggtgatttt

SEQ ID NO: 72589 - DNA, 398 bp, Zea mays
  Clone ID: LIB3078-012-Q1-K1-F6
cccacgcgtccgagaccatcaaacaagtgccagcgccctctcgcagtcgccgcaatggggagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggaaggcaagagcgtcgtcacaactggccgcaagatcattggcgccaccaaccccctggcttctgagcccggcaccatccgtggcgactttgctgtcgacatttggcagaatgtcattca

SEQ ID NO: 72590 - DNA, 326 bp, Zea mays
  Clone ID: LIB3078-012-Q1-K1-E10
gccaatcgagcgagacataccacttctttcttattcattgagaagcccatcccttagcggtgctaacaacaggccaaccgagctttgctactgaaaacaacgtaccggatcttattacaccataacctaggagtgaaacgatagatcttttcactggtacatgagtacataactcaacgctcataatgtataacatcaacagcttaaactaaggcccatgctatatttatgtgtttgcaaaacatctgataacgtacaccaaaaaagaaaagaactggacagcgaatataatgatccaagcgtaattacgcttgcttacaagcaca

SEQ ID NO: 72591 - DNA, 311 bp, Zea mays
  Clone ID: LIB3078-012-Q1-K1-E11
gcagaagaaagtccccttcatcagcgactacctcgagattgagtgcgaggggaaggaggggttcaagtgcggctccaacgttttctggaagtggtgaagcagctagcagcagcgtctgatgggaatggaggagatcatcacctgtcttgtcgaccctagatatgtccaaactgcagggaaattaaatcttcatgtgtaattgtgctcattctgtttcaatcatctcaacatccgatcatgaacctcttgcattattaactggctcgatcgtcttctcagtttaagacgttggaggctgctttatttgttcc

SEQ ID NO: 72592 - DNA, 439 bp, Zea mays
  Clone ID: LIB3078-012-Q1-K1-E12
ggagaacccctttcagcacactaccagaatattctcaaatcacttctgaaagaattgcgaggtcgattttgggagggaaaagatgctattctggatgcattggcttcattgtgtgcttgctgtcatgttgctataactgcagaagactcctgcttgccaagtgttatactaaattgtgtttgtgctgcatgcagtaggaaatcaaaattgtaccgtgaagcagctttcttgtgtttacacaaagtgattacggcattcagagatccaggatttttcaatagtgtgtttccaatgctgttcgaggtttctaaccaatctgccatctcgaagacaaagggctctgctgaactagatgaaagtgaaggtgcttctgtttctctggataaagtgctcaattgtgcaacatcttgcatcagtgttgcttttccacaggatatta

SEQ ID NO: 72593 - DNA, 352 bp, Zea mays
  Clone ID: LIB3078-012-Q1-K1-E2
cccacgcgtccgcccacgcgtccgcccacgcgtccgcccacgcgtccggcggatcgagagggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggccgccgtggaggctgcggccgtgggtacggt

SEQ ID NO: 72594 - DNA, 380 bp, Zea mays
  Clone ID: LIB3078-012-Q1-K1-E3
cggacgcgtgggggctcatcggcgtcaaccacgactggtgtgaggcgttctcgacatagcggcgcacctatgacctgttgcatcttgatggcctgttcacagcagagtctcacaggtgcgagatgaagtacgtgctccttgagatggaccgtatccttcgtcccacgggctacgccataatccgggagagcacctacttcctcgattctgtggcacccattgccaaagggatgcgatggagctgcgagaagcacagcagcgagaacaaggccgacaaggacaagatcctcgtctgccagaaaaagctttgggcaggaaagcagtgacgagagaggatcatccttcttccttccgagtataaaaaagtaggcattcagatc

SEQ ID NO: 72595 - DNA, 354 bp, Zea mays
  Clone ID: LIB3078-012-Q1-K1-E5
cccacgcgtccgttttttttttttttttttttttttttttttttttttttttttttttgttttttttttttttttttgtggtttttacaaggaaagcaaaatgtccatttgtccaccatcatgaattaatgatagtgccaaaaaggcaaatacccattaccagtttcgagcagatcacattcactgccaattcaaggcaaaaatttttcacgcacatacaagctagggaatcgacacatacccaaattttatattatgaaacagcaattccttacgaacaacatgggggatacaagaaattggggattcaaacaaaagaaacttacgaaaaaaaaaaggagtactcgtatacct

SEQ ID NO: 72596 - DNA, 437 bp, Zea mays
  Clone ID: LIB3078-012-Q1-K1-E6
ggcatcgactacgccgccgtcaccgtgcagctcccggggggcgagcgcgtgccgtgcgcttcaccgtcaagcagctcgtcgccaccggcaagcccgagagcttcggcgggcccttcctcgtgcccagctaccgtggctcctccttcctcgaccccaagggccgcggcggctccaccggctacgacaacgccgtcgcgctccccgccgggggcagaggtgacgaggaggagctccagaaggagaacatcaagaacgccgcctcctccaccggcaacatcacgttgagcgtcaccaagagcaacccggagaccggcgaggtcatcggcgtcttcgagagcgtgcagccgtccgacaccgacctcggggccaaggcgcccaaggatgtcaagatccagggggtctggtacgctcagctcgagtgattcgagtgtctaact

SEQ ID NO: 72597 - DNA, 277 bp, Zea mays
  Clone ID: LIB3078-012-Q1-K1-E7
cccacgcgtgcggaactatctggagctcatggctaacaatatgaattgctgcacggggcgtgactatcttgaagagtgtagcatatgagactaccccaagtcccatgaggggatatgacacaaatatctctgtatatgcgctggaacacataccgactcacctagtgttcacctgatctgacaaaatctgcttatggatactgtgctgattcaactctatgcacagttccttctagctcatatgtgttcaggcgagcgttctgaatgaatcaagctt

SEQ ID NO: 72598 - DNA, 377 bp, Zea mays
  Clone ID: LIB3078-012-Q1-K1-F1
cggacgcgtgggcggacgcgtgggcggactcgtggggtcgtcttgtcgggtcttcaagccgcaccaaaccacactgcgacgcacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagaccctaagtacgaatgaaactgatgtcctctagtgcaaagatcctattatctgcaggccgaaatagggctatactgttagctaatgctattgagatcgcttgacactttgagtgcatatcatggaagctggacatgcagttcctggcattttgggtttg

SEQ ID NO: 72599 - DNA, 422 bp, Zea mays
  Clone ID: LIB3078-012-Q1-K1-F10
gggcgccgccgccgcccctgccgccgctccgtggcagaacggagagcgcaaggtcgagggaggagggcccggctccaacagccggcaggtcacgccggacgacaccggcatcgtcggaagcgtcggcgacggtagtagcagagacgagactttctatgaagccaccgcctggttggaattagactgcgaagatgatttctacagcgtcaacggagatctgacgcctgcgagatcgttcgcatcccgaaccagtggccggaacactccgccacctagaccccgcgatctaccgacgctggcggcgatcctcaaggccgaacccctgaagccgccgtcgacgccgacgccgacggcggccccgcaaaggaggctgggcgacctcctgcgggaggcgcaagacgacgacgacgacgacaatgaca

SEQ ID NO: 72600 - DNA, 430 bp, Zea mays
  Clone ID: LIB3078-012-Q1-K1-F11
cctcgcgccgccgccgcgtctcctcctgtacaggtaaggagaggaagagggcgaaatggggaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctgttgatcaccgccgcaagaacaaatcccttgagggactgcaggccaatgtccagaggcttaagacatacaaggccaagctggttatc

SEQ ID NO: 72601 - DNA, 378 bp, Zea mays
  Clone ID: LIB3078-012-Q1-K1-F12
ccgactcctagccgaatatacattttttttacaactacgaacgacacatttactggtgtggaataatactgtcgtgcccatactatacattacacacagacgaaatcgccaaaaaaaccaatatgaagacgatgctcaccataaaagcagttgcctattgatcgacgaagctttagatactcaaaacaaacaaaccaccacctgggcatgctttttcaccacttgtaacaatccaaagcactatggatcaaatatccaccttctgcaagccgatcaattatacatacacaacaaacagctacttgtacctgatcaacgaaaaactcgattttttttacttccacataacacttatcgttgctcaaaagaaatttattc

SEQ ID NO: 72602 - DNA, 413 bp, Zea mays
  Clone ID: LIB3078-012-Q1-K1-F3
gcttcacgtccgctacagaccggcgaggagacgaaaggagggagttttgagaagctcagatggctcctaaagccggtcctgccaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacccaagaatcagcactactggaagaaacaagcttgatcagtaccaaattctcaagtaccccctcaccacagaatctgcaatgaagaagattgaagataacaacactctggtctttattggtgacctcaaagcagacaagaaaaagatcaaggctgcggtcaagaagatgtatgacattcaagcaaag

SEQ ID NO: 72603 - DNA, 365 bp, Zea mays
  Clone ID: LIB3078-012-Q1-K1-F4
ccacacctctggcaaggagtacaagctgaaaccaattggtgatgctggccctgtaatggaggcgggagggatctttgcctacgcccggaagacaggaatgattgcgtcgaaagctgctgcatgagggaaaggccttagactgcaggtctgatcaactacggtggttggcgtggtgagagatctgcgagcggtatcgaactagtggattggcagggagaggttgagaggaaatgcactaacttagcagcttttgcgttttgggaggtggatccaccagtgggcagactgcccaaaatgatggattggcagaaagaggttaagaggaaatgcactagcatagcaggttttgcggtttgggaagtgga

SEQ ID NO: 72604 - DNA, 437 bp, Zea mays
  Clone ID: LIB3078-012-Q1-K1-F5
tcccactcgtcctcccactcgtcctcccactcttccgaaaaaaaaaaaaaaaaaaaaaaaaaaaaatttaaaaaaaaaaaaagaaaaaaaaaaaataaaaaataaaaaaaaaaaaaattaaaaaaaaaaatctaccccacctttccttcctccctttttaaagtttctatttttactttcctttccttccaacttcttactttttttttatttccccttaatttaattttatttcccctctttttaaacctttttaattggaaaaccctttcttttacccaatttattccctttcaaccccttcccctttttcccattttcctttttttcaaatatcccttcacttttcccctttccaaacatttccccatctttattttcaatttgtactttccttttaacttttcttttaccctttcttttttgttttttccccc

SEQ ID NO: 72605 - DNA, 399 bp, Zea mays
  unsure at all n locations
  Clone ID: LIB3078-012-Q1-K1-E1
gcctctactacgcgcttctccacgtcgggctcgccggctccccgcgcaaccccttcctgtcgcacgagatcggcggcgaggacggcgccggggatagcgacctagggttctccaagtgggccgagaagctccgtggcggtgcctcaggtgaaaaagatgctcagcataagagaaagctaactagcaaatggaagcccacgaccaaaggcacactgaagagaacctaccgagtacgatcaacggatganggaaagcggatccctgatgagattgcttcagttctgtcccaagatgatcattntgtggatgcttcgtctcacaagggttgccanattatgagnggaagtgctcatggcaaaagtgtttgctgctacaacgtgagagcgttgttcgatgagc

SEQ ID NO: 72606 - DNA, 268 bp, Zea mays
  Clone ID: LIB3078-012-Q1-K1-C3
cacgcatacggactactacttcctccggtttctctctgcttgcgcactgtcacctgcccgcgccatcttcaaccgggaccgagatgaacattgatagcctcatgaagatacacccttgactctgcacacggagcatggtcaccatgctcacgagaaaaaaaggtgtactcataacaatcaccacgctcgacaataccactaacttcactctcaaaagattaagggtcaacaccatccctgcaatcaaagacttgaacatattcaagga

SEQ ID NO: 72607 - DNA, 368 bp, Zea mays
  Clone ID: LIB3078-012-Q1-K1-C4
cgaggacgtctggttccatgtggacaaggtatcctcggcacacgtctacctgaggctagagaaaggcgagacgatgcacaccatcagcgaggccctcctggaggactgtgcgcagctcgtcaaggctcactccattcaaggtgcgtgctcgatctcctctgacctctctctctctctgtctctctccatgggagaagaaccaaaaacagaacacggtgtgccctgccctacaaggcttttcagctcccacattgcagcatgttgcggcggctggaatcttttctcactccccccctgtagccatcgagcaggagatctatcaagagagcgccttcttcgtcttcctctctttctcctaactccattat

SEQ ID NO: 72608 - DNA, 408 bp, Zea mays
  unsure at all n locations
  Clone ID: LIB3078-012-Q1-K1-C5
cttaacaaggatgatgatgtacgcaagtacgtgaacacataccgcaggacattcactagcaagaacggcaagaaggtcagcaaggcacctaagatccaacggcttgtgacacccttgaccctccagaggaagcgtgctagaatcgctgacaagaagaagaggataactaagaagaagtctgaggctgctgagtaccagaagcttcttgcccagaggctgaaggaacagagagaccgccggagcgagagcttggccaagaggaggtccaagctttctgccgncgccaaggcttctgctgccacctctgcttaagaatgttcagtgttttgggatctttgtaaggtctatcttgtaacggcaaaagtgttttgggatctttgtaagctccatagttcacatcacttaagt

SEQ ID NO: 72609 - DNA, 460 bp, Zea mays
  unsure at all n locations
  Clone ID: LIB3078-012-Q1-K1-C6
cgctccagctcagggtggtggtgacgggcgggtacgacggcaagtgggtgtgggccgggcgcgaggtgctgccgcggtggcggcgcgccggcgaggtctacgacacgggcgtccagatcacggacgtcgcccaggagggctgcttcccgtgtgacacgcacgagtgggaggaggagtgacggcaccagcagagcagaggctgcaacggaactcgctgaggactggagcctgcgggctgcggagttgagttgctctgtctgactgctccgtgtcagtgtcactcgctggctttctttgtctgagttttgccggagtggcacttgtaacgacgagaggagagagccccgaaaccnctgtccctcccctgtacatgaattagctgcatgcgtcgtcgacgttgccatgggccgtgtttcaaccggatcacatgcctcgttcgcgttgctttctgccaacactc

SEQ ID NO: 72610 - DNA, 441 bp, Zea mays
  Clone ID: LIB3078-012-Q1-K1-C9
cggacgcgtgggccggcagcgtcttcaatccgctcaacttcgcgcccacgctcgaggcgaaggagaaggagctcgccaacgggaggctggccatgctggcgttcctggccttcctgatccagcacaacgtcaccggcaaggggcccttcgacaacctgctgcagcacctgtccgacccatggcacaacaccatcatccagaccctgtcgggttgagtcgacggtccatcaggtcatgtggtccgagctgaaaggccgagactcgaagacagttcgtgtgatgcgttcttaatcgactgagggctaaggaatgtgacgtactggtatatgtacattagttgaagcggaggctataaagggtgtagagattgtttcatcagtgtatatcatctgtcccgatgggttttgttttgtgcttttcacgattcattgtggaagcaca

SEQ ID NO: 72611 - DNA, 243 bp, Zea mays
  Clone ID: LIB3078-012-Q1-K1-D1
cctaacttcatttcgtggcaccaatataacgaagcgcactaagaatgcaagaatttttagcaaatatagaaccatttattgtgctagcttgcttattcaaatcaataatatggaggtatctcatcattccaagtacttttgctagttctgtgttaagtttgctgttaatacgaaagcatttttaatttgtgattgcaaggactgttgtaatgtgaatgctgatacttcttacaccattaacac

SEQ ID NO: 72612 - DNA, 425 bp, Zea mays
  unsure at all n locations
  Clone ID: LIB3078-012-Q1-K1-D10
cgatggcgctcgactctgcctcgtcgacggatccgcggtctcctctgcatccgtgctggtactggtccgccggccgcgcctgtcctctacacgggagttcgctgcggccgtcacgcactctggggcgctgttcgtcgccggtggctacgtcccctggtcccctttctacgccagggctctcgatctctccactctgaatgccaagcggagagccgtcgccagtcctgcacacctccgcgcgatgtggatgcacggctgcgcggcgctcgatgggagggtctctatggctgcgcgatggaggatactccaccggggctcaagtaattgctcgccggacttcacatccgccgcggtgccgctctacgtcgaggaccgactccaacgcgcgctctangccgagcgaggacacgtgtcatctgaaaagc

SEQ ID NO: 72613 - DNA, 436 bp, Zea mays
  Clone ID: LIB3078-012-Q1-K1-D11
ccgacaccaccaccctcttcatcatcgagctcatcctcatcggctgggccgagggccggcgctgggctgacatcatcaagcccggaagcgtcaacaccgatcccatcttccccagcaacaagctcaccggcaccgacgtcgggtaccctggtggcctgtggtttgacccgctcggctggggcgccggctcgccggagaagatcaaggagctgcgcaccaaggagatcaagaacggacgcctcgccatgctcgccgtcatgggcgcttggttccaggccgagtacaccggcaccggacccatcgacaacctcttcgcccacctcgccgaccctggccacgccaccatcttccaggccttcacccccaaatgaggagctctgatgaacttagcagttcgaggagtgctaccacacatgcatgcattgttaggtttgat

SEQ ID NO: 72614 - DNA, 499 bp, Zea mays
  unsure at all n locations
  Clone ID: LIB3078-012-Q1-K1-D12
tccgtccgaaccctattgcaaaagaaatttgtttgtatttcctaaatttaatgtgtgnnatgatatcatattgtgggtgctgactaacaagatcgtaatgtgtggagatagtttacgtagggaatcattatatacagnnaaattcgagaatgctcttatgatgcgnngggagctctgaagtnnatttccttaggagtttcaaggtgcaagcaacttccaagaatggcgaccttcatcatgccaaacaanaatacatacaangacataccttaccaagttntggaataaanggatgccaaancccatcaagacacctcatgggaaccaatgtgcatctcgacctcgacacgggagattatatattctacaggtgcataaaggttcaacacaaaccaataaaagattgaagttagggatcaaattcaaaggagcaaagaaaccgagtatgccctagtctggcgcaccggactgttcggtgtgccacccgacattgttcggt

SEQ ID NO: 72615 - DNA, 213 bp, Zea mays
  Clone ID: LIB3078-012-Q1-K1-D2
tgctcatcccagatgtacttaccaatttctcactcatcaacactccacacaatacgacaccttcaaatcggagtacgtatccgtcatgaacacgctattcatcatccaattcatcctattccactacttgctcatcctcctcttgcaagacatcaataacccttacatcatcaaccaagaccccatcttcaatatctacagtctaccaactca

SEQ ID NO: 72616 - DNA, 451 bp, Zea mays
  unsure at all n locations
  Clone ID: LIB3078-012-Q1-K1-D4
tgaacaatgggtatagatagacatttaactatactcaaagagctgatgtcttgcatctggtgaaataattcttgatgcttttttaatattttttttccgttcgtaatacctgatgtcccctgcccctatctgtctcgctacagcactgctgaacctgaagccgggctctgcggactacgccctcttcgccaacgcctccaagatcacgccgtcagccggcggcaaccctgcgagcgacagcgccgcgggcagcggcgtcaagctccgggctggggtcagcggcggcgtcgcgctcgccgtggtctccgcgatcgccttgtcactcttctgatggaccgacctnctctcaaaggagcaacggcggtttttttttacccttctgtggattccttctcgtgcttcgttccgctagcccatgtctactctggactatcttataaaaaaaaattga

SEQ ID NO: 72617 - DNA, 425 bp, Zea mays
  Clone ID: LIB3078-012-Q1-K1-D5
gagcattttgttttacctcgttgtcgaagtatgctgtccagaccaacgagccccactgggtgtagtgatgcagtcttcataaccgaagaagatctagagggctatgagacctacgccgatgacgggaaggacgttgtcgaagtgcaagtagtggttcgccacaagcccatcatgaggaaactctcctgcttccttgggtccttgaagcttaccggcaattgcgagccaccacctggccgtttgaccgaggttcgagcctgctaggtggatcagctatggtttccgcatctgtttttcgctctttgtacatcggcagagtgtaattaccggcataagtttgcacagcctgcggaattccctcgggacagaactgtatgttgtggcatgtgggtggcgaggataatttggctatcgggagccgggag

SEQ ID NO: 72618 - DNA, 345 bp, Zea mays
  Clone ID: LIB3078-012-Q1-K1-D6
cgccgctgccgcatctcctctacaggtaagaaggagagaaagagggcgaaatggtgaaggacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctttacccttgaggagttgaaggctgcgggcattccaaaaaggcttgctccaaccattggcatttctggggatc

SEQ ID NO: 72619 - DNA, 430 bp, Zea mays
  Clone ID: LIB3078-012-Q1-K1-D7
ctagttctagatcgcgagcgccgcccttttttttttttttttccggggaaggagcatggtaccactctgttttgccacagacattcaggtccacataacgtcaatacaaagcgccaagacagaaacaaacgcttacattgcatggttaggaacagtatgttacatacaaggagcagcaggaacatatctgcctctttcattcaacaacagctgatcgacaaataaaaatcaactctgttgtagccttgtaggatgaactcaagtggtcaatatttggctttcaaacatggcactgctgcactataccattttcagatcaaaggcttccctgtatgtcatcagaaattattttcatccccactggccccacctgtcatacacacaaaaatccatatatgccattctatggcacacaagggatgaaaataaa

SEQ ID NO: 72620 - DNA, 427 bp, Zea mays
  Clone ID: LIB3078-012-Q1-K1-D8
ggttcaccctcaaggaaggctccccgtaccggctcaagttcaccttctccgtcagcagcgacatcgtctccgggctccgctacaccaacaccgtctggaagacggggctcaaagttgacagagccaaggagatgctcggcacgttcagcccccagctggagccctacacgtacgtgacgccggaggacaccaccccgtcgggaatgtttgcccgggggtcctactctgccaggaccaagttcctcgacgacgaccgcaagtgctacctggagatcaactacaccttcgacatccgccgggagtggccgtcgacgagctgaccatccttccctacctccatcggtggcctgagcagaccagtcgtttcgttctgtgttcttccttttctatgttgcctcgttctgtcctgtcactaggttttttggtt

SEQ ID NO: 72621 - DNA, 439 bp, Zea mays
  Clone ID: LIB3078-012-Q1-K1-D9
cgactcagcgagcgagagcagcacacactcagctagctaggagcagcagcagcggcgggggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccc

SEQ ID NO: 72622 - DNA, 442 bp, Zea mays
  Clone ID: LIB3078-012-Q1-K1-C12
cacaacccatggcggcggatatggcgtacgcgccgccgatgaaggctggcaaggccgggttcgaggctggcatgatggatccacagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccaccaggaagtctccctgtggagaaggtaccaacacctgggatcgctttgagatgaggattcacaagagggtgatcgatctcgtcagtacaccagacgttgtcaagcagatcacctcaatcaccattgaaccaggtgtcgaggttgaggtgactatcagtgacgcttaatatggtagccttatcatttcaaaaggcttctagtgaacaggatattt

SEQ ID NO: 72623 - DNA, 337 bp, Zea mays
  Clone ID: LIB3078-014-Q1-K1-D8
cggacgcgtgggcgaccgcatccgtgccgtcgtcgccgagattgagtccgcctcccgcgtcgccaccgccgcgctcctcctagtccaccagcccgtccccctggcagatgtgcttgtgaaagccaaggcgcaggtagaggtgatcaaggggttgtacgcgcgcctggcggaagtcctcaaggaatgccctgggcagtactacaggtaccatgctgattggaggactgagacacatatggtagtgtcgatgcttgcattcatgcactggctggagacaggtggcctactcatgcatgctgaagcccaagagaagctagggttgtgctctggggagttt

SEQ ID NO: 72624 - DNA, 336 bp, Zea mays
  unsure at all n locations
  Clone ID: LIB3078-014-Q1-K1-E1
cccacgcgtccgcttttggaggcataaatctgaggtgcagacaattagacagtttccggggacacaagtatttgctgctaagctatccaatgaactagctcagtctcagtatatatgctttagacctgaaggtaatggacaggagaacaggagtggggtaaatgcacaagcagagagacaggatctgtagaggtaggcgagagatactccggtgtactctgtacatggttctaaaaaattgggcagaaactggattgtccagaccgttcatatacgttgtactaaccagttgttgtactagccaattgcgctacggntnngttgtatatattatac

SEQ ID NO: 72625 - DNA, 431 bp, Zea mays
  Clone ID: LIB3078-014-Q1-K1-E10
cggacgcgtgggcgcccaatctccacttctttatcttctccgaggtgagagagcccaggcgatccaattccaccctcgttctcaggcactgtcacacagacacagctgacctgccactgccaggaaagtaggtcgaggatgccccgcagcggcttctcggggtccttcaggtcgcccaagatcgacgtcgtcatcgacatgggaaaccccttcctcaaccgcaccgtcgacggcttcctcaagatcggcgccgtcggcgcctgcaaggtggctgccgaggagaccttcgagtgcctccacaggggggatgtttcgaagcacaaggttgagcatgccctgaggaagatgtgcaaggagggcgcatattggggcactgttgctggagtttatgtgggcatggtgtacggcgtggaaagggtccgtggccgcag

SEQ ID NO: 72626 - DNA, 429 bp, Zea mays
  Clone ID: LIB3078-014-Q1-K1-E12
cccacgcgtccgcccacgcgtccgcaaggctaccattaacatgcttcgcagggttgagccttatgttgcatatgggtacccgaacttgaagagtgtcagggagttgatctacaagaggggctacggaaaactgaacaagcagaggatccctctgtctaacaaccaagtcatcgaggaaggcttgggcaagcacaacatcatttgcattggagatcttggtcattaaaaccttaattgtcggccaaaatttaaaggaggcgaacaacttccttgggccatttaagctgaaggcaccgttggaaggcctgaaaaggagaaggaccccttttttgaaggttgtgaatcccgtgaccgtgagaattacattaacgagctcattaaaaggatgaattaggttcacgatcaagctctattgtgttctaagaaact

SEQ ID NO: 72627 - DNA, 423 bp, Zea mays
  Clone ID: LIB3078-014-Q1-K1-E3
cccacgcgtccgagacagtacatagtgatgccgggcaggtatatatacacacagagactgaaaggtgccaatgtcaatgatcagatcatattaaacaaggtgctactggtgtcaactagagaaaaagcttacattgggatgccagtggtgaccaatgctgctgttcacgcagtggttgaagaacagggacgggatgataaagttatagtgttcaagtacaagaagaagaagaagtaccagaggaaacttggtcacagacagccaaacacaaggttaagaatcacaggcataagtggatacgaagagtaccctgctgacccaatacttgaccctgctgcagctttaaattaaactgtaagttatgtagttacaaaacggctggtagtagaatagcatgctagatttcttggttctttccttttt

SEQ ID NO: 72628 - DNA, 372 bp, Zea mays
  Clone ID: LIB3078-014-Q1-K1-E5
ctcccaacccctacactcccggcggcggcgcaggagcagcagcacccgaggatggtgaagttcctcaagcccggcaaggccgtgatcctcctgcagggccggttcgccggcaggaaggcggtgatcgtgcgcgtgttcgaggagggcacccgcgaccgcccctacggccactgcctcgtcgccggcctggccaagtaccccaagaaggtggtccgcagggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctcttcaaccgcgacaag

SEQ ID NO: 72629 - DNA, 401 bp, Zea mays
  Clone ID: LIB3078-014-Q1-K1-E6
ggagaagtgggtgcgcgtggacttcaaggagcccgtgtggttcaaggccggcgcgcagatcttctcggagggcgggctggactacctgggcaaccccaacctggtgcacgcgcagagcatcctggccgtgctcggcttccaggtcatcctcatgggcctcgtcgagggcttccgcatcaacggcctcgacggcgtcggcgagggcaacaacctctaccccggcggccagtacttcgacccgctgggcctcgccgacgaccccgtcaccttcgccgagctcaaggtcaaggagatcaagaacggccgcctcgccatgttctccatgttcggcttcttcgtccaggccatcgtcaccggcaaggggccccttgagaacctgctcgaccaccttgacgaccccg

SEQ ID NO: 72630 - DNA, 307 bp, Zea mays
  Clone ID: LIB3078-014-Q1-K1-E7
ctgcgctacgacctcaagaccgtcatcgcttccaagcccaaggaggagaagaagagcctcaaggagctcaccggcaagctcttcagcaccatcgacgatcttgaccatgccgcgaagatcaagagcaccccagaggccgagaaatacttcgcagcaaccaaagatgctcttggcgatgttctcgccaagctaggctagacgcaagggctaataatggccatgtaatttcggacttgtgtttgttcatatggacccggcaaggcaatgtaccattttctgttgatattgtatcaggaagcacttaact

SEQ ID NO: 72631 - DNA, 384 bp, Zea mays
  Clone ID: LIB3078-014-Q1-K1-E8
cccacgcgtccgcccacgcgtccgggaaaggcaaggggaagggcgggggcgcgtcgcctgagaagggcagctctggggcgccctccggtgaggacgactccaggagcagtgacagcggcagcgatgagtcgtcagagacgagagatgatgacactgaccataagggttcatctgcgcccaagaaaaggaaatctggtaacacgtcggctgaaggtgaaccgtctcaagctgctgttgtgcgctatgctacggttgagtcgccatatcccgcaaagggaaggtctgcctcaaagcttccagtgtctgcacctggcagggcagcgcttcctagtgccaccccgaatctgaacattgggatggacatttggaatacttcttctggct

SEQ ID NO: 72632 - DNA, 418 bp, Zea mays
  Clone ID: LIB3078-014-Q1-K1-E9
cccacgcgtccgcttgcatagggtttatcttctcccctcctctgcccccatctcgcttcgggcacacggcagccggattccgaagcgcgccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggtgccgcagaggagaagacagttggtggcattttgcttccatctactgcccagactaaaccacaaggaggtg

SEQ ID NO: 72633 - DNA, 338 bp, Zea mays
  Clone ID: LIB3078-014-Q1-K1-F1
ggcaatgcagcaccttgagggaaaatatgaattcatgacatctgatcactcatatgtatcacggaagcatgaggaggataaggtgatcatctttgagagaggagatttggtcttcgtgttcaacttccactggagcaatagctattttgactatcgcgttggttgtttcaagcctgggaagtacaagatcgttttagattctgacgatggccttttcggtggatttagtcggcttgatcatgatgccgagtacttcactgctgactggccgcatgacaacaggccgtgttctttctcggtctatgcacccagcagaacagccgtcgtatatgcacctg

SEQ ID NO: 72634 - DNA, 426 bp, Zea mays
  Clone ID: LIB3078-014-Q1-K1-F10
cccacgcgtccgcgtgtgcgcggcgccactatgcgtgttgcctcttcccctggtgaagcggggaattctcgctccagcgtcgagtccaacctccggagctctaacgctgctcatgcgcggcgatctagtgctggcgtcacaagcaacggtgttcacaagattctgttccctgatggtcatcaaagtgacgatgaacctccaagtggggacatgcggtatggtacaggacgtttctacaaggagaatgggagtatagaagggagattggggaactgtgactccgactccaaccatcatacctttgatgaagcgagcgtgggcaagtttgagaatggagggactcattcaggtttggatctgtatggtgagtcgatggcgttacttcagtcggcacaagaagcgcttgacaatgagatccaaaagttt

SEQ ID NO: 72635 - DNA, 428 bp, Zea mays
  Clone ID: LIB3078-014-Q1-K1-F11
cggtgaatttgcccaagggaacaggccagtcggtgaagattgcggttctcacacaaggtgagaagatagatgaagctagagctgccggagctgatatcgtaggtggagaagatttgattgaacaaataaaaggaggatttatggagtttgacaaattgattgcatcacctgatatgatgcctaaggttgcgggcttaggtaagattctaggaccaagaggactgatgcctaaccccaaagctggcactgtttcttcaaatattactcaggctatagaagagttcaagaaagggaaggttgaatacagggttgataaatcaggaattgttcatattccatttggcaaggttgactttccagaggaagatctcattgcaaacttcatgtctgttgttcgctctgttgagaggaacaagccatctggtgct

SEQ ID NO: 72636 - DNA, 380 bp, Zea mays
  Clone ID: LIB3078-014-Q1-K1-F2
gtgctcatcaggcaggcagccatggtcccctgcctcttaggcaaaggctggtcgcggataggcagatatcccccagattcttgtacctgatgcacgtggagctgggtggcatggcatcgcagagccgactccacctccatggggttgctgcttgcttgcttgcttcttcccacagcgttcttgaatactgggaagcacgataggacgctggtgctctggactcgcagaggcgcatttgttatccacggccacagtagccagccccagggggggcacacagactgggcatgaagaagaggataacaacagattactgaccagtattcatcttacatttgttaccccgtggctttttattctaaaatgtaagacctttatta

SEQ ID NO: 72637 - DNA, 416 bp, Zea mays
  Clone ID: LIB3078-014-Q1-K1-D7
cccacgcgtccgcccacgcgtccggctcgacatgttcatttactagttagaaaggagcagctacgggcttccaaagctatgcaggacagagtactcaacaaccccaacataacagtacatttcaatacagaagccatggatgttgttagcaatgacaaagggcagatgtctggcgttcatctgaagagaagagatacaggagaagaatcagttcttactgtgaaaggtctattttatggcataggacatactccaaacagtcagctgttgcagggccaaatcgaacttgatagtgctggctatattttagttaaagagggctcagccaaaacttcagttgatggtgtattcgctgctggtgatgttcaagatcatgaatggagaccagctattactggagctggatctggatgcat

SEQ ID NO: 72638 - DNA, 358 bp, Zea mays
  Clone ID: LIB3078-014-Q1-K1-C2
catgcttgatggcgtgaccatcctccggtccgagaaggtcaaggatgagctcatccttgacggagacgacgtcgagctcgtatctcgctccgccgccctcatcaaccagaaatgccatgtgaagaagaaggatatccgaaagtttttggacggtatctatgtgagcgacaagggcgtcatcgaagaggagcagtgagcgacagagtagccgaaatgccaggagatgaatatgaatgtcgtttgagttgcaattttgtgagactgaatgtgaaccatttttctcattccttaaatagttgactgccggtgttcgtggtttcaaacggaatttagtcttattaactgaatttgcgtattc

SEQ ID NO: 72639 - DNA, 379 bp, Zea mays
  Clone ID: LIB3078-014-Q1-K1-C3
gcgggatggtgctcgggctcgggacgggctccacggccgccttcgccgtcgccgagatcggcgcgctcctggccgcgggcaagctcgagaagatcgtcggcgtgcccacatccaagcgcaccttcgagcaggcgcagtcgctcggcatcccgctctccacgctcgacgacaacccgctcatcgacctcgccatcgacggtgccgacgaggttgaccctgacctcaaccttgtgaaagggcggggtggtgctcttcttcgtgagaagatggttgaggcagcatcggacaagtttattgttattgttgacgagacaaaactagttgatgggttaagaggtagtggtctagccatgccagtggaagttgtgcagttctgctg

SEQ ID NO: 72640 - DNA, 378 bp, Zea mays
  Clone ID: LIB3078-014-Q1-K1-C4
tggtgcaaagatggggctgcgcttatcgggggctgctgcaggacaactccaaacactatcagggccatacacagaactcttaaccaaggctgccacaagcatcagttacctgtaggctgtagcatagatctgtgctccactcctgatgctctcctcccagcagtaccttgagctgtatccccgagattccttaaccagcgcgagccaatatactgttgcgtgttctcctgcaaatgagatgttctgcacctatgcttgtaatgttgtatttctgggtttttaagctatccaacttggagatacaaccggtgaggaagcagcaacaataggtagttctacttctgagtgaggaaaaacaacttgcggctgagttaatga

SEQ ID NO: 72641 - DNA, 413 bp, Zea mays
  Clone ID: LIB3078-014-Q1-K1-C6
cccacgcgtccgcccacgcgtccgcccacgcgtccgcgctcctgccctctgcctggtggacacgctcgccctagcccccagcgtcgaccgcccctgctcccttctgcagcctcaactccctcacggctgctcccatgacctttcccatccatggccatcacccatctgaagtcgtggagcacgccatggcctccaatgtcgtcagtctccggagcgccgcgtggccgctgctctaccatttcctggtagattggaccggaacagactaacggagcggagttctgctattaatcattataggtacgctagatgattatgcgatatgaagggcatgaaccagactgaaccacaagatggatgatctgacccagtgccaggatgagagatgctcaccgagtggtcctcgttttgac

SEQ ID NO: 72642 - DNA, 342 bp, Zea mays
  Clone ID: LIB3078-014-Q1-K1-C7
cccacgcgatcgcgttgtcgtatcctccttcgtaccatcactctctggtcgcgcactctcacctgcccgcgccgtctgctaccgccaccaagatgaacaaggagaggctcatgaagatggtcggctccgtccgcaccggcggcaagggcaccatgcgcatgaagacgaaggctgtacacaagacggtcaccacggacgacatgaggctgcagggcactctcaagagagtacgggtcaacacgcattcctgcaatccaggaggtgaacatattcaaggacgatctcagaatccagctcttgaaccccaaagtgcaagcttccatcgtagcaaacacgtgggtg

SEQ ID NO: 72643 - DNA, 432 bp, Zea mays
  Clone ID: LIB3078-014-Q1-K1-C9
cccacgcgtccggccgaatcgacccgccccgatccagatcaggagctgagggatggacgcgaacaggcgccagagtgggatccagcagttgctggctgcggagcaggaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcacccagcaggccgcaagcatctccccggatgtcattcagatgcttctgcggcatgtcaccaccgtcaagaactgaggagtgctgttcccgaactatgctcgcagacttgtaccgtcgatcta

SEQ ID NO: 72644 - DNA, 331 bp, Zea mays
  unsure at all n locations
  Clone ID: LIB3078-014-Q1-K1-D1
gctcaagttcgaggagaaggacggcatcgactacgccgccgtcaccgtgcagctcccggggggcgagcgcgtgccgttcctcttcaccgtcaagcagctcgtcgccaccggcaagcccgagagcttcggcgggcccttcctcgtgcccagctaccgtggctcctccttcctcgaccccaagggccgcggcggctccaccggctacgacaacgccgtcgcgctccccgccgggggcagaggtgacgaggaggagctccagaaggagaacatcaagaacgccgncttctncaccggcaacatcacgttgagcgtcaccaagagcaacccggag

SEQ ID NO: 72645 - DNA, 427 bp, Zea mays
  Clone ID: LIB3078-014-Q1-K1-D10
ggttcaccctcaaggaaggctccccgtaccggctcaagttcaccttctccgggagcaacgacatcgtctccggcctccgctacaccaacaccgtctggaagacggggctcaaagttgacagagccaaggagatgctcggcacgttcagcccccagctggagccctacacgtacgtgacgccggaggacaccaccccgtcgggaatgtttgcccgggggtcctactctgccaggaccaagttcctcgacgacgaccgcaagtgctacctggagatcaactacaccttcgacatccgccgggagtggccgtcgacgagctgaccatccttccctccctccatcggtggcctgagcagaccagtcgtttcgttctgtgttcttccttttctatgttgcctcgtcctgtcctgtcactaggttttttgttt

SEQ ID NO: 72646 - DNA, 429 bp, Zea mays
  unsure at all n locations
  Clone ID: LIB3078-014-Q1-K1-D11
ctcatgcagagggcaccacccacacgctggaaggcacccacacgctcggatgggcatgggtcgcaggatgcctcatcatgttcgccaactgcatttgcttgtctgcgtggatggttctgcaggtcccggttctgaagaaatacccagctaagctgtcgtctttcgccatcactctggcgttgggtttcgtccagctcgctgtcgtcgcgccgtttttcgagagcgaccttgagaggtggaagatcagctccggaggcgagcttttcaccatcctgtatgctggcgttgtggtgcttggaatcgcctggtatctcatgatctggtgcataaacaaaggaaggcctcacttcgtttccgtcttccagccactgcaaaccgtcatggtcgccatcatggccgncatcttccttggcgacacactctacattg

SEQ ID NO: 72647 - DNA, 428 bp, Zea mays
  Clone ID: LIB3078-014-Q1-K1-D12
gcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgcc

SEQ ID NO: 72648 - DNA, 362 bp, Zea mays
  Clone ID: LIB3078-014-Q1-K1-D2
cccacgcgtccggggtttagtcgcgccgccgccgccgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcattcacctgg

SEQ ID NO: 72649 - DNA, 349 bp, Zea mays
  Clone ID: LIB3078-014-Q1-K1-D3
cccacgcgtccgcccgcacgacacgacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcg

SEQ ID NO: 72650 - DNA, 370 bp, Zea mays
  Clone ID: LIB3078-014-Q1-K1-D4
ggcttgtgctgcattgcagagctgccttccagacatgctcaaagatgggaccttcaataactgccttagggatgatccagcgacaaggcgctggctccaacagctcctgcacaatgtgactggcggaggcatgggaggtgctcctcaaccaggaatggatcccatgaacatgggaatgtgatgtgcattctagttgttgcaattcactgcaataacacatcacctctcagtgaattacaactagagaagatctggccactgtccagatgaaacttagtatggtgtagcctgactttctgccggggtaaaaataggaatgttgtttggtattgccataagctaagctgtagaaacaagatcggcaggcttc

SEQ ID NO: 72651 - DNA, 421 bp, Zea mays
  Clone ID: LIB3078-014-Q1-K1-D5
gaggtatgagctgtttatggaggccttcgatcacatatctaaaggcatcgacaaaatctataagcagctgacaaaaagccatacacatccactcggaggaacagcatatttaaatctagaaaatgaagacgaaccgtttctacatggaatcaagtacacagctatgccacctaccaagcggtttagagatatggaacagttatccggtggggagaagactgttgcagcactggctttgctctttgccattcacagttttaggccatcaccgttcttcatattggacgaagtagatgctgctctggacaatttaaatgtggccaaggttgccgggtttatcagatcaaaatcatgtgaacgtgttggtgatgaacaaggcagcgatggcgaaagtggttttcagagcataggtatatctctg

SEQ ID NO: 72652 - DNA, 375 bp, Zea mays
  Clone ID: LIB3078-014-Q1-K1-D6
cggacgcgtgggggcgcatcggcgacgacggcgttgcgccctggtccatctaccgaactcgcctacccgcggtcctcgtcgttcacaggcggcgcgccctcgtccaggtccagtcgtcctcgttcacgaaggcggcctcgtccagcctactgttccttctgctacaaattcatagtcactgatggggaaggcaaagcgtgcctcgatcttcatcaggctggtttctgcagccggcactggattcttctacgtgaagcgcaagaatcctcgtcgcatcaccgagaagcttgagtttagaaagtatgatccccgtgtgaacaagcatgttctggttaccgaagcgaagatgaagtgagatcttggttcttcacaatg

SEQ ID NO: 72653 - DNA, 363 bp, Zea mays
  Clone ID: LIB3078-014-Q1-K1-C12
gccaggcgttcggccacgagtgcgtccacgagtgcgagcacacgcacggccgctcgtccgtgctcgccacgctcaggcgttgtccacgcagtggctcaccggagtgacctggaaggacgcctgcaacggggacttggtgtactgttcatcactagcagtgtcagtcgctgtcgcgcatcatctataccctcatgaagaccgaggctcatgagatcggctacatctagtctcagcgaagctgctaacatgacatggagaagaagctgctcttcaagcggatctacttgcacccgctcggcctggagctcgaccctgacaagactgagcgactgcagctgcgagagatcatagcacagcgctgac

SEQ ID NO: 72654 - DNA, 262 bp, Zea mays
  Clone ID: LIB3078-014-Q1-K1-A7
cccacgcgtccggtgaaggctcagggtaatgattgcatgaggctgaaggttaaacgagtctctatggagcacactcaccatacatgccaatacattccgctactcatgatcttcaaagagcatggccccattcgtagactcgatgaacctcacctgtcgtcaccgtcaaatactccggctctgtacactccttccaccctgtcgcatcctcccaagcccgctgctccacccactttgtcggagtctacaccaccgtattctc

SEQ ID NO: 72655 - DNA, 353 bp, Zea mays
  Clone ID: LIB3078-014-Q1-K1-A8
ggcgcacagggcgagcctcaggtaccggtccctcctccaggactaccaggagctcatcaaggaaacccaagcaaagaaggagaggctgtacatggagaggctcaggaagaagaggcttttggctgaagtcaaattcttgcgtaagagataccaatctatggctaagaacccctctcagacaattgcttgtagagtgaagaatccagcactgtcgtctgcatcctggagggctgcttcggtaagtgacgcccagcaccagttggttcgtgctgtcgggagctccagtagaaaccagctggtgcagccaaggcgcggtggttctccaagggtgtatccggcgattgacctcaatg

SEQ ID NO: 72656 - DNA, 430 bp, Zea mays
  Clone ID: LIB3078-014-Q1-K1-A9
cgcgcagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagacccatccattcgtccgtccgtccgtccgtccgtcgagtgaacagtgtggtct

SEQ ID NO: 72657 - DNA, 347 bp, Zea mays
  Clone ID: LIB3078-014-Q1-K1-B1
ggctcaagcgccgcagcaatgtctctggccccgtccatcccttccatcaaggtgaaggtggggcccgtctcggtggcgcccccgcaccgcgcatgccgatccttcgcggtggtcaggagctccaaggcggagggccccatccggagacccgcggcgcccccgctgtcgccaccgccaaagacgccggctctgtccactcctcccaccctgtcgcagcctcccaagcccgctgctccacccacgtcgtcggagtcgacaccaccgtctcctcagccgaaggcggctgtggccacagcccccgcggcagcgctgcagaggccgctggctggggctgtgacgcttgagta

SEQ ID NO: 72658 - DNA, 425 bp, Zea mays
  Clone ID: LIB3078-014-Q1-K1-B10
cccacgcgtccggaaatcttccgttctcaaaccaacctaggcaattcgccggagcctctcaccctcgcgagtcccgacctcccgcagccgccgcacagatggcacccaaggcggagaagaagccggcggccaagaagcccgcggaggaggagcccgcgacagagaaggtggagaaggctccggcggggaagaagcccaaggccgagaagcgcctcccggcgggcaagtccaaggagggcggcgagggcaagaaggggaaaaagaaggcgaagaagtccgtggagacctacaagatctacatcttcaaggtgctgaagcaggtgcaccccgacatcggcatctcgtccaaggccatgtccatcatgaactccttcatcaacgacatcttcgagaagctcgcggccgagtccgccaagctggcgcgc

SEQ ID NO: 72659 - DNA, 377 bp, Zea mays
  Clone ID: LIB3078-014-Q1-K1-B11
cggacgcgtgggctcggcttcgccgtgcaggccgccgccaccggcaaggggccactcaacaactgggccacccaccttagcgacccactccataccaccatcttcgacacgttcggaggatcctcttaagcccgccattgatccgctccgtccatcgatcgaaacgtggtcttgaattaactatgatagatctctatgagcctggagatggatcaacccgtcgtgcgttgtttcattttgtgatgaatgggagagagggtatgggacaagattgatcaacccgtcgtgcttacgtctcgttaattaggagagctaccgctcggatttggtgatttgtaatatatgaaccagtgatgaataaatgcattcacttgtac

SEQ ID NO: 72660 - DNA, 421 bp, Zea mays
  Clone ID: LIB3078-014-Q1-K1-B12
tctacggctccaatttctctgacttctccctgagcctttgcggccggctggagctggacggtccccgggcagcgcaggcagccggactgcgggagtcacctccatggcctcggctgctactgcaaccctccccaaggttcagttgaggccaagatgcaacagctactttcaggtgaccggtcaagtccatgcccacaccaaaacatgcgttgcctgcaagtgtccgacccatatccacgggttgcttgtttcagctggaggaaggaggacattcctgccggtgtctgcagttggatcaggtcagggctcatcggtcactgaggccgacaggaagagcgatttgtcgctggagaacgtcaagacgtccgttgtatcccgcgacgatgaaaagattaatgtacgagtgcagttgcctggaaag

SEQ ID NO: 72661 - DNA, 287 bp, Zea mays
  Clone ID: LIB3078-014-Q1-K1-B2
agcttgcttatttgagaagtaggaagccatgcagtagattttgtatccaaaagccgtgtacttgtttttgtctgatatgtaatctagcgcatgtcacacatatgtattcccttcctttgattgaagggctaatggtatgatgtcttttttttttgataaaaaaaaaaaaaaaaaaaaaaaaaaaaaaaaaaaaaaaaaaaaaaaaaaaaaaaaaaataaaaaaaaaaaaaaaaaaaaaaaaagaaaaaaaaattaataaaaaatttataaaaaaaaaaaaaatttaa

SEQ ID NO: 72662 - DNA, 330 bp, Zea mays
  Clone ID: LIB3078-014-Q1-K1-B4
gtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacgg

SEQ ID NO: 72663 - DNA, 226 bp, Zea mays
  Clone ID: LIB3078-014-Q1-K1-B5
cccacgcgtccgcccacgcgtccgatataattccatacgtatatgggtgtgcaaggtccagaccgaccagctgtatgtcttcatcgttgccttcgtttctgcgtcgtcctcccatgcatgtttatgcatgatgccgtgccgtctcgttgtcagctggttcagtagtgatgcttactttcttgtcgttgttgctaatgtaagaaataagacgatgcgttgactgctt

SEQ ID NO: 72664 - DNA, 413 bp, Zea mays
  Clone ID: LIB3078-014-Q1-K1-B7
cagcttactaaccttgggattgtgtcctggatgtcgaattgtgttgccaaggttcttcaatctttctcattgagctggcctgcagcatttgttgtccttcaggcctcgtacttctttattcactatatatttgcaagccaaactgcacatgttggagctttatactcagcatttcttgcgatgcatttagcagctggtgtgccagctctaatgtcggcacttgctttggcatacaatgcaaacctctttggagcactaacacactatagtagcgggcaatctgcagtatactttggagcggggtatgttgaccttccggatgtattcaagctgggttttataacagccgcaatcaatgctgtaatttggggagttgctggtgcattatggtggaaatttttgggtctttattg

SEQ ID NO: 72665 - DNA, 378 bp, Zea mays
  Clone ID: LIB3078-014-Q1-K1-B8
cggacgcgtgggattttcttgctgatcacagctagtagggagcgagagttaccttgaaatcaaggcagtacgtacgagtacgatcgacaatgtcgacggtcacttcttgcacctttctgagcctcgggtccccagtgcggccggcagtctcctccgcgagaccggcggcggcggcggtggcttcccgacggaggccccggtccctttctgtgtgctgcgaggccggccggaaaggggatcacaacccaaagacggatctgcatccatttaacatccctgccttcgttctggtgcacccggtggcaccacgtgaggaacggtggcagctggaagaggacgccgacaaggtgaacctgtggttcgaggtgcctgggcagt

SEQ ID NO: 72666 - DNA, 435 bp, Zea mays
  Clone ID: LIB3078-014-Q1-K1-B9
ggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggcccgcctccctccgtcatcgtcgactcccc

SEQ ID NO: 72667 - DNA, 401 bp, Zea mays
  Clone ID: LIB3078-014-Q1-K1-C1
cccacgcgtccgcggcgatctacatgcccctggacaacgtgggcatgtggaacgtccggtcggagaactgggccaggcagtacctggggcagcagttctacctccgcgtctggacgccgtccacgtcgttgcgcgacgagtaccccatccccaagaacgcgctcctgtgcggccgggcggccgggcgccggaccaggccgctgtgagagtgagactgccgccggatcattcacagcttttgtcatgagaggatgacacggtattggtttggtctttggagaagagcagggacatacacaagtttatataccctcaactgaaaggaggttcagaggaacgaaagtgttgcttgccgattttttttcattttagtttttttttcctttaaaatttcatattta

SEQ ID NO: 72668 - DNA, 426 bp, Zea mays
  Clone ID: LIB3078-014-Q1-K1-C10
cacagtttttggcgtcattctttacagtgaatcgaaaaagcgcagcaacaagccatgaatgccctaggagacagtaaatatgggaaatcatttctttgtcctgtcagtgcctagagctaatatatgatgagaaatcacatcggtggcgaccacaacaaatcctatgccatactgcctcagcaattggacatcaaggatagaagtccaataactaccttggcatatgggaggcattttgttttatggcgttgatggatagaatataaatatttttttgtgtgtgttagagaactatggctcacactgccagcattggttgatacgtttagctcttgggaaattgcctcttgtattcatcttctgctgctgcagtttccattttgttttgttgtgaagaccacctataccacactttgatccaggttc

SEQ ID NO: 72669 - DNA, 434 bp, Zea mays
  Clone ID: LIB3078-014-Q1-K1-C11
ccctgcggtgcgggtgctttctccagcgacagcgacagcgagaggggaggggaaccagcgggctcctcctcctctacccctcgcctcggcggtgccaacaggcaggcaggcaggtcgtccgcgccagatctatctgtcccttcctcttgtagttgcaggcagacgcgccatgcggatgcgggtgcttcccgcgtcctggtcatcttcctccgccaagcatagcagcggcagctccgagtcgcaggagcacccttcttcctcctctgctacggccgcggtgtacctcaacatctacgacatctcccccctcaaccactacctctactggttcggactcggcatcttccactccgggatccaagtccatggcatggagtatggctttggagctcatgaataccccaccagcggagtcttccaagtagaacccaaaa

SEQ ID NO: 72670 - DNA, 345 bp, Zea mays
  Clone ID: LIB3078-014-Q1-K1-A6
atcacgcacccacaggacaactcaatgtatggtttgatcgctggcgtgaccgccgtaggcggctacgtaagccgctacggcattcgccgacgtcttcgtcggcatgcactcacgaaggctctaaccatggattcagtcgaggcagatatggaagcaaatgtgtcaagctaagcgatgaagttagatagccaggtccacctgatgggcatggttatcattgagggtatcatggagcatgttacagacgatatgacttacaaggagcatggctacgaccatggttactacaatgctgatgctcaatttgaagggaaagctcaagggctaactcgagatcttactgga

SEQ ID NO: 72671 - DNA, 397 bp, Zea mays
  Clone ID: LIB3078-013-Q1-K1-H2
ccagggtatcgctctgagaggactgttcatcattgacaaggagggagtgattcagcactctaccattaacaaccttgccattggtcgcagtgtggacgagaccatgaggacccttcaggcattgcagtacgtccaggagaacccagacgaggtctgcccggccggttggaagccaggggagaggtccatgaagcccgaccccaagggaagcaaagagtacttcgcggccgtgtagactcgccgtctttgagaagctttgctacgtttttgtcatggtgcccgctaagccccccggcagtaggttggagttttgcggagctcgcgtttttacaaatctctgtgctctgaaccgagcgtagtagcccccctttgctggtgtgcatcccgattgagtgct

SEQ ID NO: 72672 - DNA, 418 bp, Zea mays
  Clone ID: LIB3078-013-Q1-K1-H3
acagaggatagcgtctatgacgctgtcaaatctatgactcagcacaacgtgggagctttggtggttgtcaaacctggacagaataaatcaatcgctggcattgtcactgagagagattatctccggaaaatcatagtgcagggaaggtcttccaagtcaactaaggttggcgacatcatgactgaagagaacaaactgatcacagtgaatcccgacaccaaggtcctgcaggcaatgcagctcatgacagaaaaccgcgtcagacacatcccggtgatcgacggcacggggatgctggggatggtctccatcggcgacgtcgtgcgcgcggtggtggccgagcacagggaggagctgaaccggctcaatgactacatccagggaggctactaggacggcgtgtgcaccgacgacccct

SEQ ID NO: 72673 - DNA, 369 bp, Zea mays
  Clone ID: LIB3078-013-Q1-K1-H4
cccacgcgtccgcccacgcgtccgcgggcgtgtcggtgtgggaggcgctggtgctggagatcgtgatgaccttcgggctggtgtacacggtgtacgcgacggcggtggacccgaagaagggcagcctgggcaccatcgcccccattgccatcggcttcatcgtgggggccaacatcctggtgggcggcgccttcgacggcgcgtccatgaaccccgccgtgtccttcggccccgccctcgtcagctgggagtggggctaccagtgggtgtactgggtcggccccctcatcggcggcggcctcgccggcgtcatctacgagctgctcttcatctcccacacccacgagcagctccccttcaccgactact

SEQ ID NO: 72674 - DNA, 399 bp, Zea mays
  Clone ID: LIB3078-013-Q1-K1-H5
cccacgcgtccgcccacgcgtccggagggtcttgaatttgacgctgtctatattggaaaccgaactggtctaagtggtggatggaggggctttgcaatgcaccacaacctggaggaaggggattcattggtctttgaattggctgagcatgacaaatttaagatttatataataaaagctattgatgatgatgtgaaagaggctgagcctgatgacaagaatgacaatggtgttaccaaggaagagcctgaccaggaagaatcacctgttgctgagcctccaaaaggtgccaaaaggagaaaactccgaggacggcggtagtttttctattagtttacatcgaacttttaatattagacactctttgggtaagcgaatgccgctatgctaatgatgcgc

SEQ ID NO: 72675 - DNA, 401 bp, Zea mays
  Clone ID: LIB3078-013-Q1-K1-H6
gcacagcaggtttggttgcggaaaatgggaggagccaagcctgtagtgagtgagggggataggaggataattacagcaggacgagcaaaacgctctaatgctcaaccagctggagaaaggtttaggcagctaaaagaagaggagagcatgagaaaagtcaacaaagcactcgctgcaggagactcaaatgcatcgtcatcaacgtatgacatggaggatgaagagtcggatgacgagaccacagaagagggagggcccgtggaggaagcatccagtactggcagtgacaagaagcctccaagttactcagggaagaagggcaaaagatccaagaggaagcgcatggtgcagtgatcgtcacagctcaatcggatgcgattttcgccacaactggttgattc

SEQ ID NO: 72676 - DNA, 420 bp, Zea mays
  Clone ID: LIB3078-013-Q1-K1-H7
gtccctaacggagtccgcgggccgcggcgtcttcgctacccgcccagtatcttctggcgagctcctccactcagcgcagcccctcgtctcccacccctcccactctctgctccacgaggtttgctacaattgcctcagaaggaagcccggggaagggcgcgcttcaagcgggggtgactacttctgcagcgatgcttgcagggaccacgccaaggggttccatgacattgacaagaatgtagattggtctttattcgattaccactgcagttcacgtgatctgaagtacccatacatggccaagcgccttgcttgcatggttatatcaggagctgctaatgcagattgccttaacatacttcagccagctctgttgcaccaggggacgctgattgagatgaaagaggaatttgagttgtg

SEQ ID NO: 72677 - DNA, 363 bp, Zea mays
  Clone ID: LIB3078-013-Q1-K1-H8
cggacgcgtgggcaaatccagacaccaacgctcgtgcgggagagagagagagagccgaggtcagagtgcatctaccaacgccggccccgtccgcgcctggagctcgggagttcacgacgggttagcgtacttcgtgaggttgctggtgaagcgcttgtggccgattggggaggaataaaccactgtgtcgaccagaattcgtcgtcggtcgccggattccgccacgcactgtgggtgggtctgggcgcccttcggatctcggtgagcatctcccgtagtgataccccacaattaccgctgtttggtactgctttcggataagagtttaggcatgaggatcggagattcgggagttccggccat

SEQ ID NO: 72678 - DNA, 433 bp, Zea mays
  unsure at all n locations
  Clone ID: LIB3078-013-Q1-K1-H9
ggcgtgtggaagaacacggaggacgagatcctcaaggcggccgtgatgaagtacggcaagagaccagtgggcgcgcatctcgtcgctgctcgtccgcaagtccgccaagcagtgcaaggcccgctggtatgagtggctcgatccgtccatcaagaagaccgagtggacaagggaggaggatgagaaattacttcatcttgctaaactcatgcctactcagtggaggacaattgcacctattgtaggtcgaacaccatctcagtgtcttgaacgttatgaaaagctgcttgacgccgcatgtgcaaaggatgaaaattatgaggctaatgatgatcctaggaagctgcggcctggcgagattgacccaaaccctgagtcaaagcccgcacgtnctgatcctgttgatatggatgaagatgaaaaagaaatgctt

SEQ ID NO: 72679 - DNA, 300 bp, Zea mays
  Clone ID: LIB3078-014-Q1-K1-A1
gagatggcacaagccatggcgtccatgaccggcctctcgcagggcgttctgcccagcaggcgcgccgccaacagggccaggacggccgccgtcgtcagggcgtccgccgaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttg

SEQ ID NO: 72680 - DNA, 425 bp, Zea mays
  Clone ID: LIB3078-014-Q1-K1-A10
cccacgcgtccgcccacgcgtccgggagtgggaagcggagctgaatcgccgactgaaggaggccgaggagatggaggagttggagcgcaccgccgagcagctgcaaagccaggccgccgccgaggcccccgaggagtcggaggaggagaagcgcgagcgtgtccgccgcgagctccagaaggtagcgaaggagcaagcggagaggagggagacggcgaagcaaatgtttgagttgggtcaaaaggcgtacgggaaaggaatgtatggacgatcaattgaattcttggaggctgcgctcactatcatacgtccctcctctctactcggtggcgagatccaaatttggcttgcaatggcatatgaagccaataggaggcacaaggattgcattgcattgtacaaagagttggagagtagccacccca

SEQ ID NO: 72681 - DNA, 422 bp, Zea mays
  Clone ID: LIB3078-014-Q1-K1-A12
cgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcataaaatacatcaagaatctcactgctgtgttggagccagagaaagcggatgagttcaaaaagggtgtcgagggtgcaaccaagtttctccttagcaagct

SEQ ID NO: 72682 - DNA, 375 bp, Zea mays
  unsure at all n locations
  Clone ID: LIB3078-014-Q1-K1-A2
cggacgcgtgggcgggccaaccggcgaccagagccacgtgtccaccagagtcatgggcacctacggatatgctgctccggaatatctcgcaacaggtcatctcacgccgaagagcgacgtctacagcttcggcgtcgtgctgctggagatgctgtcgggccgccgcgccatggacaagaaccgcccggccaccgagcacaacctcgtcgactgggcgcgcccctacctcagcagcaagcgccgcgtctcccgcatcctggacgaccgcctggccggccactacccgctgccggccgtccaaagggcggcagcgctggcgctgcagtgcctcttcgaggacttcaggaagaggccaaccatggaccangtcgtcgc

SEQ ID NO: 72683 - DNA, 336 bp, Zea mays
  Clone ID: LIB3078-014-Q1-K1-A3
cttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgtccacggcgccctcgctcacgctcaccggcaggaagaaggaggccgacaagctgcagacctccgacggctgggccaagttcaccgggggattcttcttcggcggcatctccggcgtgctctgggcctactttctcctctacgtgctcgacctcccctacttcttcaagtagaaatcatcaaagatgcgtatatatatagc

SEQ ID NO: 72684 - DNA, 346 bp, Zea mays
  Clone ID: LIB3078-014-Q1-K1-A4
cccacgcgtccggaaccagcttccagatctccaccaactgctggttgaggctgcgaagctcttgaacaccgaagctcctgacttgtacataaggcagaatcctgttccaaatgcctacaccttagcaatcaacggcaaaaaaccattcattgtcgttcacacaagccttgtggagctgcttactccaagggaattgcaggctgttttggctcatgagctgggtcacctcaagtgcgatcatggtgtttggctcacttttgccaatatactcacaatgggagcatacactgtccctggttttggcatggttgctggcttcctggaagagcagctatacagatggcta

SEQ ID NO: 72685 - DNA, 344 bp, Zea mays
  Clone ID: LIB3078-014-Q1-K1-A5
ggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaagaggtcgc

SEQ ID NO: 72686 - DNA, 433 bp, Zea mays
  unsure at all n locations
  Clone ID: LIB3078-013-Q1-K1-H12
cacgagccacagcccacaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgacgccgccgagatcttcaggatcgccgncaccatgaacggcctcgtgctcgtcggcgtcgccgtcgggttcgtgctgctccgggtggaggccgccgtcgaggagtccgagtaaggtgcgtgggcctgccact

SEQ ID NO: 72687 - DNA, 371 bp, Zea mays
  unsure at all n locations
  Clone ID: LIB3078-013-Q1-K1-F8
aacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttntgattgcaaggtcgctctgtgtcagttgttagtgct

SEQ ID NO: 72688 - DNA, 433 bp, Zea mays
  Clone ID: LIB3078-013-Q1-K1-F9
atgaaggaaactgctcaaacagaaaggcagttactaatggagaatgggaggcaagttgtgaacgaacagaaggttgataaattcctttacacaatgtttaagttgaactccacgatactcaggtactccagaatggcagctgtagttcttgtgagccttcctccaccgccattataccatccttcatatttctacatggagtacatggatttgcttgtagagaatgtcccacgcatgttaatagttaggggatatacgagagatgttgtcacatttttcacatgattatacatacgaacttctcacctggagactctagtgccgtcaggctgttgtactatctcagcagagactggatacacaagagcgtggaatctaccactgaaatgacaagccctcaccttgaaggcaaccacgatgagatgtcagatgt

SEQ ID NO: 72689 - DNA, 443 bp, Zea mays
  Clone ID: LIB3078-013-Q1-K1-G1
caagatacaccttccttaggttaactagccacctaattaccagctgccagccatcttctgtcagcacactgcagtgttcgctcgtttctgtcgggaagagagagaagaggcagcgacgatggatgagcctccgccacagagcgacgatgaccggaagctgtcggccatggagcacgtcaagaagcgccacgaggagaagggcttcctctatgcctgcgccttcatgttctgctgctgcttctgctgctacgaggcctgcgagcactgcctggagtgcttctgctgctgcagcaagaaggacgagtgattaaggccggtccaaccagttccgcccgcccaccaatgatgaatgatcggtttgtaattcgtcgtggatttgatttgtttcggttgtgaagaactgcgatcaatctggaactgttcgtcgtgatagaacatgcatg

SEQ ID NO: 72690 - DNA, 436 bp, Zea mays
  Clone ID: LIB3078-013-Q1-K1-G10
ccacgcgtccgcagagccccagctactgcagtgcccctgaagatttcatcgtcgacaactgcaagaacatctactttgctgggcatgaaactacagcggtcactgccacctggtgcctgatgctccttgctgcacacccagactggcaggaccgtgctcgggctgagattcgagaagtgtgctgtggacagacagcgatggacatcgacgtccttcgtcagctgaaaatacttacaatggtgatacaagagactctccggctgtaccctccagcatcactgatcatgcgtgaggccctgacaggcatcaggctcggtggagtcgacgtccctcgcggcaccatcatccaagtagccatttcattgctgcaccttgacatggaagcctggggtccagacgctaacgagtttcgtccagaccggttcgcgaacggagc

SEQ ID NO: 72691 - DNA, 266 bp, Zea mays
  Clone ID: LIB3078-013-Q1-K1-G11
acgcgtacgacaacacgtacatgcactacatgacgtacttccacagccactacacgtacctcgatctgcgcaacgatgtaaatagaaaaggcccgacgcaatgctatacaaactatccttaaacacttgacctggctattatgtactacccgtacgcgtcggacattctcgacacatcttcctcgatcaataactgggatgctcactactgcgccatctactacgacgacacatggctcaaagctgatttacagcactctatatgc

SEQ ID NO: 72692 - DNA, 434 bp, Zea mays
  Clone ID: LIB3078-013-Q1-K1-G12
ctcgtcctgacccctcgcaaaaccctagctccaaccaccatgaagggcaaggccaacgcctccaagaaggatgaggccaggctccgggccggcggcggcggcgccggaaagcgcaagaaggccgccgcgagcggcaagcccaagcgccctccctccgccttcttcgtcttcatgtctgaattcaggcaggagtaccaggcgcagcaccctggcaacaagagcgttgcggccgtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggccgtagtga

SEQ ID NO: 72693 - DNA, 406 bp, Zea mays
  Clone ID: LIB3078-013-Q1-K1-G2
cggacgcgtgggtggagttggtcagcagctgttttatggtcagccacctccagccttcatcaaccctcaggctggatttgctttccagcaacctatgatgcctggtatgaggcctggtggtccaatgccgaactttatgatgcctatggttcagcagggacagcaaccgcaacgtcctgctggtaggcgtgctgggtctggtggaatgcagcagcccatgccaatgggtagtcagcaacagatattccctagaggtggtcgtggctaccgctatgctactggacgtggaatgcctgatcctggcatgcataatgttggtgctgtgatgccatctccatatgagatgggagggatggcaatgagagatgctggtgtctcacaacctgttccaattggggcactagcc

SEQ ID NO: 72694 - DNA, 386 bp, Zea mays
  unsure at all n locations
  Clone ID: LIB3078-013-Q1-K1-G3
cccacgcgtccgctggggaggtcgtcgaggaggaggaggagctcgtgttcaggcccgaggaggtgaagcggatggagtacctncacgccgcgctctccgaggcgctccgcctctacccgtccgtccccgtcgaccacaaggaggtcgtggaggacgaggtgttcccggacgggacggtgctgaagaagggcaccaaggtgatctacgccatgtactccatggggcggatggagagcatctggggcgacgactgccgcgagtacaagccggagcggtggctccgggacggacgcttcgtgggcgagtccgcctacaagttcacggccttcaacggcggcccgcgcctgtgcctcggcaaggacttcgcctactaccagatgaagttc

SEQ ID NO: 72695 - DNA, 405 bp, Zea mays
  Clone ID: LIB3078-013-Q1-K1-G4
cccacgcgtccgcgatcaacgagtgagtagtagcaccatcaccatggcagacaagaggaaggtggaggtcaaagagacgaaggtggaggtgaagacggccgtctacaaggtgtacgtccactgcggccagtgcgcgcgcgacatccagacgcagttcaccgagttccaaggggttgaagaggtgaaagtggacgccggggccgggaaggtgacagtgaagggcttcggcttcgacgtcgagaagctgaggaagaaagtcgagaagggttgccggaagaaggtcgagctgattccgcccgcgcctcccaaggacgacatggtcgttgatgtcaagaccaaaaaggaggagctcaaggtcataactgtaaagctgccgttgcattgccccgattgtgcagtcagggt

SEQ ID NO: 72696 - DNA, 388 bp, Zea mays
  unsure at all n locations
  Clone ID: LIB3078-013-Q1-K1-G5
gcaattttgtgtttcccgttctggaacctggtcgcgttcttcgcaactccgtctaccacacccgcactgttcggaggcggtctgttgggatatgtgatgtatgattgcactcactactacctgcaccatgggcaaccatccaaagacccagcaaaacatctcaagaggtatcacctcaaccatcacttcagaatccaggacaagggcttcggcatcacctcatcgctttgggacgctgtctttgggacattgcctccatccatgacgtctgggaagaactgacgcacgtaactcaattcttggcatgagagattctaggggacctgtaatatatattcaagctagggataatcctggatctgtcttcgtgcgatgggtngacatgttc

SEQ ID NO: 72697 - DNA, 391 bp, Zea mays
  Clone ID: LIB3078-013-Q1-K1-G6
gggacgcgtagcatagagcaataccttacgagctgttacgataacgatgaacacagacctgacctaggtcggatacgcgttgacgaagaccgtggattacgggcatttgtcacgctacaacgcatcattgacatgctacgtggccttgctcttctctttgaactaggcatcatattaagggcatgagtgttcattgacgacatgatgacttaccaagctatgactgagataatacctagagaacatgatgctcttaggagtctgaatccgatcacagacaccctggtacgcgacagatgacggccgccactctggcatgggaacggtgcaggcatgccgaatggcatcatgcactgatgctgtatgcgagctatgggtgtgaacaatttgg

SEQ ID NO: 72698 - DNA, 405 bp, Zea mays
  Clone ID: LIB3078-013-Q1-K1-G7
cccacgcgtccggccatcgccccgatggacaccgccgcctcatgccgcctcctctcgccggcctcctcctctccgcccccctgtccgaagcagctacccaagcggcgaccgaccttcgcggcctcgcagcagcagtcgcccagctccagcgccaagttcaggctcctctgcctcctccatgacaagtccgcgtcgccaacgacgtcggtgcagatgcagagctcacagtcacagttgcagaggctggcgacggtgttgcagtgcggagccgtctgggcagctgttgaggcgccggcggcgctggcggtgaccggcgaggaggacatcgacctgctagggatcctgccgccgctcgcggtgttcgcctttctctacttcctcgtcgctcctccggtgatcatgaac

SEQ ID NO: 72699 - DNA, 404 bp, Zea mays
  Clone ID: LIB3078-013-Q1-K1-G8
tgatcaatgatgaggctgcaatacctgaagtgattgagactgtcaaacagcaagttaaggatgctaaatttcctgatctagaggtcattcgcatgttgtgggatgtgctcatggaggctgttcagtggtctgggaagaaccagcaacagaattctaatgcagcacttcggcaggtgaaagcatgggctgagcttttgaatgctttttgcacgagtggcagactcgaactggaacttatatacaaagtacagacacagtgctatgaggatgctaagctgatgaagctgtttcctgaaatcataagaacactgtatgaccaagatgtcctagctgaagatactgtcctgctttggttccgtaaaggttcaaaccagaagggcaggcaatctttcgtgaaagctctg

SEQ ID NO: 72700 - DNA, 432 bp, Zea mays
  Clone ID: LIB3078-013-Q1-K1-G9
cggacgcgtgggcgctgccgtccacgtcctcggcctcgtcgacgacaaccgtgagctccagggcgtcctccggcgcgccgccgaccaaccgcctggactggatgctgttctgacgggcgggcgagtgcagggcagcccggcgccggccggccaccggcgcgaaagcagtcaagccggatgtgggggaaagcggaaggcggagtgcagaactgcagatgcgatgcttgtgtgccaagaattgcaccccctgcagaaatctggtggcctccatgattgggcacgggctacctagcttggccacaaactgcattgctctgcatggtaccgtaccagccaactcgattcatcaaccatgtcttcttctttcattccttttgagattctttcctttttcctcatcttcttgttcatgaaacgtttgaggttcttttt

SEQ ID NO: 72701 - DNA, 448 bp, Zea mays
  Clone ID: LIB3078-013-Q1-K1-H1
gaaatatgctcacacacatttcccttcagtcaagtacatggaatacgctgttcaggttgagacctacaccttgtcaaaagccaacaatttggttatgaatgtcgatggtgcgatcgggtcccttttcttggatcttctatctggaagtggaatgttcaccaaacaggagatcgatgagattgtggagatcggttatctcaatgggctctttgtgcttgcacgatcaattggcctgatcgggcataccttcgaccagaagaggctcaagcagccactctaccgtcacccatgggaggatgtactttacaccaagtgagaaagccattctttgcaaggcataataaagtattattatcgcctagagcttccagttgcctgtacacttcattaaatcgagcacttgcaaaaaagaaagccagagagagaggaagacgaacatcactagtca

SEQ ID NO: 72702 - DNA, 415 bp, Zea mays
  unsure at all n locations
  Clone ID: LIB3078-013-Q1-K1-F7
cccacgcgtccgcggacgcgtgggctcggagggcgggctggactacctggggaaccgcaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtnccccgcaactaactgact

SEQ ID NO: 72703 - DNA, 433 bp, Zea mays
  unsure at all n locations
  Clone ID: LIB3078-013-Q1-K1-E12
agaaggcaacgtaccaggtggtgcagcccatcaacggcgaccccttcatcggcagcctggagacgccggtcacctcgagcccgctcgtggcgtggtacctctccaacctcccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgtccacggcgccctcgctcacgctcaccggcaggaagaaggaggccgacaagctgcagaccgncgacggctgggccaagttcaccggggggttcttcttcggcggcat

SEQ ID NO: 72704 - DNA, 414 bp, Zea mays
  Clone ID: LIB3078-013-Q1-K1-E3
cccacgcgtccgcccacgcgtccgcccacgcgtccgctacacacatacatagtttcttgtactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacg

SEQ ID NO: 72705 - DNA, 245 bp, Zea mays
  Clone ID: LIB3078-013-Q1-K1-E4
cgacgacaaggacatcggctactactagctgctgcacctgtgcttgcacatcgctgctggcgagttgggcagtcgtcgtacgtgggaaacatggcttttggtgtaagaagaaggaatggaagtggtctgttgtacttaaagaaactagatgaagaagtcttgtataactgaaacttcacccctctcttgtgtatgatgtattcaccttcgtcttgaaaattcttgagaacggtttcatcttgcat

SEQ ID NO: 72706 - DNA, 438 bp, Zea mays
  unsure at all n locations
  Clone ID: LIB3078-013-Q1-K1-E5
gagcggaggcgtgcgtgctgcggcctgcggcctgcaggaccagagatcggggactgagctagggtctgggactgggaggcggagatgtcgacgccggcgaggaagcgcctgatgcgggacttcaagcggttgcagcaggacccgcccgccggcatcagcggcgcgccgcacgacaacaacatcatgctctggaacgccgtcatattcgggccggatgacacgccgtgggacggaggcacgttcaagctgactctgcaatttacagaagattaccccaacaaacctccgactgttcggtttgtttcgaggatgtttcacccaaacatttatgcggatggaagcatntgtttggacatcctacanaaccagtggagtcctatatacgatgttgcggcaatattgacctctattcagtccctgctgtgtgacccaaaccca

SEQ ID NO: 72707 - DNA, 395 bp, Zea mays
  Clone ID: LIB3078-013-Q1-K1-E6
gcgtcgccggcgccggcacacctcaccatctgctcctcgcccgcagcgtggcggcgtgcgccgacggcggcggcggtgcgcgcggtgcggaactacgactccatcccgaagcgggagcccttcagctccagccgcagcatcctccacgagttcctcaggcaggacaagcccctcatccagcgcaccaaggaccagatcacagattattgcacggccatcgaaggcgatgagtgctgcagctgttgggacgcttactttgaactgaataaacttgagcaagagctgcccaaagacgaaatcgcaaggatggtgaaggactcggagggtgacgtgaggtacctgatagagagcatccaccatcgctcggatctgcggaagaggtggcagagaagtct

SEQ ID NO: 72708 - DNA, 360 bp, Zea mays
  Clone ID: LIB3078-013-Q1-K1-E7
cccacgcgtccgggtagctgaagcagaatctgttgtcctggaaagccttagcagccatgtccgcactgtagttgcaactctggggggcaagcaaggagcagctagcagattcgacaagtggcagtaccttcactctgggttcacggtttggctatcggtgtccgacgcaagtgacgaggctagtgcgagagaggaagcccgaaggagcgtgagcagtggaagcgtttcttacgcgaaggcggacgtggtggtgaagctcggcggatgggacccggagtacacgcgggctgttgcgcagggctgcctcgtcgcactcaagcagctcaccttagcagacaagaagctagcagggaagaagag

SEQ ID NO: 72709 - DNA, 391 bp, Zea mays
  Clone ID: LIB3078-013-Q1-K1-E8
acctttttgatggctacgctcacctttcgtccgggcttgcctgtggccttgctgggcttgcagctggcatggccatcggcattgttggtgatgctggagtcagggcgaatgcacaacagccgaagctttttgtgggcatgatcctcatcctcattttcgcagaagcgcttgctctgtacggtctcattgttggaattatcctttcatcccgtgctggtcaatcccgagcagattaagtgcactaccattctgcgattaccgtactgtttattatgctattctaagagaattgaaactctatgcccttgtctagtttattcttgttaccatgtattaatgaaacaatttgtagctgaaggaaggtgacacttccagccatgttggttttggc

SEQ ID NO: 72710 - DNA, 436 bp, Zea mays
  Clone ID: LIB3078-013-Q1-K1-E9
cccacgcgtccgaacgcctccatcaccaacgccaactccgccattgagatcagaaacttcctcggggagaagaaggtcaggaaggttgatatgcttgaaggtgtgaccatcttgcgttcagagaaggtcaaggatgagcttgttcttgaaggcaatgatgttgagcttgtctctcgctccgctgctctcataaaccagaaatgccatgtcaagaagaaggatatccggaagttcttggacggtatctatgtgagtgacaagggccccatctttgatgagcaatgagctgccctttgttcctggctagcaaaagccgtgttaggctgtggccagtagactgtttgcgtagtggatgtagttggaaataggagatgggatgagtaaggttgctggagataagagctttagcaagaatttatgagatggacctttattt

SEQ ID NO: 72711 - DNA, 280 bp, Zea mays
  Clone ID: LIB3078-013-Q1-K1-F10
gtagaacatgcgcacggcgcacctctatcaagcgacagctatcgacactcatgacttatgggtttacgaaaagcactatatgtgcaatgaacgccagctcgcgctcagaccgaacagcgaagagcagcttggctgcatgtggaacgggtgagcatgcagatactgctacaaagatcatcactagatatctagagacgcacagagagacgacgaagaaaccgcatagcgagatgaatttctaccaactgtacctctgaaaacattgcccattagagcacct

SEQ ID NO: 72712 - DNA, 433 bp, Zea mays
  Clone ID: LIB3078-013-Q1-K1-F11
ctcttcctctctgctttccccttccaatggaatcctgtagcttccgtgccgcaaccgcgcgttctccgtttccctccgctccttcttcatcttcatccccgcgcgccccatgccccatactccgatttcccaggccaagaaaagggaggcagattggggtgcggaggagggcgtccggatttgatgccttcgcgtctttcgccggcaaggtcttcgtggatgaggcgattggagcggaatatggggagggcttcgaaacatttcgaatggatggaccactcaaggttgatgtggattatctgaatgaaaaattgcaagagtgcttccttcaaaggataaggcatgctatgaagccggatgaggcgtttggtctaattttttcgtgggacaatgttattgctgatacagactcgctaaagttgaatgcttggag

SEQ ID NO: 72713 - DNA, 439 bp, Zea mays
  Clone ID: LIB3078-013-Q1-K1-F12
ctctcctcccctccccatctcgctcttgcggagatcgaagagaagctgaggcctagcgccgcacccgccgccgcatcagccatcagccatggcgatggccgctcgcctcgtctcgcgctcccgtcagctacattcggttcaagcagcttttgcgaatggaggtgccactcaagttcgctcctttgccaaggatgcagctccagctgaccgtcctcctgttggtggggatgatctcctgaagggcatattctttgaggtaaagaagaagtttgagacagctctcggcgtccttaaaaaggaaaagatcactattgatccagatgacccagcggcagtttctcaatatgctcaagtcatgaagactgtaagggaaaaggcggatcttctttctgattctcaaaggattaaatataccattgagaccttcaccaagggcatc

SEQ ID NO: 72714 - DNA, 401 bp, Zea mays
  Clone ID: LIB3078-013-Q1-K1-F2
ggctgttcctgggcgtcccgaccagcgacaccctgctgtacaaggaggagctggagaagatgaaggagatggcgccggacaacttccggctggacttcgcggtgagccgggagcagacgaacgcggccggggagaagatgtacatccagacgcgcatggcggagtacaaggaggagctgtgggagctgctcaagaaggacaacacctacgtctacatgtgcgggcttaagggcatggagaagggcatcgacgacatcatgctcgacctcgcagccaaggacgggatcaactggttggactacaagaagcagctcaagaagagcgagcaatggaacgtcgaagtctactgatgatgatccttcattgtattgttcagctcaagcaatctggtggtgatgagt

SEQ ID NO: 72715 - DNA, 428 bp, Zea mays
  Clone ID: LIB3078-013-Q1-K1-F3
cggacgcgtgggaaaaatgcccaactattcaagtgcgaccctgctggtcacttctttggacataaggcaactagtgccgggctcaaggagcaggaagcaataaattttctggagaagaaaatgaaggatgacccgaaattcacctatgacgaaactgtgcagattgcaatatctgcgttgcaatcagttctccaggaagatttcaaggccactgagatcgaagttggtgttgtgagaaaagatgaccgcgttttcagagctctcacgacagaggagatcgatcagcacctgacggcaattagtgaacgtgactgagatgtcatatgctgcacatttcagcgctgcacacactgcgccgtgccattgtgcttcggcagtcattaagtttcatagtcatcaaaggaactgagtgtaccatttcacgttta

SEQ ID NO: 72716 - DNA, 394 bp, Zea mays
  Clone ID: LIB3078-013-Q1-K1-F4
caattccagtcgcccccatccgttcctcatctcaccagaagcgaagccggaggagggaggaaggagatcgcgagcagccggagccggaggccgagaggatgaagacgttcgacccgtggccggtcttcttccgccgggagtggaagcgcaactggccctttctcacggggttcgccatcaccggcttcatcatcaccaagatgacggccaacttcaccgaggaagacctcaagaactccaagttcgtccaggaacacaagaagcgctgaccaaccgggtggagtcgtccgaatcgcctgcggatgaaaaattagccccctatttttcttgtcttttttttatctagatgcgtgcactctattgtaataatgtaataagaggcaattggattgat

SEQ ID NO: 72717 - DNA, 333 bp, Zea mays
  Clone ID: LIB3078-013-Q1-K1-F5
cccacgcgtccgcacagcattcttcccatggtcagacgccacatcaatccatgcagcataggacgcagcagtcattgcagagtcggaggccacaacaaatgacacagggtcagaagccacaacagtctttgcagagtcaaaggactcaacagtccttgcagaatcgaaggccacagcagtcctcacatattcagaaatcgcaatcctcacaagcacacagaccacagtcattaagtaacaggtctcaggctttacaaggacaaaggcctctttcttcacagggtcaatatccggagcaaagaagagtacatgcaagtgacagagtcaaacaag

SEQ ID NO: 72718 - DNA, 445 bp, Zea mays
  Clone ID: LIB3078-013-Q1-K1-F6
cggacgcgtggggtcgatgccgtcgaccccgacgacgccggtgacgccgtcgtcgtggtcgtcgtcgacgacgccgcgcggcgccggcaacgtgtggcgcagcgtcttccacccggggagcaacctggccaccaagggcatgggcgccaacctcttcgaccggccgcagcccaactcccccaccgtctacgactggctctacagcgacgagaccaggagcaaccaccgctagatcgggcgagatggatggacagtgaagaggccatgtttgctggtccttgtggttatctaaaacgcacgcatgctctattatagctagtcatcactatatatatacttgtgtttgtgtattggtgttcttgttctgctggtgtctccgccgtttaatttgacctatgttatggagtgagtgatatatgtgccgtcactcctagtatatagtagt

SEQ ID NO: 72719 - DNA, 427 bp, Zea mays
  Clone ID: LIB3078-013-Q1-K1-E11
tcggaagcagccaacgtgttcggcaagcccaaggcgagcaccgagtacatcgtgtacagcggtgacggcttaaagctgctgatcccgtccaagtggaaccccagcaaggagcggaagttccccggacaggtgctacagtacaaggacaacttgaacgccaacagtaacgagtacgacatgatccagccgacgtccaagaagaccatcgtcgactacagctctaccgaggagttcctctaccaagtcgactacctgcttggcaggcaagcctacagcggtaagaccgactactaaggcggattcgagaccggagccgtggacaccgacaacgatctgcatagctccaatctcgtgatcgatggcgctcaatgctacgccgggtccgagctgaccatgacagttgactgctacgagagctgtaagcacc

SEQ ID NO: 72720 - DNA, 413 bp, Zea mays
  Clone ID: LIB3078-016-Q1-K1-C11
ctccctcctcagctacgacgacctccgcgcctacctcgagtcgcaggagacggcggccggggcagacggtcagcgcggcgtggcgctcctgagcgagaccatgtccacacccgtgctggtggccacagcagaccagaccctggaggacgtcgagtgccacttcgaggccgtgtcggggcttccggtcgtcgacagcggcctcagatgcgtcggggtgatcgtcaagaacgaccgggcaagagcctctcatgggtccaagacgaagatatcggaagtgatgacatcttcagctatcacactatcgtctgacaaaaccgtgatggatgctgctgttctcatgctcaagaagaagatccacagattaccagttgtaaaccaggacgaaaaagtaataggtatagttacccgcgctg

SEQ ID NO: 72721 - DNA, 403 bp, Zea mays
  Clone ID: LIB3078-016-Q1-K1-C12
gaattttaccactgataaattgaggtccctagtgaagaagtggcagacattaatcgaaggccatgttgatgtcaagacaaccgacaactacatgttgcgtttgttctgcatcggcttcaccaagaggcgcccaaaccaggtcaagagaacctgctatgctcaggcatcccagatccgtcagatccgccgtaagatggttgagattatgatcaaccaggcttctacatgtgacctgaaagaacttgtttcgaaggtcattccagaagttattggtaaggagattgagaagtctacctccagcatcttcccacttcaaaacgtcttcattcgcaaggtgaagatactcaaggcccccaagttcgatcttgggaagctcatggaggttcacggcgactacaaagag

SEQ ID NO: 72722 - DNA, 430 bp, Zea mays
  Clone ID: LIB3078-016-Q1-K1-C3
gagattgtgaaggaagtctcttcctacctgaagaaggttggatacaaccctgataagatgcacttcgttccaatctctggttttgaaggtgacaacatgattgagaggtccaccaaccttgactggtacaagggcccaaccctacttgaggctctggacttgatcaatgagccaaagaggccttcagacaagcccctgcgtctcccccttcaggatgtgtacaagattggtggtattggaactgtccctgttggacgtgttgagactggtgtcattaagcctggtatggttgttacttttgggcctactggtcttactactgaggttaagtccgttgagatgcaccatgaggctctccaggaggcccttcccggtgacaatgttggcttcaacgtgaagaatgttgctgtgaaggatctgaagcgtgggt

SEQ ID NO: 72723 - DNA, 418 bp, Zea mays
  Clone ID: LIB3078-016-Q1-K1-C4
cgctcaggtgcgtgtgcccggagctgctcgcccacagcggggtcaaggtctgcgaggccgggtggtgcaaggccgtgtcccagatcttcagcgagggcgggcttgactacctcggctacccgagcctgatccacgcgcaaagcattctgggcatttgggcgtgccaagtggcgctcatgggcgccggatacgggtaccgcatcgccggtggcccgatcgtagaggcggtcgacccgctgtaccgcggcagcggctcttacccgctcgggcttgacgacgacccggatgcgtccgcggagctcaaggtcatggagatcaagatcggacgcctaaccatgttctgcatgtgaggctgcttcgtgcatgccatcaacatcggcaagggtcccgttgagaacctcgtccaccaccttgctga

SEQ ID NO: 72724 - DNA, 425 bp, Zea mays
  Clone ID: LIB3078-016-Q1-K1-C5
cggacgcgtgggcggggtcatcctgttcgacatcgggttagcccacaagagcctgtcgaggtcgctcttcgaggacccgccggactgcaagccgtcggcctccggcgggatgagcgccgcctccgccgccaggagggagggcacgcaaggtgttactggactacggttgaggcgagagatggcagcagcaggcagcgaccagagtcaggagcagaggtgaggaggaggaggaggagctctgagacgacaacacccgagacaatggcgagccagttttccgctttataaaatcctgcggtgagtgagtgagtgagtgagtgagagagagagagagagagagagtgccgtcgccgccgcaacaagaaatacaacagctgcagcttcctgcagaggttggaatgtatctactaagatgtgggtacctt

SEQ ID NO: 72725 - DNA, 421 bp, Zea mays
  Clone ID: LIB3078-016-Q1-K1-C6
cttgaccatgaggataagtttgactttgacccgctcgatgtcaccaagaccgggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgcccaccacaataaccaccatgatgggttcatgaacttcatgcacagggacgaagaggtgaactacttcccttcgaggtttgatcccgcccgtcacgctgagaacgtccccattccttcccgtgttctaacaggct

SEQ ID NO: 72726 - DNA, 251 bp, Zea mays
  Clone ID: LIB3078-016-Q1-K1-C7
atcaaacattcttataagcttgagaatgttcatttcaatatcacataaatggggtctggggacattatctggttgtgaatgtgactacatgatttacaggtccagaaccattaaatcttacaaggtcacaacgataatatagactcttgactatatcaatagccaatgaagcctttatacaaacactagatgtatcatataagaatattacaatatacttatacttagaactactccttttgtacaaatta

SEQ ID NO: 72727 - DNA, 319 bp, Zea mays
  Clone ID: LIB3078-016-Q1-K1-C8
cccacgcgtccggtctggccaccgatgccgccgccggtctggccgcccccgtggggcacggtgcaacgtcgtcaccgaggagagcccgtgctccgtcatgtgacgctacgcgcttgctttgtcatgtactcgtcgctgttggcctgttgctgtgctgccatcggtactggacctcggtgctacttgggccggtgccatcctgtgtagtgaaggtacagtgcatcgtctgcagatgtgcttgcctcctacagtctcttatacgaacgtgtcacgccttgttttattgcagtaattgtgtagcttccagctataatttgct

SEQ ID NO: 72728 - DNA, 400 bp, Zea mays
  Clone ID: LIB3078-016-Q1-K1-C9
agcctcttcaacgagctgctgtccgagtacgcgctctccggcggcaagcggggcgaccggaactctgaagacttcgtgcacctcttgctgtcgctgcagaaagactacggtctcaccacggataacatcaagggcatacttgtgaacatgttcgaagcagccatcgagacatcattcctggtgctggagtactccatgagcgagctgatgaacaaccggcacgtcctggccaagctccagaaggaggtgaggacggcgacgcccgacagccgcatggtgatggaggaggacctgagccggatgccatacctgaaggccaccatcaaggagtccatgcgcattcacccgccggcgccgttcctactgccggacttctccacccacgactgcgagatcaacg

SEQ ID NO: 72729 - DNA, 403 bp, Zea mays
  Clone ID: LIB3078-016-Q1-K1-D10
tcgtctccgtctcccggctcttcggcgtctagctcgtcaacgcgcgcgtccgccgtcgggtcctccgacgggcgtcccaccgcaggggaatacagatcgtcgatccgctgggcttgcaaacatgtatatccgagtgaagcgcaacaagagtacctacttcattcaatgtgaaccaacagagacagctttgagcatcaaacagaagttgcactcgctgatagatcaacctcctagtagtcagcagttggtcttgtggcctagcagtgatgtgcttgaagactcaaagactttggcagatcaaaaggtggataacgattccattgttgcattggcactaagaaaagatgacggtgagtttgaggaagttttcatcgctaggccggaggatttcatgtcatcatca

SEQ ID NO: 72730 - DNA, 412 bp, Zea mays
  Clone ID: LIB3078-016-Q1-K1-D11
gtagaacacgacggtgtccggcgtccgtagaaaaggaggagaggaggccagggaggcgggggcagcaagaatggcgtgctccaccggtctctgcttcttggcgtcgattcctcctctctcagcctcttgttcttctggctcctcctgcttcctcatgatcaagcgtgtgtcctctgctccgtccttgtccagatggacgatccaatacaagcaattgggacatacaatatatcggagaagccacgttctggcctttgctagtgcagatgcaccacaaggcaaaagaagctcacgtgagaatgttgtgatggttgatccactggaagctaagcgcctagctgctaaacaaatgcaagaaattatggccaaagaaaagctgaagaggcgccgtcaagcagaagcgatcaacggg

SEQ ID NO: 72731 - DNA, 405 bp, Zea mays
  Clone ID: LIB3078-016-Q1-K1-D12
gccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctactcacccccgtcgtcggcacctaccaatacgccatgtggtacaaagagcacgagaagctttcccacagatactaaatgggatgtcctccaagttgctgcggcttgtcgcagttgaattttccatgatgggttgtataatctgtcaatgtcatttctttgctcagtttaagttcaacccatttt

SEQ ID NO: 72732 - DNA, 220 bp, Zea mays
  Clone ID: LIB3078-016-Q1-K1-D2
cggactcgtgggcggactcgtgtgtagactcgtgctttgatccacgcttcaccaaaccgggctactgattcatgctcaataccttcgtgacccttctaaacgaatagtacaagatcaatattatcatgaagataatgctaaccatattccaatcactcatcttctcactcatacataacaacctcctgaatatgtacaacaccatgaactatttcaaaca

SEQ ID NO: 72733 - DNA, 425 bp, Zea mays
  unsure at all n locations
  Clone ID: LIB3078-016-Q1-K1-D3
ggcagaccatccgctctggtggcgaggagctcggtcgctggatgctgcgttccgaggagagtcgagttcatcgattgggttggtgcgaattcgttcaggggtgtctatagaggaaagaaggtttgggtcaacaaattgaggggctgtgacatgggaagtgcttacgaagttgagattcgtcaggacttgctgcagttgatgagttgtggccagaggaacatcctgcaattccatggcatctgtttcaatggaaaccatgggctctgcatagtaaccaggatgatggaagggggatcagttcatgatattcttacgcagagaaacaagaggctgtccctccgggacacggtcaggatcgctcttgatgtcgccgacactctggctntcatgaacagctacggcattgcgtaccgcgatctcaatgc

SEQ ID NO: 72734 - DNA, 417 bp, Zea mays
  Clone ID: LIB3078-016-Q1-K1-D4
gcagaggccgggcaccccgctctacaacatcaaggcttacctccctgtcatcgagtcctgtgggttctccagccagctgagggctgcaacctctggtcaggcgttcccccaggctgtctttgaccattgggacatgatgggctctgatcctttggaggctggctcccaggctgctcagctggtgctggatatccgcaagaggaagggtctcaaggaacagatgatcccactttctgagtttgaggacaagctctaaatttgtggttgttggtgacactgttacagctgccggttcaatcgtcaattggttttactgtaaatgcagtgtgtgctgctgtgctgacagtctgatgctctattttaatactccctccgtttcgttttagatgtcgctggatagtgcaaaattgaaccatc

SEQ ID NO: 72735 - DNA, 373 bp, Zea mays
  Clone ID: LIB3078-016-Q1-K1-C10
cccacgcgtccgcccacgcgtccgcggacgcgtgggactggagctgctgaagaagaacggagacatgacctttggcgagggagcaggggccgtcttatcccgttggaaaaccacgtgatgtttggagtaactcaacttgcaatattaggatagatagataagggccctatcctacacgtgtctactgaggttatacatgcttaaaaaacggttaagcttaccatcatgattgaggaccctagagatatagaaagaaagagaacactcgggatagaggatcctgatgaaattactagggatgatttagctgacgctttggctgaggttaacgaaagaaagattccagagaatcgtgttgcacttcagttgcttg

SEQ ID NO: 72736 - DNA, 419 bp, Zea mays
  Clone ID: LIB3078-016-Q1-K1-A7
caagatagacaaggagggagctaatgcagaacgagttatgcaagaactttgccaaattgggataatgccagaaatgtggggtggtgataccccaatgatcgagataagtgctcttactggggataatgttgatgaacttctggaaactgtcatgcttgttgcagagttgcaagaattaaaggcaaatccacataggaatgcgaagggcactgttattgaagcatgccttgacaaggccaaagggcctcttgctaccttagttgttcagaatggaaccctaaacaaagctgatattattgtgtgtggtgaagcttatggaaagatccgtgcattgtatgatgactgtgggaagctcgttgacaaagcaggaccatccaatgcagtgcaggttattggcctcaataacgttccccttgccg

SEQ ID NO: 72737 - DNA, 417 bp, Zea mays
  Clone ID: LIB3078-016-Q1-K1-A8
ggagatcgggcgcgtggccctggtgaactacggcaaagactatggccgcctggtcgtcatggtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgtccagaagaggagggctgcgctcagtgactttgacaggttcaaggtcatgctggcaaggatcaagaggggtggtgctatcaggcaagagctcgccaagctgaagaaggcgtccacggcttaagtcccttttggtggatggcatgttagtttttg

SEQ ID NO: 72738 - DNA, 409 bp, Zea mays
  Clone ID: LIB3078-016-Q1-K1-A9
ctccagcgcctccaccttcctcgccgcctcactccctctgaggtcgcagatccgtccgggtagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagcgttgaggatctaatcctctccgtgggatctggtggtggcgctgctccagttgctgcttccgccccagctgggggtgctgcagctgctgctgcccctgctgcagaggagaagaaggaagagcccaaggaggagtctgatgacgacatgggctttagcctgttcgact

SEQ ID NO: 72739 - DNA, 428 bp, Zea mays
  Clone ID: LIB3078-016-Q1-K1-B1
cccacgcgtccgcggacgcgtgggcggactcgtgggtgctggcaagcccaagccagcgggggccggcggcccctggtacggggccgaccgcgttctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgcccgcaacggcgtcaagttcggcgaggccgtgtggatcaaggccgggtcccagatcttcagcgagggcgggcttgactacctcggcaacccgagcctgatccacgcgcatagcatcctggccatctgggcgtgccaggtggtgc

SEQ ID NO: 72740 - DNA, 404 bp, Zea mays
  Clone ID: LIB3078-016-Q1-K1-B10
cccacgcgtccgcggacgcgtgggcggagagcaaaggcagcacactcagctatccagcagaagagatcgagacgcaggagtcatggccaccgtcagcgccgccgtggtgaccaccatcgttgcccgcgccgcgatcgccaggcccaatgctctagggctgcctgcgctgagggcgaggagcgagagggtgcggtgcagctacgccaaggacgcggccccagtcagcaccaagggcgcaagcgcgtcgctgctcgccgcagcgggcgcggtgaccgcgtcggcggtgcccgcgctggcgctcgtggacgagcgcatgtccacggagggcaccgggctgagcctcgggctcagcaacaacctgctggggtggatcctcctgggggtcttcggcctcatctggtccc

SEQ ID NO: 72741 - DNA, 413 bp, Zea mays
  unsure at all n locations
  Clone ID: LIB3078-016-Q1-K1-B11
gcaaaggcagcacactcagctatccagcaaaagagatcgagacgcaggagtcatggccggcgtcagcgccgccgtggtgaccaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctntgacctcgacg

SEQ ID NO: 72742 - DNA, 222 bp, Zea mays
  Clone ID: LIB3078-016-Q1-K1-B12
cccacgcgtccgttgaaattcaaatgattgtaattagttcaatgagaaaaattactagcgaaaaaaaaaaaaaaaaaaaaaaaaaaaaaaaaaaaaaaaaaaaaaaaaaaaacaaaaaaaaaaaaaaaaaaaaaaaataaaaaaaaaaaaaaaaaaaagaaataataaaaaataaaaaaaaaaacataaaaagaaaaggataaaaaagaaaaatgaaagagg

SEQ ID NO: 72743 - DNA, 426 bp, Zea mays
  Clone ID: LIB3078-016-Q1-K1-B2
atctccgtggacatgaaggaaggggtattggtctgggccacaagcttcgtgcttataactgacaggatgatgggcgtgatactgtggaagctaatgaggaacttggtcttcctgtggactcacgggaatacgggattggcgcacagatattgcgggatctaggagtccgttcaatgaagctgatgactaataaccctgcgaaatatagtggtctcaagggctatggattgagcattgcgggcagggtgcccttgattacgccaattaccagtgagaaccgtaggtacctggagactaaaagaacaaagatgggacatgtatatgggttggccaatgcgcaggccaacctagcaaatggcagccagagcacagaagagaatcattaggcccccaagcatgtttccattattattccagcaatccagc

SEQ ID NO: 72744 - DNA, 430 bp, Zea mays
  Clone ID: LIB3078-016-Q1-K1-B3
cccacgcgtccgcccacgcgtccgcccacgcgtccgggcgagttcgtcaccccgggcctgctcttccgctacatcgccgggtggatcgggtgggtcggcaggagctacctcatcgccatcagcggcgagaagaagcccgccatgagggagatcatcatcgacgtcgagctcgccacccgcctcctccccagggggttcatctggcccgtcgcggcctaccgcgagctcatcaacggagacctcgtcgtcgacgacaaggacatcggctactactagctgctgcacctgtgcttgcacatcgctgctggcgagttgggcagtcgtcgtacgtgggaaacatggcttttggtgtaggaggaaggaatggaagtggtctgttgtacttaaagaaactagatgaagaagtcttgtataactgaaacttcacccc

SEQ ID NO: 72745 - DNA, 306 bp, Zea mays
  Clone ID: LIB3078-016-Q1-K1-B4
ggcctgctggtggacaaggaggcccccgccctggtcctggtgctgctgctacagctccaggtccagcaccggttgctgctcgcccataggctttagcttttcgaccgtgttaagtcttctgcccactcagtttcggagttgtcccctgtgcgtgtgtgaagctgctatattagagttactttttgtctaaagtctgaacattttcgaagaatttgaatatctgaacatttgaatgtttgtgctgagtttttcaaagaatttgaatatctgaacaattgaatatctcacttgaacgttatatggctt

SEQ ID NO: 72746 - DNA, 418 bp, Zea mays
  unsure at all n locations
  Clone ID: LIB3078-016-Q1-K1-B5
cccacgcgtccgttttttttttgcaaaaatcatactagtctggcataatagggaaaaagagggccagcggcttacaagctcaccatccaaaggaaccaaaagcgtccaagaagagtctccacccaagagaaaaacctgttcctctagtctaatgggcttcactaagaaagatcagaacagagagtagcagtgctcctccatcacaattgacacagcgcagctcacttggacgtcctcttcttctggtactgctccctgacccacttgatgcccgagctcgtcccggtcttgagcttgtgcgctccgaccagcgccgncgncttggccttgacgagtccctacgacgccgacgccttcacgttgccggccaccgtcctcttaccggccgccttgccgttcgcgctgctcccgtcgccct

SEQ ID NO: 72747 - DNA, 356 bp, Zea mays
  Clone ID: LIB3078-016-Q1-K1-B6
tgggcaagcttccgaagcacgcgtgcttctccccctcgacggtcgcaccgtcgtggaccgcggagggcgcggctccgcccgtcgtgacccggatgatcaccatgctgtggccgtcggtgctgtccgtcagcacgtcggcgtgcatcgagtgcagctccgcgccgtcgaactacgaccccgcaatcggccctggcgacttgcacttcgtcgcaacaacgacgctcacggtagagggctagaacaagccgaacgtgcccgggaagattgtcggcatagcctacgtcccgctgtcgccgtggaccctcactctcatgcagaaggctgtgcgcagaccgatgcatagctaaaacggacac

SEQ ID NO: 72748 - DNA, 421 bp, Zea mays
  Clone ID: LIB3078-016-Q1-K1-B7
ggcgggtggcattgcctcgcagttgacgacaaggggcgcgcctacgcctggggtggaaaggagtacgggcagtgtggtgaggagcctgagaggaaggaggacgggacgagggcgctcaggagggacatcccgatcccgcagcggtgcgcgctcaagctcaaagtccggcaagtagccgctggagggacacattcagtagttttgactcaagaaggtcacgtctggacatggggacagccatggcctccgggtgatatcaagcaaatatctacacctgtacgtgtgcaaggccttgagaaagtgagggtcattgctgtaggtgcattccataatttggcactaacggaggatgtaattttgtgggcatggggtaataatgagtatggtcagctggggactggagatacccaaccaagatcac

SEQ ID NO: 72749 - DNA, 413 bp, Zea mays
  Clone ID: LIB3078-016-Q1-K1-B9
cccacgcgtccgcccacgcgtccggcggcgccggcgtgcttgtgatctgaacccaagtggggcctccgctccggtcacccgtcgctccacgcaaccatgtcgaggaggaagaccagggagcccaaggaggagaacgtcacccttggacccactgtccgtgaaggagagtatgtctttggtgttgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagatgtcgcacagcgcttcaaggagcttggcattactgcactgcacattaagcttcgtgccaccggaagcaacaagaccaagac

SEQ ID NO: 72750 - DNA, 327 bp, Zea mays
  Clone ID: LIB3078-016-Q1-K1-C1
acgcacattcttcgtctgcataatccacgtactcatgaacaacacgtactatcctcatattggcgttaagggactatcttcaaggacgcaaggcaaactgaatcctacaagctccggacgcattagctcctaattcacattcaggatccagggcactctacgtgtaacttcactacgcatgatgcaacagatactggcaataattctcgaccattgacatcagcagatgtcatttggacgaggatgcactcatagactactactcctctgactattacttgcaaagcttaccctgtataaactcctgtgaagatcaagtaagttact

SEQ ID NO: 72751 - DNA, 419 bp, Zea mays
  Clone ID: LIB3078-016-Q1-K1-A6
gggagctctgcatcctgatccaccacccccatgcctgccttgctgcatccggcgtcctcggtccatgagatctgaggctcatgtagccgatgagtccttttttttttctttctcttcctgctgtttctccaagattcaagttggctggccgtgcttatccgtgcaggagctgaagcaggtttctgccctgttggtggtgatggtatctatcggtacccgtactttgcgtcgctttattcccatctttgctggtgaggtgctatgtcagcgttgtcacactcgtttattttgttctcatattcttcggtttcccgttcgtaccggcggcgcgtgcattttgcggtggggctcctggatctcgctctggacggaggcacagacagcttccctggcgtccccaaggtgctggtagattcacc

SEQ ID NO: 72752 - DNA, 392 bp, Zea mays
  Clone ID: LIB3078-015-Q1-K1-H12
gccacgctgaggatgcatacaagaagatccgttccggagctacacttgttcaactttatactgctcttgcataccgtggtccagctcttatacccagaataaaggctgagctagcagaatgtttggaaagagacggattcaaatctgtgcaggaagcagtcggcgctgatttccgatgatccctggcggatcgctgacaaggtctgaataaccgttccggtaaagttcatgtgattttgatgagaagcaagcaactctttttttgtgtgtgtgggcacgatgcttgccaattccatttgaccggtacttgaaaagaaataccgggttgaaactttgctgggggtgagttgagtaatgagcggctgtatcacgcgcgcgtacatgagcttttg

SEQ ID NO: 72753 - DNA, 428 bp, Zea mays
  Clone ID: LIB3078-015-Q1-K1-H2
ctggctccttatctgcttgatgaagatacagggtgggcacttgaggttgatgagctgaagaagcaacttgaggaggctcgatctaagggcatcagtgtcagggcgcttgttgtcatagatccaggaaatccaacaggacaggtccttaccgacgaaaaccagaagaaaattggtgaattctgcaagaatgaaaggctcgctcttctcgcggatgaggtttaccaagaaaacatatatgtcgaagacaagcaattccactcgttcaaaaaaatcgcacggacgctgggatacactgatgacgaccttgctttggtatcgttccagtcgatttctaaaggctactatggagaatgtggaaagcgacgtggttacatggagataactgggttcagtcctcaagtacgggaccaaatctacaagatggcatc

SEQ ID NO: 72754 - DNA, 436 bp, Zea mays
  unsure at all n locations
  Clone ID: LIB3078-015-Q1-K1-H3
cggacgcgtgggcggacgcgtgggcggcgacgagaagtggcgagccccgagagcgggtttagttagaggctacgggcggtcgggcgcggcggcggcggcggccatgagcagcgggagcgagagcactaccgccagcaggtggctcgagctggccacgctgcgcgcgctggcgcgcgacgccgcggagcagcttcggctgccgcgggccggcacgtcggcgtcggcgtcgtcgtcgtcgccgtggcgcgggcgcgaggaccacctccacggtcacggcaagacggccaaggtgatgcacctgctgctctggggacccaagtgaagcggcggcgagaggccaccgtaccgncgggctctcccgacggcgttgctcgttttgctctgcctgcaatccgtcccgtacggactgtactgtacctatacacctatatactac

SEQ ID NO: 72755 - DNA, 433 bp, Zea mays
  Clone ID: LIB3078-015-Q1-K1-H4
ggcagcctgcaggggtttgaggagctattggcctcagtacttggaaagaaggcaggcgagaagggtaccttcaagctactgaaggcacgggcctcggctcaaacctatgtcaagatggcattcacggtggagaagaagcttgctgaaggggatgtgaactggtcaaatattccagaatggaagacgaagcccaagaggatgagagcgcactatgaagtccttgctcgagtggaggagggtcaggcgatccctgagaggatagcgcaggtacagcctttccaggccaacgaggccatgtcggagagtgtgctcaccggcaacgtcacgaggtcgaagatggaaatcgtccatccaccgtcggtttacttcactctctgagtgagggaagaactggatgctgtttgatgttctcttcagagctactacacgttgg

SEQ ID NO: 72756 - DNA, 395 bp, Zea mays
  Clone ID: LIB3078-015-Q1-K1-H5
cgcacaccagcacggcagcacctgccctcctcgccgtcgctgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgactgtcgtggccaaccctaggcaattcaaggtgccggactggttcctcaacaggaagaaggattacaaggacagcaggttctcgcaagtcgtctacaacgcccttgatatg

SEQ ID NO: 72757 - DNA, 182 bp, Zea mays
  Clone ID: LIB3078-015-Q1-K1-H6
cgcacaccatcactgcaactctctgctttcctcgccggaactgcatgcctgggagcgggcgatctaccatccgccgacgcgcacggccctgatcgccagcgaggactgacagcatattcagcgtttgctaaacaccaacgtggatgggaagcaaacgatcatgctagccatgacctcaatca

SEQ ID NO: 72758 - DNA, 433 bp, Zea mays
  Clone ID: LIB3078-015-Q1-K1-H7
cgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggag

SEQ ID NO: 72759 - DNA, 431 bp, Zea mays
  Clone ID: LIB3078-015-Q1-K1-H8
gcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccgggagctggaggtgatccactcccgctgggccatgctgggcgcgctcggctgcgtcttcccggagcttctcgcccgcaacggcgtcaagttcggcgaggccgtgtggttcaaggccggctcccagatcttcagcgagggcgggctggactacctcgggaacccgagcctcatccacgcgcagagcatccttgccatctgggcctgccaggtcgtgctcatgggcgccgtcgagggctaccgcatc

SEQ ID NO: 72760 - DNA, 350 bp, Zea mays
  Clone ID: LIB3078-015-Q1-K1-H9
acccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggctgtgctcaagatctttctcgagaacgtcatacgcgacgccgtcacctacaccgagcacgcgcgccgcaagaccgtgaccgtcatggacgtcgtctacacgctcaagcgccaggg

SEQ ID NO: 72761 - DNA, 422 bp, Zea mays
  Clone ID: LIB3078-016-Q1-K1-A1
gcagattgccgcttgagacattgtttgatgaatttgttgttgcccatatccttgggtgggggggcaaagctgtaatgatacgaaatcaacttctactttgggtcttgtcgattggctttgagctaatggagctaacgttcagacatatgctgccaaactttaatgagtgctggtgggatagcattatcttggacatattgatctgcaattggtttggtatttgggcaggaatgcacacagtccgtcactttgatggcaaaacttatgaatgggttggactgagccgccaacgaagtatcatgggtaaggtgaaaagatcgttgagccagttcactcctgctcaatgggacaaggatcagtggcatcctttcatggggccactgcggttcatccaagtgctgttcctctgcgttgtcttcatg

SEQ ID NO: 72762 - DNA, 410 bp, Zea mays
  Clone ID: LIB3078-016-Q1-K1-A10
gtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgtgctgatgggtacatccttgagggtaaagagcttgagttctacatgaagaagctacagaggaagaagggcaagagcgctgtagcttagagcattctcatggattgtcttgcaccgaaatgtgt

SEQ ID NO: 72763 - DNA, 406 bp, Zea mays
  Clone ID: LIB3078-016-Q1-K1-A12
cttggcacaactgatgagaatgagccgttacaggcaatgatgaaagaccagttcgcaaactatgtggtgcagaaggttctggagatatgtgatgaccagaaccgtgaattgattctttcccgtatcaaggtccacttgaatgcactgaaaagatacacctatgggaagcatatcgtggcacgtgttgagaagcttattgctgcaggagaacggcgcattggtgccccatcctcttgctgagatggcaataaagctatatacaggtcgcagaataacacctgtacagacagacagggatagcgaggcctagctttttaccattaccagtagtcggtaatattgagcgacggagaggttaaaaaaggctcccaaatcctttgatgtaaataaaggatagccgctggaa

SEQ ID NO: 72764 - DNA, 324 bp, Zea mays
  Clone ID: LIB3078-016-Q1-K1-A3
gaactgcccggacgacccaggccgacccacgcgtccgcccacgcgtccgcccacgcgtccgacccgatgtaccctggcggcagcttcgagcccctcggcctggccgacgaccccgaggccttcgccgagctcaaggtgaaggagctcaagaacggccgcctcgccatgttttgcatgttcggcttcttcgtccaggccatcgtcaccggcaagggcccgctcgagaacctcgctgaccacatcgctgacccaggcaacaacaacgcatgggcctacgccaccaacttcgtccccggcaactaagcttaacagctatgctatgca

SEQ ID NO: 72765 - DNA, 427 bp, Zea mays
  Clone ID: LIB3078-016-Q1-K1-A4
cccacgcgtccgggctgacatgatgaagaagaagatctcaatgcctgcccacctgatgtttgacggtcaggacgacaagctgtttgagcacttctccatggtcgcgcagaggcttggcgtttacactgccagggactacgccgacattcttgagttccttgttgacaggtggaaggtggcggacctgactggtctgtcgggtgaggggaacaaggcgcaggactacctctgcacccttgcttcaaggatccggaggctagacgagagggcccagagcagagccaagaaagcaggcacgctgcctttcagctgggtatatggtagggaagtccaactgtgaaatcggaaacccattgcgactgcttgagttggagcatagtctatcatgcaccctaagacgcatcgcgacgacaagacctggtgtgtc

SEQ ID NO: 72766 - DNA, 423 bp, Zea mays
  Clone ID: LIB3078-016-Q1-K1-A5
cccacgcgtccgcccacgcgtccgacccgctgtaccctggcggcagcttcgaccccctcggcctggccgacgaccccgaggccttcgccgagctcaaggtgaaggagctcaagaacggccgcctcgccatgttttccatgttcggcttcttcgtccaggccatcgtcaccggcaagggcccgctcgagaacctcgctgaccacatcgctgacccagtcaacaacaacgcatgggcctacgccaccaacttcgtccccggcaactaagctcaacggctatgctatgcaacttcattgtctttcggatcggagagggtgtacgtacgtggattgattgatgctgcgagatgcatgtgtgtcttttgtttcacgttgcattgcataggcaagtcgagatgatgagttggcgttgtacactaagatg

SEQ ID NO: 72767 - DNA, 297 bp, Zea mays
  Clone ID: LIB3078-015-Q1-K1-H11
cccacgcgtccgtccactcgtccgcacacacagagagagacaagtggtgggcactccagagtgctactagcagtctagcaaccagctaactcgggctggattacgcagccatcatctgatacgactggcaccaccacttattcaaccatcacacctaggtcgaggtgcacaacgtctacaagtactggttctccatgactgaggaggtcacatggaacatgcagggcgagtacgagaggtacaagaaggatgagatggaacacaggcacaaacagctcctaaagaaggcatgctcaa

SEQ ID NO: 72768 - DNA, 365 bp, Zea mays
  Clone ID: LIB3078-015-Q1-K1-F6
cggacgcgtgggctccgtgataggcaactcgctgcgcaatttcatgaaatgcctctggatcttaagatgatccgagcagaaaaagctggatttgaaatcctgaaatctacaacggtagataaactccccaatgatcttgaaggaatcgcttactgaatggagaagctctacattcttattgatgagatctacagatacctggatgatgctggacaaagacgcgcggcacctgatcacaaaatcgaacggctgctatctcaatcctgtgcttcaatgccaagattcgccccaggtgctgacgatcagcttttaaatgacaagattcaggataaccttgcgctagtatacctgtcaagcatcacaag

SEQ ID NO: 72769 - DNA, 218 bp, Zea mays
  Clone ID: LIB3078-015-Q1-K1-F8
gcgatcggtccgggatggactagctgtagatggacgaggaggtcaggccggagttcgcctgcccctactgctacgaggaccacgacgtcggatccctctgcgcgcacctggaggaggagcacccgttcgaaccccaagccgcggcctgccctgtctgctcagagatggttacgaaggatatggttaaccatattactacgcaacatggatatttattc

SEQ ID NO: 72770 - DNA, 413 bp, Zea mays
  Clone ID: LIB3078-015-Q1-K1-F9
gagcggcggcgcgggcggacaaggagcaggcggaggaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatgga

SEQ ID NO: 72771 - DNA, 341 bp, Zea mays
  Clone ID: LIB3078-015-Q1-K1-G1
ccaagaacaggaaggaaacaccgccgtcgccgtgccttccattccagtactcgcggaggaaaggaacaccagccagcgccatggtcacgtcgacgaccgccgtcgccgtgctgtccccgccgtccgtggccgggcttcgcctggcgccgtctacccgggcgcgcgtggcgttccgcgcggcgcgggcgcggcggtacgttgcggcgcgcgcggagctgagcccgtcgctggtgatcagactgagcacgggcgtgtcgctcttactgggccgcttcgtcttcttcaacttccagcgggagaacgtggcgaagcacgtgcccgagcagaacggcaagacgcac

SEQ ID NO: 72772 - DNA, 420 bp, Zea mays
  Clone ID: LIB3078-015-Q1-K1-G10
caaccccgtctgcctctgcgagctcctctccggcgccgccgactcctacggcatcgccgtcgactacggccgcgcgctcgcgctccccggggtctgccgcgtcgccacaccgtccgtctccacccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaatttgtcagcaacaaacgtacttacggaccgtacggcagggacgagggcaccccgttccgtgtc

SEQ ID NO: 72773 - DNA, 247 bp, Zea mays
  Clone ID: LIB3078-015-Q1-K1-G11
gaacgtcaaccccatcgacgtcaagttcaccggcaaggccaccttcgactaatcacactgcacgtacgccgcacgccccagccgggatccaaattaaagaacttcttcttctattaattacagtatattgtaatttggctgctggtacggtggtggcatgatttgagatgtgcatgatgatccttgtgtaattttattaccaagtctcttcttatatttacatgttcatttgcttgcttcttggtat

SEQ ID NO: 72774 - DNA, 383 bp, Zea mays
  Clone ID: LIB3078-015-Q1-K1-G12
ctcactctacccaattttcgacaatctttttttacaggacttcttacaataataacattgggacctacggggcatactccattctgcatcgagcattcaagaactatttattctattaattgcactgtattataattgggcttgtaccacttgagtacaattacttcatatgcgcatgatgatacatcacaaattacatctaccatgactgttattatatttacatacttcatattcttccttactacctagcttttcatctatgacctgtgcctgtctgtctacatcatccaagattacctactcgtgtatgacaccatcatacctcttctataatgtatatctaattcatttgattgtccgtatttttactacgtaatgac

SEQ ID NO: 72775 - DNA, 376 bp, Zea mays
  Clone ID: LIB3078-015-Q1-K1-G2
ggcatgaacgcctacagcggcctcaatgggctcaacaaggtgaccatgctcggggtgcgcaagaccgccgactactccttcggcaaggtcgtggcgtcgctcagccccgcgggcaggaagcggcgcggcggggcgttcggcgcccagatgaacgccgtcgccgagatcttcaggatcgccggcaccatgagcggcctcgtgctcgtcggcatcgccgtcggcttcgtgctgctccgggtggaggccgacgacgaggaggccgagtaaggcgctcgcgcctgcttcataagccgtgatatatatataaaaacgtgatgtatgctttcgattcaatctttggtatgtactgtatcaacgatgacaattgatgaatact

SEQ ID NO: 72776 - DNA, 416 bp, Zea mays
  Clone ID: LIB3078-015-Q1-K1-G3
cccacgcgtccgggcttacttgggagactgcatatatgaactttatgctcggaggcacttcttctttccacctctgagcatcaatgagtacaacaaacgtgtgatggatgttgtgaagtgtgagtcacaggaccttttgttgaacaagcttcttggagaagattttctaactgaagaagaaagggacatacttcgttgggggcggaatattgttagcagcaaaactcgcaccaggaagcgtgcaggaattgctgtctacaaccgggcatcttcactcgaaacactaattggatatctttacctcacaaatttcaaacggttggaacaactgatgtttcaattgggcttcacaagtggtgcctcatcacagcatattgcagacgagctgcgctcaagtttccagaaaacaacccccg

SEQ ID NO: 72777 - DNA, 343 bp, Zea mays
  Clone ID: LIB3078-015-Q1-K1-G4
gccacgcatgccttcttacttcggattctgcttatctgagctaccttcttggaggcgctcatgatttacaactatgagcatggctaagtacaacaaacgtttaatggatgttgcaaaaagcgactcacaggaccttttgttgaacaaactaatcgcagaagatatattaactgaataagaaagggacatacttctctggtcgcggaatattgcaacgcagataactcgtactacgaagcgagcacgaattgctgtataccacactacgatgttcactcgaaacactaatagcatatatttactttacaaacttcgaactgtcggaacaactgatgtttcaatt

SEQ ID NO: 72778 - DNA, 435 bp, Zea mays
  Clone ID: LIB3078-015-Q1-K1-G5
cccacgcgtccgcccacgcgtccgcgtcgtcgtcgccgtggacacggcggcggcggcagcggcagcggcagcggcagcagcgatgcgcggccggcgtcgcgtccacctgcgggtgtacatgcacgacgtgatccgggggccggggcagacggcgatccagctggtctggggcgtgggcccgccgcacgcgaccatgccggggcggtccttcggcgacacggcggccatcgacgacagtcctcacggagggcccagacatcggctccgcgcccgtcggccgcgcgcgggcagggcacctacatgctcagctcgcagcgggaggggcggtgctcgtcgtggacgtcacgctcgcgctcaccgcggggccatacaacggcagcacgatcgtggtggccggccgcgaccgcgtacaggacgagacgagggagctcgcgg

SEQ ID NO: 72779 - DNA, 275 bp, Zea mays
  Clone ID: LIB3078-015-Q1-K1-G6
gccacgcgtacgtgcacacgtccggttacacggacacaccacagggacggggagtagatgtagctgaacatgttgtggcatgtgcccaaagacgtgatggtgggcgcgttcgacgcggtcacgctcatcggtctcatggagttgttctacgaccaaacgctcaacgcgaatctgagcctctgatgcgagatgttcatgacgtactacacactcacgatctacctaagctacgcgctaattaccgtggtgtctcgcgccagcaatcgccgtgggca

SEQ ID NO: 72780 - DNA, 426 bp, Zea mays
  Clone ID: LIB3078-015-Q1-K1-G7
cccacgcgtccgcccacgcgttcgcccacgcgtccgcccacgcgttcggtccagaagagcaagatcttctatatcctatggtccccatactccgccaaggtgaagagcaagatgctttatgcaagctcaaaccagaaattcaagagtggcctcaatggcattcaagttgaactccaagccacagatgcgagtgaaatcagcctcgatgagatcaaggatcgggcacgctaggcgcaccgacatcgcgagtttcatggtcacgcatcatggactcgcctactactgcggatttgtacgccattatagactaggtgctgctaaagactgctgtggtgatttgtgggacagatgctgcgtaaaaagatcctcatggctttcagatgaccatgaaaggttggatctatcatgtaatttcatgttatctgc

SEQ ID NO: 72781 - DNA, 431 bp, Zea mays
  Clone ID: LIB3078-015-Q1-K1-G8
ggaaaaggctgattcagtcgcgaggtcgctcgttcatattttcaactgctttgccagtgccagttgttgcttctgtgcatgcggcactctatgtctcgagtaaggagacatggcggagatcagtgatctggaggcatgtgcagtatttcgcctctttgaccaagctcgagataactagtcccataatttccattgtggttggaagtgaagcaggagcgctcagggctagcaggtatttgctaagatctggatttcatgttacaccaatcagaccacccacggtgccacccaactcatgcaggctgagaatcactcttagtgcttcccattcctcggacgacatcaaaaggctggttgatgcactcacaccatggctccctgtcaaatatggtaatgggagctatgctacagcttcaaaactctaacccatc

SEQ ID NO: 72782 - DNA, 403 bp, Zea mays
  unsure at all n locations
  Clone ID: LIB3078-015-Q1-K1-H1
cggacgcgtgggcagtgacactggagttaggaggcaagtcccctttcatcataatggacgatgctgatgttgaccatgctgttgagcttgcgcactttgccctgttctttaaccagggacaatgctgctgtgctggatctcgcacgtttgtacatgagcgtgtttatgatgagtttgtggagaaggccaaggctcgtgcattgaagcgcgtcgttggtgatccgttcaggaaaggtgttgaacagggcccgcagattgacgacgagcaattcaaaaagatcttgcgctacattaggtatggtgttgacggtggagctacccttgtgacgggtggtgataggttgggtgacaagggtttctacatncagccaacgattttctcagatgtccaggacggcatgaa

SEQ ID NO: 72783 - DNA, 400 bp, Zea mays
  Clone ID: LIB3078-015-Q1-K1-H10
cccacgcgtccggtgagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcagagagaatgggtatagacaatatggatgtggaagccctcaagaagatgaacaaaaacaagaagctagtgaagaagctggcaaagaagtaccatgctttccttgcatctgaggctatcattaagcaaattcctcgtcttcttggtcctggtcttaacaaggcaggaaaattccctaccttggtgacacaccaggaatcccttgagtccaaggttaacgagac

SEQ ID NO: 72784 - DNA, 404 bp, Zea mays
  Clone ID: LIB3078-015-Q1-K1-F5
cccgttgcttccggctcccgcagcgtcgccgaccttcacagccggttccttggtccggcaccatggggaagacacgtggtatgggagctgggcgcaagctcaagacccaccgcaggaaccagaggtgggctgacaaagcatacaagaagagccacttgggcaatgagtggaaaaaaccttttgctggatcatctgacgccaagggcatcgttctggagaagattggtattgaggccaagcagccaaattcggccatccgtaagtgtgcccgtgttcagctggtgaagaatggaaagaagattgctgcctttgtgccgaatgatggttgcctaaactacatcgaggagaatgatgaggtgttgattgctggatttggtcgtaagggtcatgctgtgggagacatt

SEQ ID NO: 72785 - DNA, 325 bp, Zea mays
  Clone ID: LIB3078-015-Q1-K1-D9
cccacgcgtccgtgcatagttcagatgatcaaccctcgtggttctgattatattgagtgattagtcttgcgctcctatctgacgaccttatcaatgccactctgatattatatgcttttaatgttgcgtttactgatttcgatacactatgtttattgacgtcctatggtacattctcagccagatactgtcgccgcttcaaaatcctggccgagaggttcacggcgccggctcgcatccgtccttgccctggctgcaccttgcttattgtagttgaaatggtgcacgtgatgtatgcattgtaatcatatttccttagactgtc

SEQ ID NO: 72786 - DNA, 428 bp, Zea mays
  Clone ID: LIB3078-015-Q1-K1-E1
gccacgcgttcgcgagaatggtgtctgccttgcttgtggagaaaagctggctattatgagatcttgacccagaagaaacagaagattttgccacatttgtggcaaaattagctattaagagagagaggaaatcgaactttgagaacttccagaaatggcttgaaaagcatgggccttttgaggcagtcgtggatgctgccaatgttggcctgattagccacaaacacctttctttgagtaaggttaattctgttgccgatgcaataaggctaaagtttacgtcaaaaaaatggcctttgatagttgtacataacaagcatctcattggagagcgcatgagaaaacttaatgatcacaagttggtacaaaagtggtagcaagaaaattcaatatatgcaacccctactggttcaaatgatgattggtac

SEQ ID NO: 72787 - DNA, 357 bp, Zea mays
  Clone ID: LIB3078-015-Q1-K1-E10
gcgggcacgcattcaaatgtttacagatctaattgcactagctttccatctaaccactttcagagactatcagtggttatcaggtcctacctaaatgctgaaatactttctacagatgacactcatacaattctagaccatgatctactatacatgaatgatgacttgacaaacatgctttaaggcacttctcaaatctcgccatcttaaaagctgcttgacaatatatcaaaagctccagaacaaacttctgctgactgatatttcaggactcaacactctctacataaagatgactaggatcttgctccagaatcactttaacagcctaaatcatattctgactatgcaagctcc

SEQ ID NO: 72788 - DNA, 413 bp, Zea mays
  Clone ID: LIB3078-015-Q1-K1-E12
tgcatggaagcttggttgataacccattggctttagcaggtgacgatccatctttgcaaattttccttgcaagtcaaccttctactgttccccttcaggaagaactgagtgagcgcgctaatactccaaatggagtccaccctgatgattggaggatatctcttacgcttgcggctggtggagggggtaatgaagaacctacaagtgttgatggcctaaaatcacagccaaaagttccatcaaaagaggcaggagttgaacctttacttgatgctgcttctgctctcccaagcatgaacaatgacagatgtaatgtatctaatctaaacccgagaaggattgaaaatatattttctcatcctcgccaaccacggtctgttaggcctcgtttgtgtttgtcattagattctgat

SEQ ID NO: 72789 - DNA, 343 bp, Zea mays
  unsure at all n locations
  Clone ID: LIB3078-015-Q1-K1-E2
cggacgcgtgggccgccttgtcacagaccacgagatagcaagcctgtgcatcgagatgctcagcgatggctcggagctaccggcgacggcgctggagtggatcatggcggagctagtaaagaacccaagcgtgcaggacaagctctaccaggagatgatggagaaagccaaagccaccactgacgcttctgctggcgtgctaccgttctcggaggatgacttgcccaagataccctacctgagagcggtggtgcttgatggtctgcggcgccatgctacggggcaccaaatgccttcacacagggttgaggangacgtggatgtgggtgactgactggtgccc

SEQ ID NO: 72790 - DNA, 402 bp, Zea mays
  Clone ID: LIB3078-015-Q1-K1-E3
gttataagggacaagatatttgaatttggacagaaagttggccaggttatcatatttgttagaacaaagcaaagtactaagaatgttcacaatgctttgacgagggaggactatgtgtgctcctcaattcaaggatcccttgaccaatcagagagggaaaagataatacaggaattcaaagatggctacaccaaggttcttatatcaaccgatgttcttgctcgaggttttgaccaagcacaggttaaccttgtcatcaactacgacatgccaatcaaatttggtacaagagatgaacctgattatgaagtgtacttgcacagaattggcagagctgggcgctttggccggaaaggtgctgtgttcaacttgctgtgtggtcaaaccgataatgttgtgatg

SEQ ID NO: 72791 - DNA, 423 bp, Zea mays
  Clone ID: LIB3078-015-Q1-K1-E4
cgctagtgttggacagaagagaatacactacagtactacatggcgaagcagcagcagcagggcatgccggcagtggcgctggtagtgctggtggtgctggcgacggcggcggccgagacggcgtcggcggcttcgtgcaacgccgggcagctggcggcttgcgcgccggcgatcacggccggcgcgaggccctccgcgtcgtgctgctccaacctcaaggcgcagcaggggtgcttctgccagttcgtgaagaaccccacctacgggcgctacatcaacagccccaacgcgcgcaaggtcgtcgcctcctgcggcgtctccgtgccgcgctgctagtacgtgtacgtgtgtgcaatgtgcatgcatgtacgtgcgcacgtgggctgatcttactgcttggttcgtgccttgccgcgcgctatc

SEQ ID NO: 72792 - DNA, 271 bp, Zea mays
  Clone ID: LIB3078-015-Q1-K1-E6
cccacgcgtccggtcagtgcccctgccgccggtgaccctacctaccattgcgatcggtggcggaagcccgagcccgacaaaaaaggacccccgaaggcgggcccaacggcttcggcttccccgacgcccacacccaagcccaagccggccttggaccagtgccccatcgacgcgcttaagcttggcgcctgcgtggaccttctcgggaaccaagtgcacctcggggaccccaacgtccaatgctggccgctcgtgaaaggcatcgccgggc

SEQ ID NO: 72793 - DNA, 423 bp, Zea mays
  Clone ID: LIB3078-015-Q1-K1-E7
gggaggggacgagagcggtctcgtgaggggtgtgctcgccgcgctccgcgagcgagccgaggccgaggacgccgctcgcttcgccgtcgcccactacaacaagaaccagggcgccgctttggagtttactagggtgctcaaatccaagcggcaggtggtgaccgggaccctgcatgacctgatactggaggcagctgatgctggaaaaaagagtgtgtacagagcaaaggtttgggtgaagccgtgggaagatttcaagtctgtcgatgagtttcgccttgatggagactctgaatctgaacccgagccttctgttgcttctgatgttagctctgggcaagatattgtacaagaagaggctcgcctgcacaccattgagaatgatgggctttccggcgatttcacatcatcatcttaggcata

SEQ ID NO: 72794 - DNA, 292 bp, Zea mays
  Clone ID: LIB3078-015-Q1-K1-E8
gtggaagcagacgtgcggctgtacgttatctcgtgcaagcccgatgcgggggaaaggaatacttacgacgcgctggaagtgttagtcctccttgagacggatcgcaaatggcacgttcttacaggtttcgtgcatcgctcgattaattagcacatagagtgcttgcaattacagccagtacgaggtcatgagcttcaagctggtccaacatcacagcacgacacgcttacttactacatgaaggggataaccatatatagcgtgcctgcattaacatgcttaagaatgacaa

SEQ ID NO: 72795 - DNA, 433 bp, Zea mays
  unsure at all n locations
  Clone ID: LIB3078-015-Q1-K1-F1
cgagacgatactgctccccgggtgcgactacaaccactggctgatcgtcatggagttgcccaaggaccccgcgcccacccgcgagcagatgatcgacacctacctcaacacactcgccaccgtcctcggcagcatggaggaagccaagaagaacatgtacgcgttcagcacgaccacctacaccgggttccagtgcaccgtggacgaggagacgtcggagaagttcaagggtctgcctggggtgctgtgggtgctccctgattcctacatcgacgtgaagaacaaggactacggaggtgacaagtacgtgaacggcgagataatcccctgcacgtacccgacgtaccagccgaaggagcggaggacgtncaagtacgagagcaggcggtacgagaggcggagagatgggccaccggcgggcagcaggaaaccg

SEQ ID NO: 72796 - DNA, 418 bp, Zea mays
  Clone ID: LIB3078-015-Q1-K1-F10
cggacgcgtgggtgatgctgtcttgcgcggtcacatcgatttctcttctgacccttggcgttcaatatggaatggtgcaaaggatttggttaagaagatgctgcgacaagacccaaaagaacgcctgactgctgctgaaattttgaaccacccatggattagagaggatggagaggccccagataagccacttgacattactgtcattggtagaatgaaacagttcagggcaatgaacaagctcaagaaagttgcattgaaagttgtggctgagaacttatcagatgaagagattatgggcctaaaagaaatgttcagatccctggatacagatgacagtgggacaattactcttgaagagctaagatctggtttaccaaaacttggtacaaaaatttctgaatcagatattaaacaa

SEQ ID NO: 72797 - DNA, 247 bp, Zea mays
  Clone ID: LIB3078-015-Q1-K1-F2
gccacgcgtgcggccacgcgtccgcggacgcatagtgcgggcgaggtgcctgcccggcgacggcatcctcacggtgtccgagaagaggcacccggacttcaaacggatgggcgacgacctggtgctcaaggccgaggtgccgctgatggacgcgctcactgactgcgccttatcgatccgactactatgcggatggaaggtgagctgctcaatcccagacgaggtcgtgcggacctgctacgagaag

SEQ ID NO: 72798 - DNA, 399 bp, Zea mays
  Clone ID: LIB3078-015-Q1-K1-F3
gcgggcccatcctggacgacgagatcaacgaggtcatcgtgcgcccgctggtgcacggcgccaggctgcacgccgtggtggacgcctgctacagcgccacggtcctggacctcccctacctgtgccgcatgtccaggaacgggttctggcagtgggaggacgagtgcccgccgtcgggcgcctggaagggcaccagcggaggccacgccgtgctcatcagcggatacagcgagggcaaaggcaacttcgccatgatgcccgacgcccacgcgtcggtcgtcggggccatgacgcacagcttcgtccggacgctggagtgccagccgcgcggggtcacctacggccacctgctcagctccatgagggccatcatgaagaaccgcggcgggggctgcgatc

SEQ ID NO: 72799 - DNA, 431 bp, Zea mays
  Clone ID: LIB3078-015-Q1-K1-F4
acgcttgcggtgattggaccggtgtagaagacagggtgggcacttgaggttgatgagctgaagaaacaacttgaggaggctcgatctaagggcatcagtgtcagggcgcttgctgtcataaatccagcaaatccaccaggacaggtccttaccgaggaaaaccagatgaaaattgttgaattctgcaagattgaaaggctcgttcttctcgcggatgaggttaaccaagaaaacatatatgtcgaagacaagcaattgcactcgttcaaaaaaatcgcacggtcgctgggatacactgatgacgaccttcctttggtatcgttccagtcgatttctaaaggctactatggagaatgtggaaagcgaggtggttacatggagataactgggttcagtcctcaagtacgggaccaaatctacaagatggcatc

SEQ ID NO: 72800 - DNA, 417 bp, Zea mays
  unsure at all n locations
  Clone ID: LIB3078-015-Q1-K1-D8
gaacgggcggctcgccatgctcgccttcgtcggcttctggttccaggccgtgtccgcggcccagggccccatcgacaacctgctcgcgcacctcgccgaccccggccactgcaacatcttctcggcattcacgtcccactgatccgatgttgcttcggagctggcggagagaccgcgaagaattaaaaaaaagggcatcctgttgagggagaaagaacttcgcttggtcggtatcattttggccctgctggacatgtcaacattttgtttgtagtacctgcgtagaaatgtcaaaccacctgtacaaacgtacaaataccaccccagggatcgcgatgatgctagccagcagtccagcacacactagctngtcctgaagatccatgcaacaccgtatacagaggaaatttatggaca

SEQ ID NO: 72801 - DNA, 346 bp, Zea mays
  Clone ID: LIB3078-015-Q1-K1-C2
cggacgcgtgggcttcctcagcctcattctatccaagaacgcagaaccgagacccaggaactcgcagcaggccagcagccatggccgtccccgcaacgagctccctgctgagcacgctgctgcagctaccgctcgctccggtctcggggaagagctcgccatcgtccgtggcgcacgtggcgcgccgggcgccgacggctatggtggcggccaaggggttcaatgtgcagatcctggtggacgagaacgagggggaggagtccatctttcgcaggttcctgcgggaggtgatgcgcgccggcgtgctgcaggagatcaagcgccgtccgatgtacgagagcaagac

SEQ ID NO: 72802 - DNA, 404 bp, Zea mays
  Clone ID: LIB3078-015-Q1-K1-C3
cgccgacttcggctggggacggccggcgttcatgggccgcgcgtgcctccagttcagcggcctcgtgtacctcgtcccgggcccggacggcgacggccgcctcgacgtcgtcgtggccatggagcccaagagcctggccagattcaaggagctgttgtacgagctcaaaggtgcaggtgttccgtgcacggcagactgagctgctgcattccgtgcaggttccttggcttgctaccggctggcaaaacgaaaacctgtttgccggattgttccttgcattgcgtatctacttcgacctttactgcagtactcctagttttctactcgttgtttgtgatcgcaatctggtgagtactgtactctatatgcatttacatggctatctatattattcggagctaaat

SEQ ID NO: 72803 - DNA, 403 bp, Zea mays
  Clone ID: LIB3078-015-Q1-K1-C4
caaatatttgctgaacaccgtccaaggtagagttaagtcattggtcctatcaaatacggttcttgagacgcacaagtttgctgctgccatgccttggtctccagttgttaattggaccccttcttttttgctgaagcggtacctcttgacaggaatccgagatggtccccatgaaccattcatcgcagactcagtagattttgttgtgggtcaggtggagacattgtcaagagatgatctttcatcaaggttgatgttaaatgttaatgttgcatccgttgggtcgttaatgttgcctgattcactcatcactataatggatacaaatgactactctgcagttccccagcagttgaaggaacagttgaatgaaaggtaccctggtgcaaggcgtgctgtactg

SEQ ID NO: 72804 - DNA, 256 bp, Zea mays
  Clone ID: LIB3078-015-Q1-K1-C5
cccacgcgtccgaagaaggctgccggcggcgacgacagcggcagcggcggggggttcaacctcggcggcctcggcgggctcttcgccaagaaaagcagctgaacgtgccaagtgtggcgtggtttatggattgtcgaactcaaagctggatttggcttttgagggggaaatggttgcgcatatatatttgtggacgtgtggtggtgtgaccagtgatctttgatgtcataatgtgatatactctacttccagctgc

SEQ ID NO: 72805 - DNA, 426 bp, Zea mays
  Clone ID: LIB3078-015-Q1-K1-C6
gtggactgcattaggacacggtggccacgagctgtttgtagctgggttggagatgttgcaagcattgtctgacacagtggatgtcgtgtgcgcactagtcgctctagctatgttgctcgtaacctcgttctgaagaatctgctcagagcaagccacttggagcttcctgattgttcatgccctggaaaaaggaatcgcccaattacatggtttgttcggtcaaaatgagtgatgttttaaaatgcgtgttattaatcaagggcctggatattctttgttttttgcttttattgacattagatgtacacttgatttatggatatgttttgtgtcttgggttacattcttttctgtacacatatagtttcgtttgtgtttatcatgtcatctgacacagtgagttgtctagccagaagccggttgagt

SEQ ID NO: 72806 - DNA, 392 bp, Zea mays
  Clone ID: LIB3078-015-Q1-K1-C7
tgcatttggtgtacatgagcaggtctaaggcgagattggaaattggggatgtccctggtgcacttggggatgctgaggaagcaataagaatagctcccagatttcctcaggctcacttattgcgaggcgacgcactatttgcaatgggcgaatattctgtcgcggaagatgcctatgcagatgccttggatcttgatccatctattcgccggtccaagtctttcagggctcgcgtggaaaggctacgagagaagcttgttagtgccaataatccgtagttcattttgaagctctctctgcatcagaagttcgatccacaagtaatgtagatatgttcttggtgaaggtaataatgctcacacactttgcaagccactggtcaggaattgatt

SEQ ID NO: 72807 - DNA, 427 bp, Zea mays
  Clone ID: LIB3078-015-Q1-K1-C8
cccacgcgtccgaccacgcgtccgtgaacatgcacagaaaatcattaagggtgttacgacgacaaagttatcttctgcaattgaagcctctgttgctcggggtcagatcggtatacagcaggtccgaggattgaaggaagcaaacttccaactagatagcttgattgcggagccgcagcgagaaagcatttataggaaaactgttgaagagctcttttcttcaggtacaggggatttcgatgaagaggaaatgtatgtgaagattccagctgatctcataataagttctgagaaggccaagtcaattgtacaggatattgcaaaggttaggttggagaactcccttgtccaggctattgcgttgcttcggcagaagaagagagatgatgtgctttcatctctgaatgacatgctcgcatgtgatgct

SEQ ID NO: 72808 - DNA, 419 bp, Zea mays
  Clone ID: LIB3078-015-Q1-K1-C9
cagctatgtcttctcaggtcgacaggcgcagccagtccgccgggaagcgcgcgcgcaccgacggcagccggcgtgaggacgactgggtttgccccagctgcaagaacgtcaacttcgccttccgcaccacttgcaacatgcgcagctgcaaccagtccaggccagcagatcacacggccatgcagaccccgcctcactatcccatgtcagggggttacatgggccctgggacgccaccatcgatgtaccttggtgggggcgctcccccatatggatcctcaatgtttaatgggcctgcggtgacgcgctatggtattccgcaatttcctgggggttctgcgtattcatatggatatggtggtcccataccaatggggagcccctacgggccaatgcaaattgctgggccaactccatac

SEQ ID NO: 72809 - DNA, 411 bp, Zea mays
  Clone ID: LIB3078-015-Q1-K1-D10
caaaagctgagaacaaggctgctaagaaagtatccgctattctttcatgggaaaacacagagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctact

SEQ ID NO: 72810 - DNA, 405 bp, Zea mays
  Clone ID: LIB3078-015-Q1-K1-D11
gtttcggtgtaatggcaactacaggttgactatgcatgcactccagaagaagtgcagcagcacttcaagtcttgtggaactgttaacagagtgacaatcctgactgacaagtttgggctaccaaaaggttttgcttatgtggaatttgttgaagttgaagctgttcatgaagctattaagtcgaatgaatcagaattgcatggtcgccagctcaaggtggcaccgaataggactaacattcctgggatgaatcaactccgcggtcgaggtttcaatccataccggtcatatggttatagtccttatggttatggctatggctacaggagattccctagattccgccgtccgcgaagactgtatatgtgaagctcgtatgtccatatggtatgcagtacatggact

SEQ ID NO: 72811 - DNA, 229 bp, Zea mays
  Clone ID: LIB3078-015-Q1-K1-D12
cttccgattcacccgtgcacgcacgctttcatccactcatcatcatactttatgcgatcttatcatatcatcccacacagggaaacttgggccagctacccggcgtacaaaatatcaaacatccctaccaatgaaagacctcttattctccctaccatatttccaacacaatgttaatcattctctacataactacatcaccaccaacatcataccacatcgtaacctc

SEQ ID NO: 72812 - DNA, 429 bp, Zea mays
  Clone ID: LIB3078-015-Q1-K1-D2
gtagccttcgacgcgtcgagcatcgatcatgtcggcctactgcggaaagtacaacggtgagctcatcaagaatgctgcctacattggcacccctggcaagggtatccttgctgctgatgagtccactggcaccattggcaagcgcctttccagcatcaatgtccagaacgttgaggagaaccgccgtgccctccgtgagctcctattctgctgccctggtgctctccagtacatcagcggtgtgatcctcttcgaggagaccctgtaccagaagaccaaggatggcaagccttttggtgatgtcctcaaggagggaagcgtactacctggcatcaaggttgacaagggcaccattgaggttgatggcactgataaggagaccaccacccaaggccatgacgaccttggcaagcgctgcgccaagtacta

SEQ ID NO: 72813 - DNA, 263 bp, Zea mays
  Clone ID: LIB3078-015-Q1-K1-D3
gggacgacaccttcgctccgcggccgtgcggcggctggcaaacctccgatgcgtgcgcacattgctgactgagtgagccatcgcgagctagcagcagcaggcacgccgagctcgccaacgatgaacatccagaggcccgatgactaaatactactgactagtacatggatggggacacctgctgacacgggatgaacctgccggacacagttggactgcacttaccgaagcagttaccgaaggtgcagcgcccaatcgaagat

SEQ ID NO: 72814 - DNA, 410 bp, Zea mays
  Clone ID: LIB3078-015-Q1-K1-D4
ggaggtgcggcgagaggtggcgcagatccaggggctgtgcgcgcagatggaccgactctggcgatccatccccgccaaaggccaacgggacctctggaagagaaaagtggagcagctctctgaagaggtagattcattgaaggaaacccttgacaggcattctctgcgacagaaaaaacggattctggaagcaaaagaaagggctgagctatttgaaagagctaacggtgaatcttcacacgtcctccgaatattcgacgacaaaccccagccaaagcattcatgcccgtaccttcttaaggatgctcgaagaagcttatgagacaagagtgggtattcttcacaagtacgctgaccagagggatcggctgaagagtgctcaaaggaaagctttggatgtcctgaacact

SEQ ID NO: 72815 - DNA, 430 bp, Zea mays
  Clone ID: LIB3078-015-Q1-K1-D5
gcagcggcgtcaccatctccattagagcccagaagaagagtaatagcgactctgggagtagtagcggaggtggggacgtgcggaccagcagcgggaggcgagtgtggcgtcgtcggaaactgaccaaagaagatgacatgttgcgttacaagttggatcgtatccctttcttagaagagaaggtgagaaaggtaagggagaatgggaagatcatatgcctggatattaatcagctgatgttatctcaagagaatagatttgcgttcaccatggaggtggctgaagaagctaatgcctatcttgagaagaacaggcttgaatatgggttaaagaagcctatactgcatgttctcagtgatcgcatgaatgaatctgggttttctcggcctgagggttacctttatccttatcctatcaagcctggccctta

SEQ ID NO: 72816 - DNA, 423 bp, Zea mays
  Clone ID: LIB3078-015-Q1-K1-D6
caacgtggccagcgggaccaagctcatggtcgtcccgtacggcgccaacgtggagctggtcatgcagggcaccagcatcctcggcgtcgagagccacccgctgcacctgcacggcttcaacttcttcgtggtcggccaagggtacggcaactacgacccggtcaatgacccgcccaagttcaacctcgtcgaccccgtcgagcgcaacaccgtcggcgtgccggccggcggatgggtggccatccgcttcctcgccgacaaccccggggtctggttcatgcattgccatttggaggcgcacacaacatggggcctcaggatggcatggttggtgctcgacggcagcctcccgcaccagaagctgctcccgccgccgtccgacttacccaaatgttgattagactcttcctccatctctatcct

SEQ ID NO: 72817 - DNA, 431 bp, Zea mays
  Clone ID: LIB3078-015-Q1-K1-D7
cccacgcgtccgcgccagttatgaggttatgggcttggatgccactgccctgtcttacggtgaccttgtcaagagggtccttgggtgcttcggcccctcggaattttctgtcgccgtgaccatcttcggcgggcggagccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcaccttttgcgaaggactgcaagctggctaatcttgtctgcttggaggaagttggatgctatcgaggagaaggatggagtgcttgatgagtaagacgggtttcttgtgtccatttgc

SEQ ID NO: 72818 - DNA, 172 bp, Zea mays
  Clone ID: LIB3078-015-Q1-K1-C12
gggggcttatttggaacagttttttacacaaaactcctgacctgtaaatcaattttggaaaaccgtatccggtggtcgatccatgtattaatagagtaataatgttactatgttcatccaaatctcaaagacgtgatggttgtgttgaaaaaacagcttgaatcacttgctt

SEQ ID NO: 72819 - DNA, 219 bp, Zea mays
  Clone ID: LIB3078-015-Q1-K1-A8
cccacgcgtccgaaccaagcccgcacgacacgacaccaagtcgaggagctcgagagggcaccaataatggccggcgtgaactccagcgtcgtcgggctcaagcccgccgcggcagtgccgcaagccggcgacgactcatcgacggcgaagcgggtgcaactggccgcgcccgaaggccgtcgcgccgctctgctacgcctggcggacgtcttcgccgtc

SEQ ID NO: 72820 - DNA, 414 bp, Zea mays
  Clone ID: LIB3078-015-Q1-K1-A9
gcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtg

SEQ ID NO: 72821 - DNA, 184 bp, Zea mays
  Clone ID: LIB3078-015-Q1-K1-B1
gaggacggcggacttacagagcgcagataatatgcagttgtcgttggacaacctgagggcgatgacgtacaagctggcgagcttgagcctgaagacaagctacctgagggccctctcgagagctaacacgttgccgcggatacagagccaattgaggacatcttgactctacaacttgaggagg

SEQ ID NO: 72822 - DNA, 393 bp, Zea mays
  Clone ID: LIB3078-015-Q1-K1-B10
atcaagacccgtatgctgatggcatcgagatatatcagcttatatccagaagcacctccatcatgcagttcagctgttacaaatggcattaaggtacgctcatctgctgtctttgtgccagaacatcctgggaggcctggggaaaaatttatgttcacttactcaattcgcatgtcagttccagaggcatgcatgctaagtggcgtgtactattcttcctgccagctttgctcccgtcactggaccatcagatcgtgtgacagggttgtttctgatgtgagcggatgaagggttattggagagtatcctatactgttacctggtgaggatgagtttgtctactagagttgcacgccactgccccaagtaccaagatctgttgagggctctttt

SEQ ID NO: 72823 - DNA, 426 bp, Zea mays
  Clone ID: LIB3078-015-Q1-K1-B11
cccacgcgtccggaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggaggctaggctaggcgcctcttcgtagtcggggactggttatgggacatgtctctgtgtgatgctt

SEQ ID NO: 72824 - DNA, 392 bp, Zea mays
  Clone ID: LIB3078-015-Q1-K1-B12
gcatcctggccatctgggcgtgccaggtggtgctcatgggcttcgtcgagggctaccgggtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagatccatccattcgttcgtccgtc

SEQ ID NO: 72825 - DNA, 420 bp, Zea mays
  unsure at all n locations
  Clone ID: LIB3078-015-Q1-K1-B2
cttgatgatcgaggaccctataactggtcacatacctcgtcatgggtaaactttgacgtggagcggactaataccagaataagataccacgcaatgggagtggagagatggcgagagtagcgcgtaccctccgtggcaagaggctggacggtggtgtatctgtgctctcggttggcgtgaacctgatctggtcttaagaaccccggtggcgagttgacatatgcaagggttaagtgctacatatgtcgtgtgattgaagatcctcagctgagtataatcgattcggatcgccgtaccttcgtggttatgaatacttggtcactgccctacacgtagcaatccagtgaagatgaagggatgatgaaaagaccgctagtataagccaagtgcttgaactanggtagaaagaactctagatgc

SEQ ID NO: 72826 - DNA, 393 bp, Zea mays
  Clone ID: LIB3078-015-Q1-K1-B4
tgcctcagcagcacatgttgcgaatttgttgtcaactgaacctgctgacatcaaacggggtgttggcggctttagtatgggtgctgctactgctctgtactctgcaacttgctttgcccatggaaaatatgggaatggcaaaccattctctgtgaacctaagtcttgccgttggtcttagtggctggcttccatgtgccaggaccttgaagaacagaattgaagcctcaccagagtgttcacaaaaggcttcatcaatacctcttttgctctgtcatggaaaagctgatgatgtggttgcctacaagcacggcgagagatctgctggtgccttgaaggcaaatggcttttccaatgtgctcttcaagtcatacaatagtcttgggcactacac

SEQ ID NO: 72827 - DNA, 430 bp, Zea mays
  Clone ID: LIB3078-015-Q1-K1-B5
gcgtagacaaaggtcggagttccaatcaaaaatcaaagacaccctttacgtggccatgaaggctaagccagagctcgttccatcgttgatgaccatggcactgaatgatgccatgacatacgacaagaccacaaaaactggaggcgcaaatggatctatcaggctagaaacaagcagacctgagaacagtgggctctcttccgcgttggatttgctgactgaagccaaaaaggagatcgattccttttccaagggaggtcccatttcgtttgcagatctgatccagtttgcagcacaatcagcactgaagagatcgtttcttgacgctgacattgccaaatgtggtggaaatgaagagaagggaagaacactgtactctgcatatggttcaaatgggcagtggggtctggtcgatagaacgttcgggaga

SEQ ID NO: 72828 - DNA, 393 bp, Zea mays
  Clone ID: LIB3078-015-Q1-K1-B6
acgaagcattagtacaatcttacgagatactcatgctgctataatacacaacgaccaagccattgtcaaggacactaatccagtcatggccaacggaagtcgtactgtcatcacagcgcacaacccatctgccatgacagggcacgatggatcatgtatgaaatgcactcctgtcacaggtaggaaccgcaccagcgtaacagcgaagatgcgagacagagagacaaagactgtaggcaaccgagagctgatgactgcagacaagcagccagtacagaactagcaaaacgagccagaaaaggactgccagaacgccatgatgacacctgtggagtacatcatgatgacacgcatgtcctacatcatcatcatcctcatgatcaccttcttcaa

SEQ ID NO: 72829 - DNA, 421 bp, Zea mays
  unsure at all n locations
  Clone ID: LIB3078-015-Q1-K1-B7
cccacgcgtccgcccacgcgtccgcctacgcgtccgaaccccagcgccatggacatgagctacgcgctctgcacctcctccggcaccgtcgtgcaggacggcgcctacgggtaccagaacctcttcgacaccaccgtcgacgccttctacgtcgccatgggcaagaacggcggctccggcgtgccgctcgtggtgtcggagagcgggtggccgtccggcggcggcgtccaggccacgccggccaacgcgagggtgtacaaccagtacctcatcaaccacgtcggacgcgggacgccgtgccacccgggcgccatcgagacctacctcttctncatgttcaacgagaaccagaaggagagcggcgtggagcataactgggggctcttctaccccaacatgcagcacgtctaccccatcagct

SEQ ID NO: 72830 - DNA, 211 bp, Zea mays
  Clone ID: LIB3078-015-Q1-K1-B8
agcgttcgtaagcttaaacctcatgtgagactctaacaagtgatcacctatgactgtgggaccaaaaaagcttatatctgcagcttatccatgctacaattattacttctattaagaaaaagcgggctcttttaaggatcaatttacgtcctcacaaaacgagaattgcatgtcaaaagggtacccaatttgattaaaaagtcgacctttt

SEQ ID NO: 72831 - DNA, 414 bp, Zea mays
  Clone ID: LIB3078-015-Q1-K1-B9
ttgagttctcctctgagcagatactgaagctaacaagggaaacaaggaagatgcttccagacatcaccttatcagtaacagttcctcacacacttagtttgccagatcagatgagactagcagagctactcgaagaggaaggagctgatataatccaaaccgagggtgggaaatgttctagcccgacaaaacctggagtgcttggattgattgaaaaggcaacaccaacactcgccgcagcatactccatctctcgggctgttagtattccagtgatgtgctcgtcagggttaagctcggtgactgcaccaatggcagtaactgcaggagctgctggagttggagtcggttctgctattaacaaactcaacgacgttgtggcaatgatcgctgaggtgagaagcattgcgcaag

SEQ ID NO: 72832 - DNA, 362 bp, Zea mays
  Clone ID: LIB3078-015-Q1-K1-C1
ggacccaagcgttctggatacagaggatcataatgagtgccgggaacatgccgatcggcctgaacagatagttgagctagggaaggatatatactgcatgccactacatcctgtgcaaaaattaactgaatctctcagacatcatagtgccatgaatggatactacagatcacttatcctgaagcaatagatatgcatgatcaatatgaaagaggtagctatcgaaggtgcagcaagatccacatcgaatctgaatggtaccgatgcaaccttttatacccattgtggtcatacgatgagtaccttagtgaaacatgcataggccgacaccgcagttaatgaggccgcagctgcaacacaac

SEQ ID NO: 72833 - DNA, 393 bp, Zea mays
  Clone ID: LIB3078-015-Q1-K1-C10
gaaagcatgggtgaattggagtatctacagcctgccattggtattgtgttgggcttcatggggacaaagatgatctttgacttttttggttatcatataccaacagaagcttcgcttgcaattgtaactacatgtcttagtggaggcgtcatattaagtcttaggaaagcatcaaaagagaagggggacaagtagactgatgcaacaacacatgcaggcataggaatccagcttgctccatatttttggcagatagtcaagttacaaaaataattataataaacacttaaaagccaggtaaacatagtgttttcactaaactaattacttgtataaaaaaatctaacctgacagaatatcttttgatcagtatatgtagtcttagctaatgcc

SEQ ID NO: 72834 - DNA, 419 bp, Zea mays
  Clone ID: LIB3078-015-Q1-K1-C11
cccacgcgtccgcggacgcgtgggtgctattggaaaggatgttcaggccatgaaggctgtcgttggagaggaggcactctcgtctgaggatctgctttacttagagttccttgacaagtttgagaggaagtttgtgacacaaggagcatatgacacacggaacatcttccagtcactcgatcttgcatggacattgcttcggatcttccctcgcgaacttctccaccgtattccagcaaagaccttggaccagtactatagcagagatgcttgccactgaatcactgatcgttgatcagtgttccaatattttggcaagtgcagctttgaataaattgaacagattggcctcgtggccattttcctgtatttatctgtagtcaggtccaattcttttctgttggtgagcgcaagttatt

SEQ ID NO: 72835 - DNA, 426 bp, Zea mays
  Clone ID: LIB3078-015-Q1-K1-A7
gcacagcatcatctgaccgcactgtattagatttggaatgtcgatggcttcgagttgggaagaactttagtcggccatcatcgttgggtttgggactgtgtcttctccgtcgatggtgcttatcttataacagcatcttctgacactacagcgaggctatggacgatgtctactggagaggccatcagggtgtaccagggtcatcacaaggccaccgtgtgctgctctctccatgatggagcagaatcagcgccctcataagcatgttgtgactgcttttctgtacatacgttagattgcagaactctttcactcttgtaaacttgagacctagcaagttgttaacgcaagcctctggggttgcgtacaaataatttgcgtgctgttggtggatgtttaaacctgctatgttttatggaatgaatg

SEQ ID NO: 72836 - DNA, 437 bp, Zea mays
  Clone ID: LIB3078-014-Q1-K1-H10
cccacgcgtccgcgcaggtgaagacggccgccacggacgggtacgacgccgggcaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtctccggcaactccatcggcaaggggttccaaggtggcatcaagaggcacaacttcaagcgcgggctgatgacgcacggttccaagagccaccggcagctgggttccatcggagccgggacgacgccgggccgcgtgtacaaggggaagaagatgcccgggaggatgggaggaaccaagaccaagatcaggaagctcaag

SEQ ID NO: 72837 - DNA, 425 bp, Zea mays
  Clone ID: LIB3078-014-Q1-K1-H11
aggaagactaaattccctgtctcacatttggcagcagggaccccacgtggcattgttgacgacagtcaacgccaacgccccaaataaaacgctagtaaggagggcagccatccctgcccctgtccctgctggttgccaagttaggaaggatgccatgaactcaaaaggtaaccaaatgacccctggcaatgccggttctggagtaccagccagcagtcagactagcgtggctgcacaagctgccagcaaagcaaatctaccatccagcagcagccaggccaagcccaataacatggtggtgaatggtggtaacaggctagtggttaatccaccgtccagcagccaagctagtgcggccgtgaacgacgctaacagggctgcgacaccacagtccagcaaccctgtcaacggtgccaacaacagag

SEQ ID NO: 72838 - DNA, 361 bp, Zea mays
  Clone ID: LIB3078-014-Q1-K1-H12
cccacgcgtacggaaacagtgaaatcaggtgacgatggagaagtagatgccattcattagctactggagatctggtcagatgacgagtcatgtggtcataaaactctgtattcggtcggatttgacgatgtgaaagccagcttactggccacaacggctgacgaggaggctgcattgagtcctacattgcacatggtgcacctagtgtggtattcaactgacaagagacgtgtcacggtcaacttacaagctgattgacatgccggcgcctgtaaaaacgtagcggatagcatgccacggagaatgcctgagaacctatctcaactggatttgtgatcagatcatatgagtagagaaatga

SEQ ID NO: 72839 - DNA, 379 bp, Zea mays
  Clone ID: LIB3078-014-Q1-K1-H2
atttccagcgaggctctagctggtactcgggcaagagggaagacaagggcagatgagtttcaaatcggtcaggatttgcttctaagtagcaaagaggacatcgaattcactatagtacgggacagcatcaagaacaagctggagatgatctgtgatgaggtggttgtccatcccagcaaggctctgcggaaacttccaagagtccagcatctgtcagcgcagttagctgcgcgaataaggaacgaagatgatgagtttgagattctaaacaccctccatccgagtccagctgtttgtggcttgcccactgaagaggcacgccaattcatacgggattgtgaaatttttgaccgtggaatgtatgccggtcctggtggct

SEQ ID NO: 72840 - DNA, 345 bp, Zea mays
  Clone ID: LIB3078-014-Q1-K1-H4
cccacgcgtccgcccacgcgtccggtcagagtgaagttcttggatgaccagaaccgtctcatcatgaggaacgtcaagggccctgttcgtgagggtgacatcctcaccctgctcgagtctgagagggaggccaggaggctgcgctgaagccctggtggccttggatgtaattctgttaattttgttctatgtttgtcgaacttgccgtgtgaccttcacaacatctgctttgagatttactcagcctggattgcagttttattttatgttcctgctggaaagtgacttgccgagacatagttatcattggttatctataatagctcaatcgacgcgtgcaatctg

SEQ ID NO: 72841 - DNA, 416 bp, Zea mays
  Clone ID: LIB3078-014-Q1-K1-H5
gcggctccgttcaccaagagaggtctgctgctcaagttcctgctgctgggcggcggctcacttctggcctacgtcagcgcgtcggcgtcaccggacctcctgccgatcaagaagggacctcaggagccgccgcagccgggcccgcgcggcaagatctaagctcagcttctccatttgcatggtctagtagcttgctttgtactgctagcgccggtcgatccgtcgcaatcgtcatggatcatctctctatcttgttgttacgctgttcataatttggtatatttgccattccgctattgtgtactctttggcatacatacaataattaaaatggcgttgcgtggctctcatataattaaccttcacataacctgaaaactcaagtacgtatagtatgggccactttattgtggatt

SEQ ID NO: 72842 - DNA, 368 bp, Zea mays
  Clone ID: LIB3078-014-Q1-K1-H6
ccctcttccaccaaaaattgacccaagtgttaccatgatgactgtggaggaaaagccagatgtgacgtacaatgatgttggtggctgcaaggagcagattgagaaaatgcgtgaagttgttgaacttcctatgcttcacccagaaaagtttgtcaagctcggtattgatcctccaaaaggcgtcctttgctatggcccacctggcactggcaagacacttcttgcaagagctgtagcaaatcggactgatgcttgtttcatccgtgtaattggaagtgagttagttcagaagtatgtcggcgaaggtgctcggatggtcagggaacttttccagatggcccgctcaaagaaagcgtgcattggattct

SEQ ID NO: 72843 - DNA, 415 bp, Zea mays
  Clone ID: LIB3078-014-Q1-K1-H7
cattttaatccaaacaatctgacacacggtgcaccagaagactaagtccgacatgcgggtgacctgggaaacattggtgcaaatgctgagggcatagccgaggcaaccattgttgatacccagattcctttgactggcccaaattcagttgttgggagagcatttgtggttcatgagcttgaagatgatttggggaaagggggccatgagctcagactctctactggaaatgctggtggaagactggcatgtggtgttgttggcctgactccattgtaggttgctcgccgggtgcccgggttgcagttgcagctacgctggtacattcttgccgtggtggacttttggcttgaatccagttattgggacagtgacctttattgtattacttggattcatttcatgcatgtggtat

SEQ ID NO: 72844 - DNA, 261 bp, Zea mays
  Clone ID: LIB3078-014-Q1-K1-H9
gactcgcgtgcttaagcactcgactggcctcatggcgccggccgccgccaaggggatcggagcaagaggcattaacacagggcactggagcagcacatgcaagctgactctggacacttccgaccgcacgtggaaaacaagctagatggcgagcatattaaggaccctgaggacacatgcagctggctgtactgcttatgagaagcgatcacgggtgctgatgacagttggcaaggagctgatgcgctaaggcactggata

SEQ ID NO: 72845 - DNA, 349 bp, Zea mays
  unsure at all n locations
  Clone ID: LIB3078-015-Q1-K1-A1
cagcaatccacacaagcacttcgacgtcacacgggcgctgcgcacagacacaccaagcgtcggcaccaatggcttactaccaggaggtggactactgctcggaggaggtgaggtcggtggccccggccggcttcggccgccacggcggcggcgtccagcagcacgtcgtcaaggagaagttcgaggaggtcgacacggtctcacgcgccggcgccaaccaccaccaccaccatggtcaccacggcggccacggcttcgtggtgcgcgagaccagggtcgaagaggacatcaacacctgcaccggcgaggtccacgagcgcagggagagcttnctcgccagggctaactg

SEQ ID NO: 72846 - DNA, 381 bp, Zea mays
  Clone ID: LIB3078-015-Q1-K1-A10
cccacgcgtccgggcctgccaggtcgcgctcatgggcgccgtcgagggctaccgcatcgacggcggcccgctcggcgaggtcgtcgacccgctctaccccggcggcagcttcgacccgctcggcctcgccgacgaccccgaggccttcgccgagctcaaggtcaaggagctcaagaacggccggctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggcgccgccggtgacctttaggtgtccggatgcatgtgagcgcacgctg

SEQ ID NO: 72847 - DNA, 351 bp, Zea mays
  Clone ID: LIB3078-015-Q1-K1-A11
gcgtcaccaagagcaacccggagaccggctaggtcatcggcgtcttcgagagcgtgcaggcgtccgacaccgacctcggggccaaggcgcccaaggatgtcaagatccagggggtctggtacgctcagctcgagtgattcgagtgtctaactgctaggtgtccgaccggcgtcatggatcttgggaaggtgtatgtataccatggaaaactttggagagcataggaggaatcgtgtatgtaatgtacttgttaatgcaaattcaggctgtcgcttttttactccaaaaaaaatgctaacagatctgaaggtaaacaaattgaaggtgatatgaataatcttcaaaagagat

SEQ ID NO: 72848 - DNA, 371 bp, Zea mays
  Clone ID: LIB3078-015-Q1-K1-A12
cccacgcgtccgcggacgcgtggggcacccggttccgcgtgcctttccgcacctactctggcgggtctcgccagccagtctagggtttcggtcccggcgtgcttatccgcccccgccggccatgtcgaagcaaggagggaaggccaagccgctgaaagcgcccaaggcccacaagaaggagtacgacgagacggatcttgcatatctgcagaagaagaaagatgaggaaaaagcactgaaggagcttaaggccaaggcacagaaaggcgcgattgggggctcgggtctgaagaaaagtggaaagaaacgagactggtcacccgtctccaatacctagaggatgataaggcagctgtctatctgtgctgcgc

SEQ ID NO: 72849 - DNA, 413 bp, Zea mays
  Clone ID: LIB3078-015-Q1-K1-A2
ggggaatgtcacaattaaactttgggatcttggtgggcaacgaagattccgcactatgtgggagcgctactgccgtggagtttctgctattctatatgttgtggacgctgctgaccgagatagcatcccaatagcgaaaagtgaattgcttgatctgctgacaaaacagtctttaactgggattcccttgcttgtccttggcaacaaaattgacaagtcagaagcgctttctaagcacgcattggttgatcaacttggactggaattgataaaggaccgcgaagcttgttgctacatgatctcctgtaaggattctgcgaacatagacgttgtcatcgactggcttatcaagcactctagaacagctaaatacgctttatgggtggtcggatcacttgatgcatggtaatttg

SEQ ID NO: 72850 - DNA, 399 bp, Zea mays
  Clone ID: LIB3078-015-Q1-K1-A4
cccacgcgtccgcggacgcgtggggcgccactgtccagtgcgcgcgtcaagcttgcggagctagccgccatggcctccctcgccggcgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcgggggctca

SEQ ID NO: 72851 - DNA, 365 bp, Zea mays
  Clone ID: LIB3078-015-Q1-K1-A5
cccacgcgtccggcaccagaaaggatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgacctccacggcgccgactgccacgcgcagctccacagcgccgccaataacgcgccttgccctgggcaggagccgtccaggatcgcgcccatgtc

SEQ ID NO: 72852 - DNA, 274 bp, Zea mays
  Clone ID: LIB3078-015-Q1-K1-A6
gatttatcataatttcaggaaaaatatgaacaaagcagactagaagctatatggatagactactcatgaatagtaacattgtatgaagcagctaagtgcaagtgacaacttatttaatataggatctcttaagaagtgtatttagaaggttatttaagaaaaaaatagacgagctcttagcgaatagcttatctctaccagacttcgtacacattgtctattaactgtatttataatctagtggttcagagttatattatacaatatcttagtt

SEQ ID NO: 72853 - DNA, 379 bp, Zea mays
  unsure at all n locations
  Clone ID: LIB3078-014-Q1-K1-H1
cggacgcgtgggcggacgcgtgggcacatgggcaagcagatccaggatcagaagaagttacttgaggagtgcttggcgagatacttgaccgaatcagcccggctcttagatgaaagccaggtggtcaccgaagtgaatgttatggtgcagaattgtgttggccttgaactccaggattcgtcttactatctcgctcccagatgggtggcgatcttccgtcgtatttacaactggaggctagcaaagctctctaccggaaagttgtcagaagcttatgttctgactcagcacctgtatcaggctcctacagcagctggctcaaatggtaccacacaagggcttactgctaacaccgncagcaacgatgcttgggatcaca

SEQ ID NO: 72854 - DNA, 364 bp, Zea mays
  Clone ID: LIB3078-014-Q1-K1-F4
ccgcccccgcaccacggccagaaccctagtcacttccccgccgcccactccatggaggacgacgccatctcgacgctcatggacatcgacgactcgccgctcagcgctgcgggggccgggttcctcgacgaggaggacggggaaggcgagatgttcttcgccccgcaccgcgcggcccgcggcggcgctggcgatgcccgcgggcccctccccttttccgggttcttcaacagcttcgacggcgccgatttcgacgacgacgacctcgcctgagggaactgccgcccggttcggtaacggatgttgttcgtggatcgcgaatcgtgttatgtcgataccgtgatggggtctcttaattagcgca

SEQ ID NO: 72855 - DNA, 414 bp, Zea mays
  Clone ID: LIB3078-014-Q1-K1-F5
cccacgcgtccggggatcggcaagcgtggggtgtgctacctcagccgcgtcccgccgcacatgaacccgtcgcacatccgccagatgctttccaagtacggcgaggtgctcaggatttacctcgtgcccgaaggtcaaggtcatcgcaagcatactagtgttaaagcgaaggcttactcggaagggtggattgaatttgcaaagaagagtgttgccaagagagtggctaatctgcttaatggtgaacaaataggcggtaagaagagatctccattttattatgacatttggaacattaaatacctcaggaagtttaaatgggatgatctggttggtgaaatggctgagaaaactcatatcagagagcagaaattaaccttggagatagcagcagcaaagaaacaacgcgatcac

SEQ ID NO: 72856 - DNA, 365 bp, Zea mays
  Clone ID: LIB3078-014-Q1-K1-F6
cggacgcgtgggggcggttcctgtgccctggcacccccgggctcgacgaccctctctccaacccgttctcggaggccgccggcgggagcgcggcgcgcgtcgccgccgagcgcgtgctcgtctgcgtcgccgagaaggacgacctcagggacaggggcgtctggtactacgagagcctcaaggccagcggctaccctggcgaggtggagctgctcgagtccatgggcgagggccacgtcttctactgcatgaacccgcgctgcgacagggcgcgggagatggaggagcgcgtcctcggcttcctgcgcaagtgagcgagcgacggagcgcgcgccttgctacgcgattgagatggaataatttca

SEQ ID NO: 72857 - DNA, 369 bp, Zea mays
  Clone ID: LIB3078-014-Q1-K1-F8
aacccaaccaaacccgcacgacacgacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctggcagttcccctac

SEQ ID NO: 72858 - DNA, 332 bp, Zea mays
  Clone ID: LIB3078-014-Q1-K1-F9
attttgcttctgttccactatgccagagggaggtctacccaaattatggtaaatgagaagaactacaaacgtcaaccagcacagcacgtggtcaataggcgaaggcatcaaagggggttgtgctgggaagcgttggtcaaaaggtgccctttactattttctaattcaagtgcagtggtttctttattttttggtaagaataatatgttggtttcttgtattgctgaggcaaatagacacgtttagtggtagttctgtaagtttgttaatgtactgactttaacatgagatggattctgcatttttgtatagatcaaatagctgccgcatgc

SEQ ID NO: 72859 - DNA, 334 bp, Zea mays
  Clone ID: LIB3078-014-Q1-K1-G1
ccgggcgctttcatagtcagccatggtaatggtatcgcatcgtagccactaaagtaagggagggccccaggaaagaagcgctggttcgatgaagctgcataaataaagccagcacgcaaaccagcagcgttcagaggaaacccatttacgtatatgcccttgtcccggttcctttccccatccccaactccattatttgcttgatccttgagaagagagaggaagacgagagctagaagcgaaggagaaaagcagttcttcagctaggcaggaaggcacaggaaggaggagatggcgtcaaagaggattcagaaggagctcaaggatctgcaga

SEQ ID NO: 72860 - DNA, 436 bp, Zea mays
  Clone ID: LIB3078-014-Q1-K1-G10
cccacgcgtccgccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctcttcgaccacgtcgccgaccccgtcgccaacaacgcctgggcatacgccacgaacttcgtccccggcaactaactgactgagcaacgccgtacatgtgtactaccatcagatccatccattcgttcgtccgtccgtcgagtg

SEQ ID NO: 72861 - DNA, 428 bp, Zea mays
  Clone ID: LIB3078-014-Q1-K1-G11
ctcctcctcctccttcccggccgccgcgcgagcttggtgggttagtgtctctgcttcgcggagacctgtgagaggagccatcatcatggccgccgttgagactgttgtcctcaaggttgctatgtcatgcgagggttgcgcgggggcggtcagaagagtgctctccaagatggaaggagttgaaaccttcgacatagacctcaaggagcagaaggtgacagtcaaaggcaatgtcaagcctgaggacgtcttccagacggtttccaagtcggggaagaggacctcctactgggagggcgaagccacggccccggacgctgcggcggcttctggagccgaagcagctcccggcaccgcggcagaagcgcctcctgctgctgctccggcggcgccagagatcaccccagccaaagctgacgcctgatcgt

SEQ ID NO: 72862 - DNA, 436 bp, Zea mays
  Clone ID: LIB3078-014-Q1-K1-G12
gctagatgctggaatgaaggagctcgcctcttcgctgatcgactcagagtcgctcctcgtgttcggaaggggttacaactacgccaccgcgctggagggcgccctgaaggtcaaggaggtggcgctgatgcacagcgaaggcatgctcgctggcgagatgaagcacgggccgctggccctcgtggacgagaacctccccatcattgtcattgcgactcgcgacgcgtgcttcagcaagcagcagtcggtgatccagcagctcctctcgcgtagggggcgcctgatagtgatgtgctccaggggagatgcctcggctgtgtgccctagcggtgggtcgtgcagagtcattgaagttccacaggttgcagactgtctccagccagtgatcaacataattccattacagttgctcgcgtaccatctgactgttctccgg

SEQ ID NO: 72863 - DNA, 363 bp, Zea mays
  Clone ID: LIB3078-014-Q1-K1-G2
cccacgcgtccggctgaggttttcaagaaagctggaacttatgatcccaagcggcttcttggagtgacaacactcgatgttgcgagggctaacacctttgtggccgaagtgcttggagttgatccaagagatgtcagtgttcctgttgttggagggcatgctgggataactatattgcccctcctctcccaggttacacctccgagctcattcactcaggatgaaaccagatatttgacagaccgcatacagaatggtggcacagaagttgtggaggcaaaggctggatcaggctccgcgactctgtcaatggcttttgctgctgctaaattcgctgacgcatgcttgcgagctatgcggggc

SEQ ID NO: 72864 - DNA, 378 bp, Zea mays
  Clone ID: LIB3078-014-Q1-K1-G3
gtcacttccattttctcaataccttaagcaaggaccaatgtctcaagcccagcccgctcgttcccaagcccagtggaaacacgttaaatttcaggataaccaagctaatgccatgaaggaaccaggaaccggtgggtatggctatgggacgaaaaatgacaagaataaggatgtggatacaatagcttcggacttcatcaagctgaagcacaaggcttgggcactccagaagagcacaaccatgtaccaaccttctacctaaaggtgtcaatagttcaagaagttgatactatatacttatgcttgtctctgtatagtctataagtcctaattcaaataacaggtgctgcttgcagccttggatatttgcggatgccg

SEQ ID NO: 72865 - DNA, 365 bp, Zea mays
  Clone ID: LIB3078-014-Q1-K1-G4
ggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccaaggcgcgggtgaagacatgggcggcgctggcggcatggacgaggacgcccc

SEQ ID NO: 72866 - DNA, 379 bp, Zea mays
  Clone ID: LIB3078-014-Q1-K1-G5
cggacgcgtgggccgccgcggaacacaacaccgcaccacactacccagcggaatccgcccacccgcacccggagcagaggagatatgtcgcaggggaagggaggagcgtcgaggaaggaggaggtggtcaccagggagtacaccatcaacctccacaagcgcctccacggctgcacattcaagaagaaggcacccaacgccatcaaggagatcaggaagtttgcgcagaaggccatgggcaccacggacattaggattgatgtgaagctcaacaagcacatctggagcagcgggatcaggagcgtgccgcggagggttcgtgtgaggatcgcccgcaagaggaacgaccaggaagatgccaaggaagagctctacttcc

SEQ ID NO: 72867 - DNA, 395 bp, Zea mays
  Clone ID: LIB3078-014-Q1-K1-G6
cccacgcgtccggaagcattggcacgcaaaccatgtgatcctttgatagtggctacttttgcactagccttttacctgggaggtgatatgtctttggcagtggatatcggaaaatcaatcaaccgacaacatgatactggctttcgggagctcttagaacccaaagtctggactgataagcatttggcaggtgaagtacaaagctttgctgcattgatgaagcaggcattaactgaaatgactgatgagtatcatgtcgcaaatgctatggcaaaaatccctcaagcaccttcctcagatcttgtatttataccactacaagcctacctgaaagttctcaaatttatcgagtgtgttcaatatggcaaaaaggaacgtggccatgaaccaaaacg

SEQ ID NO: 72868 - DNA, 422 bp, Zea mays
  Clone ID: LIB3078-014-Q1-K1-G7
tgcttctgctggacgtcacccctctgtccctgggtctggagactgctggaggagttatgacagtgctgatcccgaggaacaccaccatccccaccaagaaggagcaggtattctccacctactcggacaaccagcccggtgtcctgatccaggtctacgagggtgagaggacccggacacgcgacaacaacctgctgggcaagttcgagctctccggcatcccccctgcaccccgtggtgtgccacagatcaccgtgtgctttgacatcgacgccaacggcatcctgaacgtgtctgccgaggacaagacaacggggcagaagaacaagatcacaatcaccaacgacaagggccgtctctccaaggaggagatcgagaagatggttcaggacgctgagaagtacaagtctgaagatgaagag

SEQ ID NO: 72869 - DNA, 365 bp, Zea mays
  Clone ID: LIB3078-014-Q1-K1-G8
cctgtatccctctccccatggctgctggactgggagcgcgcccctccgccaccttcgtggccggaaggttccggcctctcgctgcccctctccgccccgtccgctccggcaagttcgttgtgccaaagcgatgcttcattgtatcaagcaggcttgcatgggtggaagatgagcttatggagatacaaaagtcacaagagcaaagttcagtaaaatcaaagaaaaggccacctttgaggcgtggaaaggtctccccacaacttcctgtaccagggcacattccaagaccatcttatgttggtgcgaaaggattgcctgaactatgcaagggccaattacatgatgctcaaggaattactggaatg

SEQ ID NO: 72870 - DNA, 340 bp, Zea mays
  Clone ID: LIB3078-014-Q1-K1-F3
gtcaaggtgctcgaccaaaagttcggcatcatcaagggcaccatgaccaccacccactcctacaccggcgaccagaggctgctggacgcgagccaccgcgacctgcgccgcgcccgcgccgccgcgctcaacatcgtgcccacgtccaccggcgccgccaaggccgtctcgctggtgctccccaacctcaagggcaagctcaacgggatcgcgctccgggtgcccaccccgaacgtctccgtcgtcgacctcgtcgtgcaggtctccaagaagaccctcgccgaggaggtgaaccaagcgttccgcgacgccgcggccaacgagctcacgggcattctcg

SEQ ID NO: 72871 - DNA, 431 bp, Zea mays
  Clone ID: LIB3078-017-Q1-K1-D1
cccacgcgtccgctgcagcacctgtccgacccatggcacaacaccatcatccagaccctgtcgggttgagtcgacggtccatcaggtcatgtggtccgagctgaaaggccgagactcgaagacagttcgtgtgatgcgttcttaatcgactgagggctaaggaatgtgacgtactggtatatgtacattagttgaagcggaggctataaagggtgtagagattgtttcatcagtgtatatcatctgtcccgatgggttttgttttgtgcttttcacgattcattgtggaagcacatgtattattagtacaagaattgctagtagatatataggcttataattaagcacgacttctaaaacctcaacgtacgtatgtgaaagccccatatgatggtaaacaaaaggaaaatacaacattacatttgtatatg

SEQ ID NO: 72872 - DNA, 403 bp, Zea mays
  unsure at all n locations
  Clone ID: LIB3078-017-Q1-K1-D10
cccacgcgtccgagcaagatgacgtcgtcgacggcgttcagccaactgttcccttccgccgctgcggtatcccccgtccctcgctgcgtctccctgcagctcttctgcgccagcggtggagttgtccctggatggaggagaagatgccgccgcatggccatggtgcgcgcggccaccgcggatgctgcggcgcccgcctacacctncgattccctcatcctctacttcaaggcggagggcaccatggaggagagggccattcccaagatcacagaatctcttgagggtatggagggagtcaaggacctggaggtgctcattgaagaaggcatcggaagtgttgtgttaacaaaggagacaactgtgcaagctactggagtagcctcgaacctggtggaagcta

SEQ ID NO: 72873 - DNA, 373 bp, Zea mays
  unsure at all n locations
  Clone ID: LIB3078-017-Q1-K1-D11
atcctgaaagacatgataataccgaagacagtcggaaacattttccagcaccagccccgctagatgatcagggcttgcgaagggaccctagacattttgagagagctttaggtagacctgatggtttccttgattcagtacctggaaggccttcatttgcaaaccacagaagtgcaggtttgcatgaggattttccaagaaagcaaaatgcaactgccagtcaccctgacttcctgtcacatggagcagaatttgatcatcacaaggctattggaatgcctaatttcagaaatccaagcccatttgctcaagggacaagtggccgtccttgtggccctnctaaacaccaagctggctctggtgacatgcattc

SEQ ID NO: 72874 - DNA, 439 bp, Zea mays
  unsure at all n locations
  Clone ID: LIB3078-017-Q1-K1-D2
cccacgcgtccggtgaccttctgccacggctagagcaagtaagacggatgcagcgggaggaggggaaggtttctgacaaggctagttcatcgtgggcttctgaggcggtagctacaatggagatgacacactcgaagctcttccccttcttcatgactggtctccttccccaggaggccatgcaatacttggacctagtgtgccgatgcaccaagaacacgcgccatctggtctccatgctcagatctcttgcagagcgtctggaagatgcgaacccgtcaattatacacaacaacccaaccaaactgtatgagcacctncttgtaaagtccccataagcctcaaactgctctgcgcagcgatgcggtgctaacctttacttttcctgtcagtagtgcagcttatgtatttcgggttatttgaacgattgtgaaagcgt

SEQ ID NO: 72875 - DNA, 432 bp, Zea mays
  Clone ID: LIB3078-017-Q1-K1-D3
cggacgcgtgggcaagcatcggcattgcgatgaggctcatggatatgtccggaaggaggtttctcctcctcgcgacgatcgcagtcctaatagtcgcgctactcgtcctggtggtgtccaacatcgtggacgtgggggacgtggcgcacgcggcgctctccacggccagcgtcatagtctacttctgcttcttcgtcatggggttcgggcccgtccccaacatcctctgcgcagagatcttccccaccacggtccgcggtgtctgcatcgccatctgcgccctggccttctggctcggtgacatcatcgtgacgtacactctccccgtgatgctgaacgtcgtcgggctcgccggcgtctttggggtgtacgccgtcgtgtgcgtcctagccctcgcgttcgtgttcgtcaaggtgcccgagacgaagggca

SEQ ID NO: 72876 - DNA, 410 bp, Zea mays
  Clone ID: LIB3078-017-Q1-K1-D5
gccagatgcgtatccttacaaatccccatcgattggtttcatcaataagatatatcgcccaaatgtcgatgaaatgtctggttcagtctgtttggatgtcatcaaccagacatggagcccaatgtttgatcttgttaatgtgttcgaggtcttccttccacaacttctgttatatcctaatccttctgatccattaaatggagatgcagctgcgttgatgatgcgtgatcgccctgcttatgaacaaaaggtgaaagagtactgtgaaaaatacgccaaaccagaggatgctggtgtcagcccagaagacgagtccagtgacgaagagctgagtgaagaggaaaatgactcgggtgatgaggagataatgggcaaaccagacacatagtcgagttggaacctagatctgt

SEQ ID NO: 72877 - DNA, 233 bp, Zea mays
  unsure at all n locations
  Clone ID: LIB3078-017-Q1-K1-D6
caaccgagcaccgncatcgagcaacagtgaccgtgagccaagcaggggaacaaaggatcagaaatggctatgcaggccgcaaggaggctagcgtctttgaaactccaacgacgcctactccttccctctcaggccgagtccccaagcataagcattccaaccgcaacggcggcggcagccttccttcaattccatgccaccagctttgggtacaagcaggttcccaaaaaggt

SEQ ID NO: 72878 - DNA, 412 bp, Zea mays
  Clone ID: LIB3078-017-Q1-K1-D7
gttgagagagagagagagggatcgagagcgcggcggaggcgatggcgagcggagggaagggactcaacgcgactggggagttcttccggcggagggacgagtggaggaggcaccctatggcggggaaccagctgcgccacgccacacccgggctcggcatcgccatcgtcgccttcgggatctacctcgtcggcgaggccgcctacaaccgcctctaccgcccctccggcgacaaccaccactagatcgccggcaggatccgtgactcggtcaagaagctggagccaactttaccaagcactggtgctgttgatgtttttacagttttgagctcataaggtcagccatgaccatattgtaatctgtgaccaggtagacttgcccactggtccgtccaactattgtcttggga

SEQ ID NO: 72879 - DNA, 391 bp, Zea mays
  Clone ID: LIB3078-017-Q1-K1-D8
tgttaagagatagataaaggcaccgctatcacggcgaacgcgacaacaatccaaagggtcggactcaacgctactggggacttctatcctcgcatgaacgaatgttggaggcaccctattgcatggaaccaactgctactcgccacactatggctaagcatcgccatcgtcgccttacctatctatctactcgatgacgccggctacaaccacctgtaccgtccctacgacgacaaccaccactagatcgcctgcaggatcagatactcggccaagaacctcgacccaactctacatagcactgctgctgctaataatcatacagtttaagatctcatatgagttagccatgaccatatatgtaatctgataccatatactactatgccca

SEQ ID NO: 72880 - DNA, 322 bp, Zea mays
  Clone ID: LIB3078-017-Q1-K1-D9
actcattcgatgctgaaatacattataataccgagttcagactctatcattgcgtgcacctttcccgctagattatcacggcttgcgagaggaccctatacatttatagagagctatacgtacacctgactgtttccttgattcagtacctgtaaggccttcatttgcaaaccacaaaattgctggtctatattagaattttccaataaagcaacattcaactgtcattcaccctgacttcctgtcacatagaacaaaatgtgatcataacagccctatacgtatgcctaattacaatagtttcatcccatttgctcaacgt

SEQ ID NO: 72881 - DNA, 432 bp, Zea mays
  unsure at all n locations
  Clone ID: LIB3078-017-Q1-K1-E1
cggacgcgtgggcgcggcgcggcgcggcgcggcgggcttcgctcgtcgaggctgtaagtctagggtggcgacctgcactcgctacaacccgcatctctccgtccccggcgacgactgcgtgagcagccgcagcactactaagagcggacagcggactatggaggtggaggccatccgagttcccttcgaagcttctcgaggataggtacgcggaagatagcttcgtcgtcaccattgcggcatcgtaaaagggcttagcaagaaagagctccaggaccttctgcaagagggcgccaagatgctggtgcgtgctgcaagtgctagaggaaatcggatcctcgggtcgggcgatgagatggaagggatgctgcagccacacgggcgttgagtcatgacgtgactgctcgcctggtgttagctntgtcaggaact

SEQ ID NO: 72882 - DNA, 377 bp, Zea mays
  unsure at all n locations
  Clone ID: LIB3078-017-Q1-K1-E10
gcaaagacaaatccttagaattattgtatatgcctnctcgccataatcagtgcaaaagcgtactcaagccagcgaatagatgagttgaacaataagagagcaacaagaaaaggattccttttttttatgatgacagaagaaggaatgcaacccaacatgacgttcatcatgtcacctcttccttatttaagggatgtttagtagcagatggaacgatcaaaagaactcaaatgccaatcatccatggagaaggatgtggtcatgtcatgtgagagcgacatttgctgcagcacaaaaatgatccgagcgggaccaaacatattctaggcagaatcgtatcaccaccagcaccgaagcttggatagcgcctggatata

SEQ ID NO: 72883 - DNA, 370 bp, Zea mays
  Clone ID: LIB3078-017-Q1-K1-E11
ttccctcctctagccactcatcctccctctctttgcctttaaccatgaactttaatatcaatcatctcgtcacaacttatatgactatctgactaacatccatgctcttactcatcaccatcttcccttcctatcatcaacacaactcaccatccacctcaccatcaaatcaaccttctatcgctatactctaatctcatcatacttgtcacacctcaccaatatctccataactatatcactccctcataacaagtattctctatattaaccttttcaccacaaaaatatcataccacacatatcaaccattctctctacctatatgcacatgaaactcaatctttcagctgatctctgaattccacat

SEQ ID NO: 72884 - DNA, 389 bp, Zea mays
  Clone ID: LIB3078-017-Q1-K1-E12
cgtcggcaagccggcggctggcacgagggacgtcttcggcgagggccgcatcaccatgcgcaagaccgtcgtgaagcccaagccggcggcgtccggcagcccatggtacggtgccgaccgcgtcctgtacctgggcccgctgtccggctcgcccccgagctacctgaccggcgagttccccggcgactacgggtgggacaccgcggggctgtcggcggacccggagaccttcgccaagaaccgcgagctggaggtgatccactgccgctgggccatgctcggcgcgctcgggtgcgtgttcccggagctgctcgcccgcaacggcgtcaagttcggcgaggcggtgtggttcaaggcgggctcccagatcttcagcgagggcgggctgg

SEQ ID NO: 72885 - DNA, 341 bp, Zea mays
  Clone ID: LIB3078-017-Q1-K1-E2
gggttccatatggtcttcccgtcttattagaacatatctattggactaccatgcatggaaagccgtcgtttcataaactgttgggactatacggcaccaatgaagctattgatgctggccggcaagctgacagcgaggtgaaagcttttcaaaacgatattccgagtggaagagaaaagaaaataaaagaaatagcaggttattttagaaaaaaatagttggcccatatgtaacgcgcggtagctttaagattattatgtccagcagcttattcatatattatacatatattcaaatttcactctgtgaatagtagtctaaaatacagtagtgttttgagt

SEQ ID NO: 72886 - DNA, 435 bp, Zea mays
  Clone ID: LIB3078-017-Q1-K1-E3
gtccaaccaagtcagcacccgcgcgcggcaaggagttcacgcccatggcgagcaccggcatggcgtcggccacctcgcgggtcatgctggccgcgggcgtgcccactgccagtagcggcagcggccgtgtcagcttcgcctcggcgcccaaccggcttggcaggaggcttgtggtccgggccgatgaggagtccccggcagagccggcgcccacggcggaaggggagggcgccgtggccaccaagcccaaggccgagaagccgccgccgatcgggcccaagaggggcgccaaggtgaagatcctgaggcgggagtcctactggtacaacgggatcggcaacgtcgtcaccgtcgatcaggatcctaacacccgttacccggtggtggtgcggttcaacaaggtgaactacgccggcgtgtctaccaacaactatg

SEQ ID NO: 72887 - DNA, 420 bp, Zea mays
  Clone ID: LIB3078-017-Q1-K1-C9
cccacgcgtccgcggacgcgtgggtggggagaaggcctgcgagatgctatcgccaaatgaagaacaagccataccccaagtccaggtactgccgtggtgtccctgaccccaagattaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaagggtgcctttggcaagcctcaaggcacctgtgctaaggtggacattggtc

SEQ ID NO: 72888 - DNA, 409 bp, Zea mays
  Clone ID: LIB3078-017-Q1-K1-B5
cggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtgattgatatgcttctggtcaacgcgacggaagagctgaacaacatagtcgaacatgcaaagcagcgccatcatgtgattgggcagtatgtgatcggccaagagggcctggtgcacgagctggggtcgaaggatcta

SEQ ID NO: 72889 - DNA, 329 bp, Zea mays
  unsure at all n locations
  Clone ID: LIB3078-017-Q1-K1-B6
ctagatccgttcatcctggtggttttgtgaggtcgaaagcggcgagcgaattagaagatgctggacaagctgtgggacgacgtggtggccgggcctcgcccggagacgggcctcgagaagctccgcaagggcaccaccgcccgcccgctcgtcatcaacaaagacgcggacggcggcagctacaagcgggcgcagtcgatgccgtcgaccccgacgacgccggtgacgccgtcgtcgtcgtcgtcgtcgacgacgccgcgcggcgccggcaacgtgtggcgcagcgtcttncacccggggagcaacctggccaccaagggcatgggcgc

SEQ ID NO: 72890 - DNA, 407 bp, Zea mays
  unsure at all n locations
  Clone ID: LIB3078-017-Q1-K1-B7
cccacgcgtccgcactcggcacgcaggctagcagcacagcagcagccagagccatggcctctcctcgctacgcttcgcttcctcggcgccgattcctcctcctcctcctgcaccctcgtccgtccccttccggcgcgcgagctcgcccgagatggcgaacgcgagatcgggtgtcgctgtgaacgatgagtgcatgctgaagtttggcgagctgcagtcgaagaggctgcaccgcttcataactttcaagatggacgacaagttcaaggagatagttgtggaccaggtcggggatcgcgctaccagctacgaagacttcacaaacagccctcctgagaatgactgccgatacgcgatctatganttcgacnnttgtactgcagaggatgtccagaagagcaggatct

SEQ ID NO: 72891 - DNA, 420 bp, Zea mays
  Clone ID: LIB3078-017-Q1-K1-B8
cccacgcgtccggatatctacaattccaccagagcaaagaagtcttgatcaaatccaagagtacgtgcgtaacaaacatagcctgcccaaagaagtgtttgacggaggattcattcttgagaagatcgatggcccaatgtcgactggcagtctggtgcttgcggacaccgacatcgatagcaaccccagcgtgagcttcaactacttccagcatccacaggacctcaggcgctgcgtctacgggattcagacgatcgagaggatactcaagacaaaccacttcgctaaccttaccgccaacggtgccgggtacccgatggaaacgctgctcaatctgagcgtgtcggctaacataaacctgatacccaagcacacggatgacaccacgtccttggagcagttctgcagggacacggtgac

SEQ ID NO: 72892 - DNA, 433 bp, Zea mays
  Clone ID: LIB3078-017-Q1-K1-B9
aaaaacacccaaaaaaccaccttcttttcctgcgttcccctgctcgatccccgacgagaattcgctcccgaacccatcgatctgctctccgcagtccgccgatccgtggatcgatccgtgcgcgggctcggtccgccccgggttccgatctggtcgccgactcgcctgaggagatgaacggcgccgggggcagccaccaccagcagcagcagaggctccggcagcagcagcagcaggcgctcctgatgcagcatgcgctgcagcagcagcagcagcagcagtaccagtccggcgtcctcgccgtcgcggcggcggcggccatgacccaggtcgtctccccggatcctcgcctctcgatctgctggtctgcgtgcgcattgggcagcagtaatgcgcgccgatctgcttgggagattttttttctttgctttga

SEQ ID NO: 72893 - DNA, 431 bp, Zea mays
  unsure at all n locations
  Clone ID: LIB3078-017-Q1-K1-C1
ggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcgtgacccagggcaccgtcgccgncggcttcatcagctccggctccaaca

SEQ ID NO: 72894 - DNA, 212 bp, Zea mays
  Clone ID: LIB3078-017-Q1-K1-C10
tcgcccacgcgttcgcttcagccgtcgtcgctcgtagcaagcaggagcagcaaggatgccgggtggccacgggctgcgctcgcggacgcgcgacctgttcgcgcgcccctttcgcaagaaaggctacattccggtcaacaactaacttcggacctaccagatcggggactacctcgacctcaaagggaaccgggccctccacaaagggattc

SEQ ID NO: 72895 - DNA, 232 bp, Zea mays
  Clone ID: LIB3078-017-Q1-K1-C11
agtccatctactgccgtcttgtccctgaccccaagattacgatctactatgttagcatgaatagaaagggtgttgatgagttcccctactgtgttcaccttgtctcttgggagaaggagaatgtctcctgtgactctcttgagactgcccttattgactgcaacaactacatgaccaattctgcaggaaatgatgccttccaccttcaccttccggttcaccccttgaatgt

SEQ ID NO: 72896 - DNA, 418 bp, Zea mays
  Clone ID: LIB3078-017-Q1-K1-C12
cgcaacttcctccttcccaagggcaaggctacacttctgaccccagaagtcctcaaggaaatgcagctggagcaggagagaatagaagctgagaagaagcgggtaaaagaagacgcgcaacaacttgctcgagtttttgaaaccattggcgctttcaaactccctcgcaaaggtggaaaaggaaaacagatctttgggagtgtcacggcacaggatgttgttgacataataaagtcacaacttaatagggatgtcgacaagaagctggtgacggttccagaaatccgtgaaatcggagagtatgttgcagagatcaagcttcacccagacgtgacagcgcgagtaaggctgaatgtctatgcgaaatgagctcaacagttacagaacctcgagtaatggactttggaagagcctgatg

SEQ ID NO: 72897 - DNA, 437 bp, Zea mays
  unsure at all n locations
  Clone ID: LIB3078-017-Q1-K1-C2
cgccttcttcgtccctgccggctccgggaacgccggcggcgggacctacgcgaaggagaagctgggcaacgacatcacggtggangcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgctgagaacaagttcatctgcccctgccacggatcccagtacaacaaccagggcaaggtggtccgtggaccggcgcctctgtcgctggccctggttcacgccgacgtcgacgacggcaaggtcctcttcgtcccgtgggtggagaccgacttcaggaccggcgaggacccatggtggaaggcatgaagatgatccg

SEQ ID NO: 72898 - DNA, 412 bp, Zea mays
  unsure at all n locations
  Clone ID: LIB3078-017-Q1-K1-C3
atcacgcgtccgatcaggtaccgacgatgctcgtggcgatgaccgatgagaaaacggatcccatggtaaagccttcgtgggggggtacatatgaagatcgctcgacagatcgatagacatcagctgatacgagatgtactacgagctgcatctcgagctcgagctggtatgccatctggaaggccctgtggaagaccgttcacgatcaggctgtcaggtccgattaaacgaccgggaaatcgatggtgacgacctgtgggacgactcggggcatgacttagggagcatcatgaggcgcataacgatcgacttgccgcangacctgcagcacatgggccgtgaccgtctatgtgaccctgtagctacgactgtagcgaggatgctgtatgacaactattgtgacgactattat

SEQ ID NO: 72899 - DNA, 355 bp, Zea mays
  unsure at all n locations
  Clone ID: LIB3078-017-Q1-K1-C4
nttaagtgtccgagcacgccttcgcttgaactatcaggctggtgatcttgagcacatgggctgatgcacgtcactagagcctgacctatatctatagtgtacggtttgaccacagggagcgtcacagcactaggcaactcaacaaaaatcctctagcttgctgatgcgaaactctgcatctaccatgtgagctagtctgtgtttaacagactgcctattgcagtcatgactctgaataacatacagactcactggtatctcacactgctgctgactagacctctgatgtctacgaagcgtgtgagacttccgtatatggacaagcttataaacctgtaatcaagatcctaacagc

SEQ ID NO: 72900 - DNA, 225 bp, Zea mays
  Clone ID: LIB3078-017-Q1-K1-C5
gatcttatcacatcaagtgagctactcctgacactttggtcaggctaatgatgccgtgcacaaggaccagcgatggcgaccaagggcatatgcttcctggcgctcgcatccgtgctacttgccgtaacttttgccgaatctgctctgaagccgcaagtgaagaagggcagctgcagttaaggtagcagcacatgcagccatcgctgaagctgacgctggaacctg

SEQ ID NO: 72901 - DNA, 380 bp, Zea mays
  unsure at all n locations
  Clone ID: LIB3078-017-Q1-K1-C6
cccacgcgtccgctcatggccaccgcctgccagctcgccgcgccgctcggcctcgcgccgttgccccgcggctgcgcctctgctggcgtcgtggccgtcgtccggtgcgctcggtcgtcaggctccaagatcccgagaggcgttgctgtcagggcgacgtccggcggcgagggcgccacggaggaggtgccggagattgtgaaggctgcgcaagacgcgtgggacaaagttgaggacaagtacgccgtggccaccatcggtgtcgctggcatcgtcgcgctctggacggtagtaggtgccatcaaggccatcgacaagcttcctcttctgcctggtgtccttgagatnngtggaattgngtatacagggtggttcacata

SEQ ID NO: 72902 - DNA, 405 bp, Zea mays
  unsure at all n locations
  Clone ID: LIB3078-017-Q1-K1-C7
gcccagatcgacgccgtgtacgccgccatgaaggccatggggcacacggacgtgggcgtccggatctcggagaccgggtggccgtccaggggcgacgaggacgagaccggggccacggtgcagaacgccgtcgcgtacaacggcaacctcatgcagagggtcgccatgagccaggggacgccgctcaagcccaacgtgcccgtcgacgtctacgtgttcgcgctcttcaacgagaacatgaagccagggcccacgtcggagcgcaactacgggctgttctaccccaacggctcgccggtgtacgcgctcagcgccggcttccgcggcggttcaggtccgggcgggtcgctcaacccgtactacacatncatgttctcctnctcgtccagatccggcgtgagcgcg

SEQ ID NO: 72903 - DNA, 441 bp, Zea mays
  Clone ID: LIB3078-017-Q1-K1-B4
cccacgcgtccggttgcatttgctgttgtgtgggctgtttttcgccagctccccttggcttggattgggcaagacattctgggtattgcattgatagttacagtcatccaaattgtgagagtacctaacctcaaggtgggttcggttcttcttggctgtgccttcctgtatgatatcttctgggtgtttatctccaagagatggtttcatgagagcgtgatgattgtggttgcgcgtggcgacaagaccgacgaggatggtgtgcccatgctgctaaaaatcccgcgcatgtttgatccatggggtggatacagcatcattggctttggtgatatccttcttcctggtcttttagttgctttctcgctaagatacgatttttctgcaaagaagggcttacggtctggttactttttgtgggcaatggtggcctatggctct

SEQ ID NO: 72904 - DNA, 393 bp, Zea mays
  Clone ID: LIB3078-017-Q1-K1-A11
gacagacttcatcgagagtgagttcctcgaggagcaggtggaagccataaacaagatcggcaagtatgtcgcccagctgaggagagtgggcaaggggcacggggtgtggcacttcgatcagatgctgcttgaggaagaggcctaaaaagaagaacggacagatgaatgaaggaaacaagtgtgtaatgtgttgatcaggcggaggaataataatgggtcaactgacaactctgggtcggtggatttgtagttggtttgggttttttagttgtagaacggtgttgccctcctagagagggatgaacacattatgcatgcgatgtgtcagttcggtcggtgctatgcttcgttgggatttgattggcggaaataaaactcctaatctatggcttg

SEQ ID NO: 72905 - DNA, 378 bp, Zea mays
  unsure at all n locations
  Clone ID: LIB3078-017-Q1-K1-A12
tcgctcagattgcagtagtcttgggttcttgcactgctggtggggcatatattcctgcaatggcggatgagagtgtaatagttaagggaaatgggactatatttctagcgggtccaccacttgtaaaggctgctacaggagaggagatatctgctgaggaccttggtggagcatcagtacattgcaaggtatcaagagtctcagatcattttgcacaagatgaaattcatggacttgagttggggcgaaacattgtgaagaacctgcacttagctgctaaaggaacaaatattcagagttctgcttgtggttaccaagagccattgtacgatgtanaggaacttcgctccattgcaccagctgatgtgaaacagtcct

SEQ ID NO: 72906 - DNA, 416 bp, Zea mays
  Clone ID: LIB3078-017-Q1-K1-A3
gagtccgccgtgcgcatcccggccatcgccggaggagacgggccgccccgtggcatcatctctttctacggcggccactgctgcagcgatttcatttacagctggaactcactggaagaggaagaagacacctcgaagcaaacctgcgacagccagggtaacctcgtgctaactgggccatcaatggccacctcggcagaaagtccaattgccttcaccttctacctccatgatggcagcccgcaagccggagaagccgctgaggacgacgaggacatcgggaggataatctgcgactgcatcggcgacgacttctccaactacaacagggccatagtcgagactgtccaaatgggctatggcctcgctgaagtgatctatgccgtgctgaacaacggcgtccaaggccgggtcgc

SEQ ID NO: 72907 - DNA, 434 bp, Zea mays
  unsure at all n locations
  Clone ID: LIB3078-017-Q1-K1-A4
cccacgcgtncgnccacgcgtncgggtcccttcgccaagccatcgtcggggtctcggggattagcacccgcacccacaagatggccacaccgaacggtccttctgcttctccgatggtgtaccctgtctacctttctggggtatttccccagcaaggcggggatgatcaggctcaaggtccagggatatatgccatacaacagaaccagttagcagcggcgatgggaatgggttgctatgctccaaccacactcattcccctcacttacaatatcccaacagaaagcattggtgctcctgctggtgaagagaatgtacaggatgctaggcagcaaaatgtacctcaaagacaagttgttgtgaggaggtttcacttcgcttttcagcttgacttgaccctgatcatcaaactagctgcaatggtgtttctcttt

SEQ ID NO: 72908 - DNA, 395 bp, Zea mays
  Clone ID: LIB3078-017-Q1-K1-A5
tccacgcgtccggccacgcgtccgggcgcagctaagctagctgattccgccggttttcgtacgctcggcggcgtccgctgacgacacacgccttgttggtttgttcttgctggacatcatacatctctatatgcatgattcttgttctgttattgttaaatcgtgattacaatacttgtaattgtaaagaagtgtgtgggcacgggagtatatcactgtagttttaatttgcttgtaaagaaaagaagggtttttttacttgtgacgcgggagctagcgactgcgtcctgttcgcgtaaaatgtttgcaatggatgatgatgcatgtacgcagcaacagctagcagtgtactacttccacatattattgcgttcaatcaatccagatacacattt

SEQ ID NO: 72909 - DNA, 329 bp, Zea mays
  Clone ID: LIB3078-017-Q1-K1-A6
gtgcgacataccggccaggggcctgaccatggcgtacaccttcatcggcaactcgacctgcatccacgagatgttccagatggtgagcgagcagttcactggcatgttcacgacgaaggctttcttgcactgtgacacgggcgaaggcatggacgagatggagttcaccgaggccgagagctacatgaacgacctcgtgtccgagtaccagctgtaccaggactcgactgacgaccaggaggagttcgacgacgaggaccaggtgcaggccgatgacatgtgacgggagggccgatatcctgggaatgcttatggtcccctaggcaagc

SEQ ID NO: 72910 - DNA, 392 bp, Zea mays
  Clone ID: LIB3078-017-Q1-K1-A7
cccacgcgtccggtccgtaagcacagctggaactgcagctgagaacattcagcaagtccagcaaagttcgaaagatattcaaagcaagtcccagggcgcttcaacaaggagctgtacaaaggttcataagcaaggagttgcgcttggccggtccgtggacctctctaaattcaccgactacggtgagctcaaagcggaactagacaagatgtttgagttcgagggcgaattggtatctgctaaccggaactggcagatcgtttataccgacaacgagggtgatatgatgcttgtcggagatgacccgtgggaggagttctgcaacatagtgcgcaagatctacatctacacgaaggaagaggtccagaagatgaactcgaaatcatccgtgc

SEQ ID NO: 72911 - DNA, 394 bp, Zea mays
  Clone ID: LIB3078-017-Q1-K1-A8
cggtcatctacatcgggttcgtgtgcgcgcacaccctgccggtgctgtacgagaggtaccaggaccaggtggacgagttcctgtacaacatgctagggctggtgcagagccagtacagcaagctggacagcaagggcatcctcaaggggggcgtcaagttcaggaagagcgactagctgatttcctcccatctacgactacgatttgattcatcctgggagtcttgatcgatcgacacttgttctgttctgtacagcgagtaacaaccgctgctgctagctacattctttactgtactgtacttgtgtgatgacatcatatcttcgcgtcgcgtgtactgaagaactacacattgcactaaggttgctttcgtacgtgtacgtgctcatctttc

SEQ ID NO: 72912 - DNA, 355 bp, Zea mays
  Clone ID: LIB3078-017-Q1-K1-A9
gctcgaaccactcgtccgtgctcgacttcgtccccgatccagatccagggtggaatagggaacggccatacaccatggcggatttctccaagctgagataacattgtttgatggttatattgtcgtttacaagtttgtacatgaccttcacttttttgtcaccgctggagatgatgagaatgagctcatcttagcaagtgtactacatggtttttctgattctgttggtcttctactcaggggtgatgttgagaagcggactgcgcttgagaacttggatttgatacttctctgcattgatgaaattgtagatgggggaatcatcctggaaacagatgcaaacaccattgctggt

SEQ ID NO: 72913 - DNA, 391 bp, Zea mays
  Clone ID: LIB3078-017-Q1-K1-B1
ctaaatcgcgagcgccgcccttttttttttttttttcatcccatgactctatctcagcttgtatatacgattgagaggagaggtgcacactcagctatatagatgagtgttttaaaacatattacagtgtctgtctgtgtctgtcaaccacaggaaaaaaaaggagaaagaactacagaggttcccgccaaccgaaacgcacaaaaatagggtccgttcatatatgtatcggagatttggagccaccaccgttgatccgcaggtctgagtgactgaaggggacagggccaacattcccgcttggttccttgagacagtagcagctatagcttcgagggcgaggatggacgcctcaagccggcctcagacttcgagcgggtctagatcgcga

SEQ ID NO: 72914 - DNA, 189 bp, Zea mays
  Clone ID: LIB3078-017-Q1-K1-B10
cggacgcgtgggcgcgccgtcaacagggctcaggacggccgccgtcgtcagggcgtccggggaagcgcaagcgcaagcgcaggcgggccgtcgcgccgtgctcgggctggtggccactggcatcgtcggcggcgccttgtcgcaagcggtgcacgccgagaccgtcaagaccatcaagatcggagcccc

SEQ ID NO: 72915 - DNA, 306 bp, Zea mays
  Clone ID: LIB3078-017-Q1-K1-B11
accacgcgttcgttcacgcgtacgtccacgcgtacggtcgtcgggggctccttgcctgggttacgcgatgggcagctcggtgtcgtcctccgcggcgtgctacagctgtgtgcgctcgctcaacagccgcgcgtcttctactgcggaccgtcatgccacctgcaactgcctcaatagcatgactggccggctcggcggcagcgttagcatggccaactccgccaacatacccggcaagtgctgcgactccgtcggcgtgcccatcagccttaccgtcgactgcaccaagatcaactgatcgttgga

SEQ ID NO: 72916 - DNA, 405 bp, Zea mays
  Clone ID: LIB3078-017-Q1-K1-B12
gggcaacagacctcctggtgcctggcgttctcccaattggctgcttcccgttgtacctggcgctgtacaacaccagcagcaaagcagattacaacgcccggaccgggtgccttcggaggtacaaccgcctggccttccaccacaacagggagctgaagcagcagcttgacgagcttcagaagaagtaccccaagacgaagatcatgtatggagattacttcaaggctgcactgcagtttgtcgtcaaccctgggaaatttggtttcagcacggctttgcaagcgtgctgcggcgccggagggcagggcaactacaacttcaaccctgaagaagaagtgtggcgagcagggcgcgagcgtgtgctccaacccgtcgtcgtacgtgagctgggatggcatccacatg

SEQ ID NO: 72917 - DNA, 443 bp, Zea mays
  Clone ID: LIB3078-017-Q1-K1-B2
cggacgcgtgggggggaacggagggtttgcaaggaaccttcaaccacatgagattgtggaacaggtgttgggcatcgaggggacgttcaaacacagggtgacaaatgttgtgttcatggggatgggtgagcccatgatgaacctcaagtcagttctagaagcacaccaatgcttcaataaggaactaaaaattgggcaaaggatgatgacaatatctacagttggtgttccaaatacaataaaaatgctagcatctcacaagcttcagtcaacgctggcagtcagtctgcatgccccaaatcagaagctgcgggagacgattgttcctagcgccaagtcttaccccttgggagcactaatggatgactgcaagagttacttccttgaaactgggcgcagggtatccttcgagtacactctgctagctgggattaacgatgaaa

SEQ ID NO: 72918 - DNA, 435 bp, Zea mays
  unsure at all n locations
  Clone ID: LIB3078-017-Q1-K1-B3
gaaaaatatccccaaaccctagctcccgatctcgatggcgaaccctcgcgtcttctgggacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgnccccggtgtgctctccatggccaacgccgggcccaacaccaacggctcccagttcttcatctgcaccgtcgcgaccccttggctcgacggcaagcacgt

SEQ ID NO: 72919 - DNA, 430 bp, Zea mays
  Clone ID: LIB3078-017-Q1-K1-A1
cccacgcgtccgctgggctagccgccggtctcttgctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtc

SEQ ID NO: 72920 - DNA, 426 bp, Zea mays
  Clone ID: LIB3078-016-Q1-K1-G5
gtgaagactcctcgtggcctccgcacactcaactctgtttgggcccaacatggtagcggggaagtgaggagaaggttctacaagaactggtgcaagagcaagaagaaggctttcacaaagtatgctctcaaatatgaaaatgatgctggcaagaaggaaattcagctgcagcttgagaagatgaagaaatatgcttctgttatccgtgtcattgctcatacccagattaggaagatgaagggtttgaagcagaagaaggctcacctgatggagattcaggtcaatggtggtaccattgctgacaaggtggactatggctacaaattctttgagaaagaggtccctgttgatgctgtcttccagaaggatgagatgattgacatcattggtgtgaccaaggggaaaggttatgagggtgtggtcact

SEQ ID NO: 72921 - DNA, 424 bp, Zea mays
  Clone ID: LIB3078-016-Q1-K1-G6
catgtttgtacatgctttgtttatggtgcaggccatggcggcacttgcttgagccaagggggctgactggaacgcgatgaggctgacggagaaagaattggctgctgtgaagatcaaccctgcggatgtcgaaattatcgctagtgagcttgagctggacaagaagatcgcggagagaacgctccgtgagcacaagggtgatgccgtggctgcggttcgattcctgctgcgctagttccgagatttcgtcgccagcatcatatgttccccttcagttccacacaagaggtgatgatgtgaagtgaagcactagtacttttgtgtgcctgttttggaagtttgctattagaactatgttgcagaaaatttaagaatgagaataccatgcaaaaggtgtaatatgatttgtattagttatttgcta

SEQ ID NO: 72922 - DNA, 425 bp, Zea mays
  Clone ID: LIB3078-016-Q1-K1-G7
cccacgcgtccgcaacccggccgtgaccttcggcctgttcctggccaggaaggtgtccggggtccgcgcgctgctctacatcgtggcgcagtgcctgggcgccatctgcggcgtgggcctcgtcaagggcttccagagcgcctactacgtgcgctacggcggcggcgccaacgagctcagcgacggctactccaagggcaccggcctcgccgccgagatcatcggcacgttcgtgctcgtctacaccgtcttctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaagg

SEQ ID NO: 72923 - DNA, 413 bp, Zea mays
  Clone ID: LIB3078-016-Q1-K1-G8
gatcggccggccggcgaagaacgttccccagcagccgacacagccgctgcgggtgtccgtgtccaagaagctacgggcgtacgtggaggacaagtatagccgcgccggcgtggagaagggcaagtacgtcgtcatccacggcatcgcctctgactccgtcgccaacatgaagtccagaggcgacgacgactgccttcttcccctcgggcactgggctcagatagccaaggaaatcagctccggcgacagggggctcaagcctctgttcgtgatccctcatgagaagcacagagatgaaatcgaggaggaggtgggggacgacacaagcatcctgttcatcaccaccccaggccagctcacctgcctcatcaacgactctgccggcgtcgtcgcgaccaataccgctgccgtgc

SEQ ID NO: 72924 - DNA, 326 bp, Zea mays
  Clone ID: LIB3078-016-Q1-K1-G9
gagaaacttcatgtctactatcaaacaagctggcatacatggacttgtggtgcctgatggtcctttggaggagacagcgttgctgaagagcgaggccattatgcacaacatagagctggtgctgcttacaacgccaaccgcgccgacagatccgatgaagggaattgcacatgcttcagaaggatttctctatcttgtgagcgctgtaagtgttacaggtacacgctcaaatgtaaacttacatgtagaacacctaagtagggagatcaagaaggttacagacaaaccggaagctgcttgtctcggtgtatcgactccagagcatg

SEQ ID NO: 72925 - DNA, 428 bp, Zea mays
  Clone ID: LIB3078-016-Q1-K1-H1
tgttaacgtactcatggagaacaaccacaaagactgttccaccttgttgagaccagtgggtgcagaagattcattgagactgcataatatgtttcttccttttactttctggagttcacttttcactggcatgcttcaaattggggtcaagtactcacaagagacaattcgtactgatgcattatccataatgattctcattgtaaggacaacagatcccatagaagaacgccagaaattcggatttacttcagtaatgacgagattgcatctgctattgcagaaagagaacggattgcttgttaagaagcattctgtgcgtctacttttcttgcttctgaattgcccagtgatgttgaagttgctgtgtagtggaggcaaagacggctccaaacagatgggatcggaagcttgtgaaagtgatagat

SEQ ID NO: 72926 - DNA, 389 bp, Zea mays
  Clone ID: LIB3078-016-Q1-K1-H10
cccacgcgtccgcccacgcgtccgcccacgcgtccgcccacgcgtccgggttgctctagagccgttcatcctggtggttttgtgaggtcgaaagcggcgagcgaattacaagatgctggacaagctgtgggacgacgtggtggccgggcctcgcccggagacgggcctcgagaagctccgcaaggtcaccaccgcccgcccgctcgtcatcaacaaagacgcggacggcggcagctacgagcgggctcagtcgatgccgtcgacccctactacgccggtgacgccgtcgtcgtcgtcgtcgtcgacgacgccgcgcggcgccagcaacgtgtggcgcagcgtcttccacccggggagcaacctggccaccaacggcatgggcgccaacc

SEQ ID NO: 72927 - DNA, 405 bp, Zea mays
  Clone ID: LIB3078-016-Q1-K1-H11
ccacgcgttcgatcgaacctcacccccgatctgatcgaatcgaaggctgcggcggcgatgggcggtgaccatggcggtgggcacgccggcggcgacttccgccagaaggtatggagcatgacgggcggcccgtactgccgccccgtccactggcgccgtaacaccgccatcgccatgttcggcgtcttcctcatctgcatccccatcgctatgaagtccgcagagctcgagcaacgcccgcatcacccagtccggccaatcccatctcaactgcggtgcaaaaactttggtaagaaggaatactgaaggaccctccaactagcatgaagtgcgggcaccttgcttttgccttcattttgtggaaacctgtgcctagccataatgctgggttaagtgttaggagca

SEQ ID NO: 72928 - DNA, 415 bp, Zea mays
  Clone ID: LIB3078-016-Q1-K1-H12
cccacgcgtccgcccacgcgtccgcgcacgcgtccgcgaaagggaggaggtgcttcaggagatcaggagcaagaccttcaatttaagacgcacaagctcatctaaggcagatggctcatcacaatctacagccagttccaacgttgcagcaattttggagaaagccaacgctatccggcaggctgtggccaatgatgagggtggcgatgatgatacatggagtgatatatgaccacctaattgcagacgttcatggtagtcttttcctgtatattaagctattacaagatgaagggattaaatgtgaataccatccttttcttcattgtaattagattttgcaggtcttgttttgtaccttccttagttcatattagtgaatcctaccgtatgtcgctgtggtcgtggaaatgtc

SEQ ID NO: 72929 - DNA, 221 bp, Zea mays
  Clone ID: LIB3078-016-Q1-K1-H2
cggacacgtactccgacacaacagccacatccactgatactcctagttaagaccagctggtgcagcagattcattctgcttgagtcacatgtctcttactactactatctcaagctcacttttcactagcataactaactttctcaaccagacctcaccagacacaattcatcatgatgcattatgaataccaatactctttgagagcactacgaagacct

SEQ ID NO: 72930 - DNA, 427 bp, Zea mays
  Clone ID: LIB3078-016-Q1-K1-H3
aacacttcctgcacccatatcctactgatggagacaagcaaatgcttgctaaacaaacgggtttaacacggaaccaggtatccaactggtttataaatgcaagggttcgtctttggaaaccaatggtggaagagatccacaaccttgagatgaggcaggtgcacaaacaccctgttctcgacaagggccagcacgtgctgcatcaccaaacccagcattcgttcgagagcagtggaaagccttctgacccttccgactctcagcttggccaaagcagcagcatcacgaggaaccacaacatccctgcgtcccagggatttgccgatgagctctccgagatgtcccattctattcagcaggggcaggtaaccttcgcatacaatgggatgtcggcgccacaccacagcctcgcttcgtcacagcacca

SEQ ID NO: 72931 - DNA, 435 bp, Zea mays
  Clone ID: LIB3078-016-Q1-K1-H4
ctgaactcctgaagcaaaagcaatggccatgagagcgcttccgctgaccccttccaggagctcctcgtttggagctcaccaaaccaggccgagcggcggcggccccagatcagtgagagcttatgcgaagggagacgaggagggcgacaagcagtccctcttcggaagcatcaccgaggcgctggacttctcgcaggtccggtcggagaaggacgccgagctgctgtacgaggccagggagtccaccagaggtggagggaggatgacgagggagcagtacggagcacttaggcggaagattggtggcacctaccaggatttcttcaagtcatatgttgaagtcgacgggcaatacgtggaggagggttgggtcgacaagacctgcaagatctgcaagaaggacacaaggggggagccgaggcaagttgacaagct

SEQ ID NO: 72932 - DNA, 322 bp, Zea mays
  Clone ID: LIB3078-016-Q1-K1-H5
cccacgcgtccggacccacgcgtccgggcaagtgctccagcgtggtgtacggctggtggtgatcgctagctccatcgtccgcctagcccaccccgccaccggccgatctctccgccgttccggtccatcagagtggtactactacctatgagttgagcttttcttggtgcacgcccaccgtacttcctcttgattcttctaccttgatcagagttaggatctttttttatagttttatctttatgggatggatttggtggtatgtagaatgagtagtcgagcttctctttggggatttggaacggtggggaggttgactggt

SEQ ID NO: 72933 - DNA, 117 bp, Zea mays
  Clone ID: LIB3078-016-Q1-K1-H6
tcgtgaagacgtagccaaaggcttttgcaccctattgctccaccatcttgaggaggctctcgggatcagtttattaattcaccccattgttcatctagccaacatcctatctatctt

SEQ ID NO: 72934 - DNA, 422 bp, Zea mays
  Clone ID: LIB3078-016-Q1-K1-H7
acacagcgtagctagctagctagtagagaggtcaatcaccaatggcgaggcagctcgttgtgcttgctctgcttttagtgatctccggtgtggcgcatggcgcgggggagtgcgccagagcctccttcgacaggatggcgctcaggatggcgccatgcatctcggctgccgactacccgcagtccacgtcgaccagcagctgctgctccgctgtgcacaccatcgggcagagccgcagctgcctgtgcgccgtcatgctgtaccggcaccggcagggctgacgggatcaagccggaagtcgtcattaccatacccaagcgctttaacatggccgaccgacccgtctgctacaagtgcggagattacacgctgccctagctgatgaagactttgtcaacgagaccgtgcgagtgaaccagtgc

SEQ ID NO: 72935 - DNA, 286 bp, Zea mays
  Clone ID: LIB3078-016-Q1-K1-H9
ccggctcgacccactcgtgcgacgcaaccttcacctacaccagaaaaatcttcagttcttttgtccgcgtcagagaagccgggccgatgggggggctccgcaaaggccgcaagggtctgggcaacggcggcactaaacatcacccgaaggggcttcttgacaacatccagggcatcaccaagcctgcgattcggaagctgtcttagatgggtggcctgaatcgcatctcggggctcatctacgaggagacccccggcgttctctaaatctttctcgataacctcat

SEQ ID NO: 72936 - DNA, 434 bp, Zea mays
  unsure at all n locations
  Clone ID: LIB3078-016-Q1-K1-G4
cccacgcgtccgagaagatcgccgtcctcggcttcgccttcaagaaggacaccggcgacgccagggagaccccggccatcgatgtctgcaagggcctgctgggtgacaaggcccagatcagcatctacgacccccaggtgacggaggaccagatccagcgggacctagccatgaacaagttcgactgggaccacccgatgcacctgcagccgacgagcccgacggccgtgaagcaggtgagctgcgtgtgggacgcgtacgaggccaccaagggcgcccacgggctgtgcatcctgaccgagtgggacgagttcaagaccctggactaccagaagatcttcgacaacatgcagaagcccgccttcgtcttcgacggccgcaacatcgtcgactccgagaagctganggagatcggcttcatcgtctactccatc

SEQ ID NO: 72937 - DNA, 403 bp, Zea mays
  unsure at all n locations
  Clone ID: LIB3078-016-Q1-K1-F10
cgagcgggcaacattccgcggtacccaagtatggataacgtcagctggcccacagggggcattaacagctcgatgtcaaggtcaagagcgtcatcatggagcggaacgtacccagagcagttgagcagcactgccgcttccaggtcacctgatggacagatgacgcagtcaccatcgatgcctggaagaagacctccgcacagccgttccaacagcgcgtcttcttccgcccagctcaatggtttgggtgaggatcttcacgaggtggagctctgacacctggccgcagattttgaccataatgtgatttatattaatagctgcatgtgtctagagagcaaagcanaggaaattaaagtgcggtgtccctttttcaatttttttacatgtgaaagactgtgga

SEQ ID NO: 72938 - DNA, 403 bp, Zea mays
  Clone ID: LIB3078-016-Q1-K1-F11
atggcgtctaagaggatcctgaaggagttgaaggacctgcagaaggacgcgcccacctggtgcagcgcaggtcctgttggtgaggacatgttccattggcaagcgaccatcatggggccttcggacagcccatttgcaggtggggtattcttggtgaacattcacttcccaccggattaccctttcaagccaccaaaggtgtctttccgcaccaaggttttccacccgaacatcaacagcaacggcagcatttgccttgacattcttaaggaacagtggagtcctgctttaactatctcaaaggttctcctgtcaatctgctcactgctcacggacccaaaccctgatgatcctcttgtccctgagattgctcacatgtacaagaccgacagggccaagtatg

SEQ ID NO: 72939 - DNA, 426 bp, Zea mays
  Clone ID: LIB3078-016-Q1-K1-F12
caaccccgtctgcctctgcgagctcctctccggcgccgccgactcctacggcatcgccgtcgactacggccgcgcgctcgcgctccccggggtctgccgcgtcgccacaccgcccgtctccacctgcacagccctcggatatcacgtccgcgtgggcccagctgcggcgcccatgtcagggtctccctcgcccatgtcaggcatctctccctccggggagggcccacagttcccaggaacatcgccgaccgcctcgccgccgtcctcgaccagcaccgcggcgcgccgctccttcgccggcgcgggcagccacctcgtggccctcgccatgctgccgttggccgccgccgtcagcgggatgctctaaggtcgacgactccttcgtctccgcatgcattgcgcagctggacattgttgcgtagtata

SEQ ID NO: 72940 - DNA, 427 bp, Zea mays
  Clone ID: LIB3078-016-Q1-K1-F3
ctccattaggcgtgcctttccctctcctttccctggccacaccatcccacaaggaccggggccaagcgacagcgccgccagcaagcaccccatgccctgaaccaccccacaccatatctgcagtacaggtacaacagtccctgccgccggggacgttagacccaccctgctcgcgcgcgcagtctgatggctaattcgccacgtcatcggtcctgctccggtgagctgtcgacgctgtctcctgactggcgaagccagtgacgcacccgccgtgcccttgctcctgcgccgttctcgtgcacaacatcacagatcgcgattcgtttctaagcttcaaggaatcgacggtcaagcttcggcgaccaaatgatccagttcttcgagttctacaaggctgaagatcctgagcatctgtttggtgaagtga

SEQ ID NO: 72941 - DNA, 418 bp, Zea mays
  Clone ID: LIB3078-016-Q1-K1-F4
cagctatgcgcctctgcctttgttgcatgtggtagtcgcaactcgccagtgctctctgctgtacaacgtacaagtcaggttgaggagttggagcaggaaaagcaggagctggagtttattgcagatatgtacgtgaaagaaagttctgagtctaggacaattgctgatattgaagaatcagaaacccgagctcgcaatcaggctgaatatttgaggagcaatctagaggagcatagtcttgagcttcgggttaaagcagcaaatgaagctgaagctgcatgccagcaaaggctttcctttgctgaagtggaactagaggagttaaggaccaaagtagatgcatctgaaagagatgttgtggaacttaaggaggcattaagaattaaagaggctgaaggagacgcctatatttctgata

SEQ ID NO: 72942 - DNA, 407 bp, Zea mays
  Clone ID: LIB3078-016-Q1-K1-F6
cggacgcgtgggttctacctcaaggccttgaagcttgtgaacgtggagagggcgtttgcggagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagc

SEQ ID NO: 72943 - DNA, 420 bp, Zea mays
  Clone ID: LIB3078-016-Q1-K1-F7
cggacgcgtggctcgtctagatccgttcatcctggtggttttgtgaggtcgaaagcggggagcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgatgccgtcgaccccgacgacgccggtgacgccgtcgtcgtcgtcgtcgtcgacgacgccgcgcggcgccggcaacgtgtggcgcagcgtcttccacccggggagcaacctggccaccaagggcatgggcgccaacctcttcgaccggacgcagcccaacttccccaccgtctacgactggctctacagcgacgagaccaggagcaa

SEQ ID NO: 72944 - DNA, 421 bp, Zea mays
  Clone ID: LIB3078-016-Q1-K1-F8
gctgaagcttctagtcagggtagtcccaataagaaaaggcataagtttgatagtggtgatggcacttcatgcaagcgttgtagttgtaagaagtccaaatgcctgaaactttactgtgagtgttttgctgctggagtctattgttctgagccttgttcgtgtatcggctgtatgaacaaccagagtcatacggaaactgttctatctacgcggcatcagattgaatctcgcaatccattagcatttgctcctaaagtaattcatacatctgagcctggtctggaactaagggacttctccaataaaactcctgcttcagctcgtcacaaaaggggatgcaattgcaagaagtcgtcatgtctaaaaaaatactgtgaatgttttcagggtggtgtgggatgctccataagttgcagatgcg

SEQ ID NO: 72945 - DNA, 406 bp, Zea mays
  Clone ID: LIB3078-016-Q1-K1-F9
cccacgcgtccggatattgttccttcatcacacaactgtgacattccgcatgtgaaccgggctgagtatcagctgattgatatttctgaggatggatttgtgagccttcttacttcagatggcaacactaatgatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagactgaaccctactgtatctcaacttaaatcggaaaagaagtgtatcaccaaaggattgctaccgagacattcacctggcttgagctggcttttgctatagcgtgcaaggggtt

SEQ ID NO: 72946 - DNA, 432 bp, Zea mays
  Clone ID: LIB3078-016-Q1-K1-G1
accacgcgtgcggatgctgatctggttgctggactgatggctctaatggagagtgatcgtgttgctggtttcaacttggggaacccaggagagtttaccatgttggagctagcacaggttgtgaaggaaacaattgacccaatggcaaccattgaattcaaacccaacacagctgatgatccccatatgagaaagccagatatcaccaaggctaagcaactgctacattgggagccaaaggtctctctcaaagaaggccttccgctaatggttcaagatttccgtcaaaggatctcggatgagtaatcaaagcaattcttttttccccgaatgtgccatgcacgtgtttgtaatcagagcaatcgtatgatactggtgaccggtttgattctgaacgatgctgcaactacagtcaggagctcttcaccaact

SEQ ID NO: 72947 - DNA, 411 bp, Zea mays
  Clone ID: LIB3078-016-Q1-K1-G10
cagggagaggctcctcgccgacgagctcttcctcaccaagctcggcatagagtgcggcggcggtctcgtcgccaagaccgtggctgagttccagaagaggggggacaatttcttcaaagagattggagtaggcatatctgatgtggtcatggctattgttgcggacgtcatgcttgtctatcttcctgctccaactattggtttacagccggcactggcaagaaacgctggagctattgccaactttttctataactgccctgataatactttccaaattgctatggctggaaggtcattctcacttctgcagaggattggagcttttgtgaggaatggtataaagcttttggcagtgggaactactgcttctttgattggcactagtgtcacgaatgcagcgctcaaagc

SEQ ID NO: 72948 - DNA, 267 bp, Zea mays
  Clone ID: LIB3078-016-Q1-K1-G11
gatcgtcaccccgggccttctcttactgtacatcgtcctaatcatactgggcgttcgcgggagctacctgatggccatcagcttctagaacaatcccttctattaattgctcatcatcgacatctagctcctcactaccgttgtgtcctaattggtcatctgccccatcacgctctaccactagcttttccacgtatacctcttatatttacaatcttacatgctcgttctactaactgctgcacctgtgctttcacattcctgctg

SEQ ID NO: 72949 - DNA, 405 bp, Zea mays
  Clone ID: LIB3078-016-Q1-K1-G12
ggccgccgcgcctcctccttcgccgtcgtctgctccaagaagaagatcaagaccgacaggccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcgtgtaaaatcagggtgtctgtctataatctagcctccatggatgctc

SEQ ID NO: 72950 - DNA, 430 bp, Zea mays
  unsure at all n locations
  Clone ID: LIB3078-016-Q1-K1-G2
cccacgcgtccgcccacgcgtccgccgcgccgcgcccccagcacagccacacgcgtacgcgcgtacagctcccgcagccatggcatcagtaggcttcggcacggtcgcgccggccgtggcatcatcgccggcggccaggacgacgagcgtgggccgcccctccgcggcgcacgtccctgcggcgacgaccaaggtcgtcgcggcggcggcggggaagcgggaggaggagaagggcctgttcgacaccatcttcggcgcgctgtacaaggaggagcagctgctggagacggaccccgtcctgaacaaggtggggagcaagggcaaggccgncgccgtcccggcgcccaagaaagccgctgaagagggcggcaacggcgggctcagcctcggcgggttcttctccaggcccaagaaagggtgaacgtacgta

SEQ ID NO: 72951 - DNA, 262 bp, Zea mays
  Clone ID: LIB3078-016-Q1-K1-G3
accactcctccgaccactcttccgacacttcttaccctcactacattcacacacctacaggcttacacgctactgcatcctggaatcagtacaattcaccaccttcgcaccatcctaagcatcatccatcatcaactaataccacaaccgctactaggtcctcatcctctaacgttcctactaccacaactactgatattgctatgacaaatgctaagcatcagcaataaaacgatctatccaacaccattttactatctct

SEQ ID NO: 72952 - DNA, 431 bp, Zea mays
  Clone ID: LIB3078-016-Q1-K1-F1
gttatattgctagaaagatgcagctaggaacaccttttggtgcatttcttgatcctgtgggcgacaagcttatggtagcggcaacattagttttgctatgcaccaaacctttggaatcatcactgctcaatgatgggccatggcttctaacagtcccttccattgccatcattggaagagagattacaatgtcagctgtgagagagtgggctgcatctcagaatagcaaagttcttgaggctgttgcagttaacaacttagggaagtggaagacagcgacgcagatgacagcattgactctgcttctcgcaagcagagacccaagtctacctgcgcaaggcgctctagttgcccccggtgttgctctactttacgtctccacgggactcgccgtatggtccctagtggtgtacatgagaaagatatggcgt

SEQ ID NO: 72953 - DNA, 420 bp, Zea mays
  Clone ID: LIB3078-016-Q1-K1-D6
ctgcccttctacggagtagttcacattgggtactttggcaatggaagcggagaaggcattgatcggtcgcattttcaggcgttggttcatttctacgggtgcaagcttcaggttcaagaaaggatgacaaggcagatagctgaagcggtttattcagtttcgcacaatggggccatggtcgttgttgaggccaaccacatttgcatgatctcaagggggatagagaaaataaggagcaacacggcaacaattgcagttttgggccagtttttggccgacccttctgccaaggcgtgcttcttacagaatgttttggattctgttggttctgcggtatgaatcgtatcgcaagcagcaaagaaaaaaatgtctagttggagtactatccagcaattgaaatttttagcaatctactggtct

SEQ ID NO: 72954 - DNA, 420 bp, Zea mays
  Clone ID: LIB3078-016-Q1-K1-D8
cccacgcgtccggtgaaggcgcaggagtgggcggccgtccccggcgggcaggccacgtggctgggcgccccggtgccgtggggcacgctgccgaccatcctggtgatcgagttcgtggccatcgccttcgccgagcaccagcgcaccatggagaaggaccccgagaagaagaagtaccccggcggcgccttcgacccgctcggcttctccaaggaccccgccaagttcgaggagtacaagctcaaggagatcaagaacggccgcctcgccatgctggccttcgtcggcttctgcgtccagcagtcggcgtaccccggcaccggcccgctggagaacctcgcctaccaccttcgcgacccgtggcacaacaacatcggcgacatcatcatccccagatcaatctccccttgagctcagctc

SEQ ID NO: 72955 - DNA, 410 bp, Zea mays
  Clone ID: LIB3078-016-Q1-K1-D9
cccacgcgtccgcggacgcgtgggttcaccaagacgtatatcgatataccaatttgatggtgagcgcagtttggaagacagacagaatttgatatttcgagttacttgctcaaaaggaacatacattcggtccctatgtgcggacttgggtaaagcacttggaagctgtgctcatttaactgccttgcggagagactcgataggtgaatactcggtcaatgatgcttggaacttcgatgagcttgaagaacaaatcaccaaggggtatttatgagcatgccagtgagccgagctaggttatatgcggcttgcaaccagtggcatccatgctgccatgtcagtcccaaagctgtcaacgtgggcttcagcgaagagttgcaaatccagttcagttcatactcaaccttttg

SEQ ID NO: 72956 - DNA, 430 bp, Zea mays
  Clone ID: LIB3078-016-Q1-K1-E1
cggacgcgtgggttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcggcgaggtcgtcgacccgctgtaccctggcggcagcttcgaccccctcggcctggccgacgaccccgaggccttcgccgagctcaaggtgaaggagctcaagaacggccgcctcgccatgttttccatgttcggcttctttcgtccaggccatcgtcaccggcaagggcccgctcgagaacctcgctgaccacatcgctgacccagtcaacaacaacgcatgggcctacgccaccaacttcgtcccc

SEQ ID NO: 72957 - DNA, 406 bp, Zea mays
  Clone ID: LIB3078-016-Q1-K1-E10
ggccagcatatatccgagttttcctgaatatcctgcggagcatctccaaggaagagacggtggaatacgtgcttgcactcattgatgaaatgcttgcaacaaatcctaagcgtgcagcactgttttatgatcaatctttgtcgggtgaagatatttatgaaccgttcttaaggttgttatggaaaggcaactggtttgtacaagaaaaaagttgtaagatattgactgttataattagtgcacgaccaaagcttcagaatggcacacttccaaatggagatgcttcgaattcgaagagcaagcttacttcaacacacgatgtattgagaggtttggttgattggctctgttcacagctgaggaatcctacacacccgagctgctctattcctacttctatccattg

SEQ ID NO: 72958 - DNA, 401 bp, Zea mays
  Clone ID: LIB3078-016-Q1-K1-E11
cccacgcgtccggttctagatcgcgagcggccccctttttttttttttgtggagtcatgggccaatttcttcaaaattatcattaatttatgatgttcatgtaactatagtcgtaggataaggcagggccggtttggtttcatcacgcggatgggagcaccttcttgacgatctcatcactgagcgaggcgatctgggcgtcgagcgccttaacagcctcctccttctgcgcctcgaggttggcgagcgcctttacgagctcggccttcacacggctgcgcccctcgttcagcttggcctccagcttcgcggtggtctccttcttcatcttgttaagcgccgcctcgatctcggcgcgcgccatcttcatgatggccgccgcctggtccttcagctgcttc

SEQ ID NO: 72959 - DNA, 402 bp, Zea mays
  Clone ID: LIB3078-016-Q1-K1-E12
gcgacggcgctgccggagatggagacggagacggaggcggcagcggcgaggcgggcgagaggagtctctggagctggctttccagatgtgccagatcctagacaccggcctcgaccgccacaccctgtcgctgctcatggcgctttgcgaccgcggagccaaccccgaggcattggccgccctcgtccgcgagctctcctctgctgctcccccaacctccgccgcggcttcctcccccgtgagcaacggcgccgcggggccggcctcggcaattgcgcccacgttctcctccggccttcgccgtccctagggtttgtaatatccttctgttcccacgatgagactgcttgtcggttagccaactagatcccgcactatgcacttagctgtcgtgaacgcctg

SEQ ID NO: 72960 - DNA, 428 bp, Zea mays
  Clone ID: LIB3078-016-Q1-K1-E2
cccacgcgtccgaccggtcgctggcggacatcttccctccgcacctcctcaagaaggtgggctcggaggtggtgtccacgttcctgctggtgttcgtcacgtgcggggcggcggggatctacggcagcgacaaggaccgcatctcgcagctggggcagtcggtcgccggcgggctcatcgtcaccgtcatgatctacgccgtcggacacatctcgggcgcgcacatgaaccccgccgtcacgctcgcgttcgccgtgttccgccatttcccctggatccaggtcccgttctactgggcggcgcagttcaccggcagcatctgcgcgtcgttcgtgctcaaggccgtgctgcaccccatcgccgtgctgggcaccaccacgccgacggggccgcactggcactcgctcgtcatcgagatcatcgtcacc

SEQ ID NO: 72961 - DNA, 426 bp, Zea mays
  Clone ID: LIB3078-016-Q1-K1-E3
cccacgcgtccgtcttcttggtccgccgtctccactccgcgttccctggctccctgcgtggcgtcttgggggagagagagaagtgggagacccgcgagaggctgccgtgtagggactagggaccgtagagtaagcgacagcgaaggagggagagggggatggccgggatcgggccgatcaggcaggactgggagccggtggttgtgcggaagaaggcacccaccgccgctgccaagaaggatgagaaggccgtcaacgccgcgcgccgctccggcgcggagatcgagaccatgaagaagttcaacgctggtatgaacaaggcggcgtccagcggcacatccctcaacaccaagcgcctcgacgacgacacagagaacctcgcccatgagcgagttccaagtgacctgaagaaaaatctcatgcaag

SEQ ID NO: 72962 - DNA, 426 bp, Zea mays
  Clone ID: LIB3078-016-Q1-K1-E4
cccacgcgtccgcatggatgttgataagatcgcatttactggatctaccgatactggaagagattattctcgagttggctgcaaagagcaaccttaagacagtgacactggagttaggaggcaagtcccctttcatcataatggacgatgctgatgttgaccatgctgttgagcttgcgcactttgccctgttctttaaccagggacaatgctgctgcgctggatctcgcacgtttgtacatgagcgtgtttatgatgagtttgtggagaaggccaaggctcgtgcattgaagcgcgtcgttggtgatccgttcaggaaaggtgttgaacagggcccgcagattgacgacgagcaattcaacaagatcttgcgctacattaggtatggtgttgacggtggagctacccttgtgacgggtggtgata

SEQ ID NO: 72963 - DNA, 420 bp, Zea mays
  Clone ID: LIB3078-016-Q1-K1-E5
cccacgcgtccgcccacgcgtccggcgtcgacagcgcgcagctcgcaggggtgttcgagcaggccggctccgtcgagatggtcgaggttgtatatgacagaatgactggacggagccgaggatttggattcgtgacaatgtcttcggccgaagaagccgaagctgctgtcgagcagttcaacggttatgcatttcaaggaagacagctgagggtgaactgcgggccaccgccacctagagatgaatccacaccaagagcaccaaggggtggtggtggtggcggcggcggctttgtcgattcagctaacaaggtctacgtggggaaccttgcgtggggcgttgacaactcaactctggagaacctgttcagtgagcaagggcaagtgcttgatgctaaggtcatctacgacagggatagcg

SEQ ID NO: 72964 - DNA, 422 bp, Zea mays
  Clone ID: LIB3078-016-Q1-K1-E6
cccacgcgtccgcccacgcgtccgcccacgcgtgcggtcttgccaatgcagggggtggggaggccctgagattagaagacctggaaactttcagacctgaagaagggatgatccttgctaatgcaacatcattggggatgtacccaaatgttgatggtactcctattccaaagaaagccttgggtttctatgatgtggtatttgatgccgtatatgccccaaaagttactcggcttcttcgagaagcagaagaatgtggagttaaagttgttagtggtgtggaaatgtttattagacaagccatgggtcaatttgagcatttcaccggtggtatagaagctcctgaaagcctgatgcgtgagatagcagcaaaatacacctagcaggctaatggcgaaaacctatctttgatgaatatttgc

SEQ ID NO: 72965 - DNA, 423 bp, Zea mays
  Clone ID: LIB3078-016-Q1-K1-E7
cggacgcgtgggattttctctcctctctccgtcgccgcctcgggccaaaccgtacgcagggagttgattgatcgattgcagccatgagtaagttgcattccgagcttctcaaggattgcatctcccagatagttcaggatgccaagaagaataggaagttcactgagactgttgagcttcagattagtctgaagaattatgatccacaaaaggacaagcgtttcagtggctctgttaagttgcctcacatccctcgtccaaagatgaaggtgtgcatgcttggtgatgcccagcacgttgaggaggctgagaagatgggacttgactacatggatgttgaggccctcaagaaaatgaacaagaacaagaagcttgttaagaagcttgccaagaagtaccatgcttttttggcatcagagacca

SEQ ID NO: 72966 - DNA, 304 bp, Zea mays
  Clone ID: LIB3078-016-Q1-K1-E8
ctcggtcacatttgcccgtcttgcaagggaaaggcttctggtcatcttggggtcaacgggccatctattcgaaatcagcttcttgtaacctgaactggtgctgctgctccaccatcaatttatactctacttcatatgagtcgatcagtactacgtactatgtctgctttaactcgttgctagtggaggaaacaggtttattcaaatcttacatctctggttattaaaactcatccattaagcagctgttgcgaacaacgaagctgacttgttcgatacatacatgactgagctctcaagagac

SEQ ID NO: 72967 - DNA, 393 bp, Zea mays
  Clone ID: LIB3078-016-Q1-K1-E9
cccacgcgtccgcccacgcgtccgcccacgcgtccgagcaccaacgtgtatgcttacaggtcaataatcgctctaattgtttgcattccacctgcattgatctttgaagggcccaagctaatgcagcatggatttagtgatgccattgcaaaagtaggtttgacaaagtttgtcagtgacctattcttggttggactgttctaccatctgtataaccagattgctacaaacaccttggagcgagtggctcctctgacacatgctgtcggcaatgtgttgaaacgtgtttttgtcatcggtttctcaatcattgtttttggcaacaaaattagcacacaaactggaattggcacgtgcattgccatagctggtgttgctatgtactcttacatt

SEQ ID NO: 72968 - DNA, 414 bp, Zea mays
  Clone ID: LIB3078-016-Q1-K1-D5
tgctgcgacaagccggtcctgccgtgactgcaaccaggcctagaggcatgtgaggaacggctgttggcgtgcagggagcagtgcaagggacagacagcgtcatagcgatgctccaactacgccattgatgaggctagctgtaacgatgggccacgaataagaagtttgcctatggcctgtgggggagttccctgcgggttttaaagtgtaataacacccttcataatcgatgccttaagctggtgctgccgagtgccgactagctaggccggcatgtaagagcagcctagactgatgttgatgtggtctggcagacgtcctgtgctgtgcctgcctctgtatttcggtcaaataaataaactagatggagtttgcatgtttgcatcagacaaggataacgagaaagtaaaaggg

SEQ ID NO: 72969 - DNA, 502 bp, Zea mays
  unsure at all n locations
  Clone ID: LIB3078-018-Q1-K1-G4
tcgcggacgtcgtgtgagtcgactccaagcgcgtccgtcggaccgccgtgggctggactgccgtgggtcctggaggacggtgagcaccatgtagtgctcgtatnggtagcaatggcttgataggggcttgctgactggacataggcgacatttgcaaaccagctgtttagccttacactcgtggctgtatcttgcttcgggaacctctcttctttgggatggaacctgtccttagccccatgcgttcatctcatgcccacttcgtacctgctgattcgagcaacgctaccaatcttgaaggagtagctttgaaggctttcaccaggcaaatgtggcgtgctgcgggcgatcctggtccaaggacgaatgagaggctgtgagcagcctatagggccgnctgtgaccttgcaacccactacctctgccacccctgcgccctctgccaggagggtcgcgagctgcgccgcagggttccccaccctggattcaacaatgggcactt

SEQ ID NO: 72970 - DNA, 439 bp, Zea mays
  unsure at all n locations
  Clone ID: LIB3078-018-Q1-K1-G5
cccacgcgtccgcccacgcgtccgcccacgcgtccgcggacgcgtgggggaagactgggggctggacacactgtgtgacctgtatgagaccctggccattacccagagtgtcatctttgtcaacacccgccgcaaggtggactggctcactgacaagatgaggagcagggaccacaccgtttctgccactcatggtgacatggaccagaacactagagacatcatcatgagggagttccggtctggctcctcccgtgtgctcatcaccactgacctgcttgctcgtggtattgatgttcagcaggtgtccctggtcatcaactatgatcttcccacccagccagagaactacctgcatcgtattggtcgtagtggtcgttttggtaggaagggtgttgccatcaactntgtgacccgcgacgacgaacgtatgctgttt

SEQ ID NO: 72971 - DNA, 322 bp, Zea mays
  Clone ID: LIB3078-018-Q1-K1-G6
ctagaccattgaccggaccctggtgcccggcgccgagctgcacactgatgtcgaggcgggccacagcgatgacttggtcgaccttatgttgctctgcaacatgtccaggaccgacaactggcacaggcaggatcaccggccaccgtagctcgactgcaagggcacaagcgagggccaggcgacgctgatcagcagttacagtgacggcacaagcagattcagcatgacgccggacgcctgagcaacggtcaagggcatgacccacagcttcatcacggcgcgtgaatgccagctcaaggcaggcacctacggacgactgctc

SEQ ID NO: 72972 - DNA, 350 bp, Zea mays
  Clone ID: LIB3078-018-Q1-K1-G8
gtgcctgagcgatatgcagacagaaccatggctgacttgaccactagagatccaattattagggatcacacagcactaccaggggaggcacttgctcgagcagaccgcttggatgatctctaccgttctgatcgtgtggaggaactctaccgttctgatcgacttgttaaccgtgctgtggaccgccctcatccagcctattttacagctgcttatgagaccaaccctgcttatgctgaaacgagcattaggcctgtctctgcaagggtcaatggacccagtgcggcagtttcgtcactctattccttcagtggtggcccagtatatcggtaatgaatgatcatggctct

SEQ ID NO: 72973 - DNA, 339 bp, Zea mays
  Clone ID: LIB3078-018-Q1-K1-G9
aactcatcggtcatcaccctccccggtggtcaccacaatgggagatgagatgagtgacgggcggcgggcagacgggagctacgggccggagtacggtcccgtccctcgtgagtttcagcacgcctggtaccctcagttgccatccaggaccaggaggaggtccccgtggcctctgcatcatggggattacccttggaggctttcggagcacaggttcagaagaccacctttcgagcgctccagttgctggcacccgttgcagccaccattccatatccaccgtgtccatggcaacagcggcagtggcgcgcccctaaacccgagacacaagcgaggaga

SEQ ID NO: 72974 - DNA, 416 bp, Zea mays
  unsure at all n locations
  Clone ID: LIB3078-018-Q1-K1-H10
ccgagagtcgtcggggtttcctgcttcaacagtgcttggacggaacccggcgctcgtggcccaccccggccggccgcccatagccagccctccgtcacctcttcaccgcaccctcggactgccccaaggcccccgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctnctacgtttacctgtccatgtcttactactttgaccgcgatgatgtggctttgaagaactttgccaaatactttcttcaccaatctcatgaggagagggaacatgctgagaaactgatgaagctgcag

SEQ ID NO: 72975 - DNA, 364 bp, Zea mays
  Clone ID: LIB3078-018-Q1-K1-H12
acgcccacgcgtgcgcgaaaaccctgctaaacttatgtatctgccaaaccaacgcagcgcacgaaccgtccttcacgatatcaggacaccacacttaaactactcggatatgctatgtcaatgcaatggactgtccattacattaggaagtacatgcgaatcttgcactactctaactgatccatctgtgcacttacaatcacgacccatatcatagtcacttcattatgacacattacctgaatgcactaatataaaccatctatgaacaatatgaccacgttaccaactttcgcaagataagagcacccgaatctaacttcgcgcaatatctatgatacaagctcaccctctcatacattca

SEQ ID NO: 72976 - DNA, 442 bp, Zea mays
  Clone ID: LIB3078-018-Q1-K1-H3
ctgtttttgatgaccctacagtggagattcaagagttgactgcagtcattaagaaggagatcacggctttgaattctgctgttgtagacctacaagctctctgcaattcacaaaatgagagtggcagtctctccaaggacacatcaaatcattccactacagtcgtggacaacctaaaaaatcgtctgatgagtgcaacaaaagaatttaaagaagttcttaccatgcgaacagagaatttgaaggttcatgaaaatagaaggcaaatgttctcttcgtcagctgcaaaggacgcgtcaaatccattcatccgtcaacgaccccttgttgctagggatccatcagagtcatctgtgcccccagcaccatgggccagcgactctgcatctaccccattattccagaggaagaaaactaatggagaccatggggcatcatcatc

SEQ ID NO: 72977 - DNA, 397 bp, Zea mays
  Clone ID: LIB3078-018-Q1-K1-H4
ctcatgtgagcactagggttgcaggaacaataggatacctggctcctgaatacgctgtgagggggcaagtgacgaagaaatcggatatctatagtttcggcgttttgctactggaaattgttgctggtagatgtaactacaacagtagattgcctcagggagaccagtttctgcttgagaagacatgggcatactacgtgcagggaaagctagagaaggtcatagacgccgaagcaggggaggacctgaacgtcgaggaggcatgccgtttcttgaaggttggcctactatgcgcccaagacgcgatgaagctgcgtccgaacatggccagcgtcgtcctgatgctgataggagagaaaggaatctccgtggacaggatcaccaagccagccgtgat

SEQ ID NO: 72978 - DNA, 441 bp, Zea mays
  Clone ID: LIB3078-018-Q1-K1-H5
cccacgcgtccgcggagctgcgctggtgaggtactcgatcgcgggcaacttcctggggcggccagcgatcaccgtgcccgtcgggtatgacaggggagggctccccgtggggctccagttcatcggccgcccgtggtcggaggccacgctgctgcacctcgcctacgccatgcaggaggcgtgcgggaagaaggtgctccggaagcccaaggtgcactacgacctcctcaccaaagagtagctccagcgagcatcgatccggcagattgctctctatgaggcgcgcggttgctgattgcatgcacctctagtgtgattgattgtttgtttgattgattgagcttgtgatgagagagtgggggaagttgaatggaatgccgtcaatgtcggacaactctcaactaggagaagaaaaaaaaacatggttgccagcaccatgca

SEQ ID NO: 72979 - DNA, 431 bp, Zea mays
  Clone ID: LIB3078-018-Q1-K1-H6
cccacgcgtccggtttcatcggaggtattgtgaggttccgccggcgtctcggcggaagggaaccacgatctgcatctcagtcgtctccccaagcaccatcgcctatcatggatgcctacaggcaccagttgcagccagcaaaagcaaacttacaagtgagctggttcctcccgcggattcaccagtaataaattatccaatgctttagacctagcaaagtgctacaaagaaaaggtcgtgcacatcacctacagggaggcctacaaagaagctttttgataatgacgttgattagaaggatggaggggctgactgtgctgcagccaaagctaggcttattagctcctgcaagatcactggaatagatagttcagaacaaataagtgacattttgcgtggcattgaaagaagagtgatactgctttggtcat

SEQ ID NO: 72980 - DNA, 442 bp, Zea mays
  Clone ID: LIB3078-018-Q1-K1-H7
caaacctaacgtaccctcttccgcgccgccatgtctgggaggaagaagacgcgggagcccaaggaggagaacgtgacgcttggccccgctgtccgcgagggagaacacgtctttggcgttgcgcacatcttcgcctccttcaacgacactttcatccatgtgacggatctgtctggaagggagacgctcgtccgcatcactggtggcatgaaggttaaagctgatcgtgatgagtcctcgccttatgctgctatgcttgcctcacaggatgtcgcgcaaagatgcaaggagcttggaattactgcattgcacattaagctccgtgctactggtggaaacaagaccaaaacccctggccctggtgctcagtctgctcttagagctcttgctcgatctggcatgaagataggccgtattgaggatgttactccagtccccacag

SEQ ID NO: 72981 - DNA, 446 bp, Zea mays
  Clone ID: LIB3078-018-Q1-K1-H9
cccacgcgtccgcgaatcctctccttccaccatctcgaacctctccttccgtctcctccgcggccgattcttccagtctccagccaccttcaactgccggccgcaagtggccccgcgtctcacccctaaccccagtgaagaatctaggcgtcgtctatccagccccgtcatcatcaccatggaggagcatgggctgtggtccagcggggccagcgacaagaacaagtccatggttgagcagctgcagaggtacggggtcatcaggtcgaccaaagtcgcggaggtgatggaggccatcgacagggggttgttcgtgccacctgggggctcgccataccacgatagccccatgccgattgggtacaatgccaccatatcagcaccacacatgcatgcggcttgcctggagctactggagaagaatcttcagcctgcaatgcgagctc

SEQ ID NO: 72982 - DNA, 416 bp, Zea mays
  unsure at all n locations
  Clone ID: LIB3078-018-Q1-K1-G3
ggatcgagcaccgggcgagataatgagcagcctgtcctcggatctctgcctcggatctgcacgcccagcaccggtcgggccgccatgacgcagcgccgcagcagctgagggtgaaggcggcgggcggccacagctgctgcacgccggccgcggcgttnagtgtcgggaggaggccgggcggcggcgcggtggtggtgagggccgggcctgggccgctgtcggagatcgagccggacctggaggaggacgccatcgacgtgtaccgcaccaacggcatcagcccggaggacttcgagtacgggaagtatgacggacaccacacctatttcgaaggccaagacaagaagggcttctgggaggatgtctccgagtggtaccaagaagctgagcctcctcagggctttcaagcactcatc

SEQ ID NO: 72983 - DNA, 433 bp, Zea mays
  Clone ID: LIB3078-018-Q1-K1-E9
cccacgcgtccgcggacgcgtgggcggcgccggcgtgctcgtgatctcaacccaaggcgggcctccgctccggtcacccgtcgctccacgcaaccatgtcgaggaggaagatcagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtc

SEQ ID NO: 72984 - DNA, 448 bp, Zea mays
  unsure at all n locations
  Clone ID: LIB3078-018-Q1-K1-F10
cccacgcgtccgcccacgcgtgcgcccacgcgttcgcccacgcgtncggcaatcaaaaagcgagctagggttttagggggagacagagaagcagagggaggctccatggacaaccccgagatgcagcgattcattcagaaagagcagcagaaggcgatgatgaacgagatggtcggcaagctaacgagcgcgtgctgggacaaatgcatcaccagcgctcccgggagcaagttcagctccggggaatcgacctgcctgaccaactgcgcccagaggttcctcgacatgagcgtgctgattgccaaacgcttcgagatgcagtgaggcgttgtcactcgaagctgttgcctggtcaatcgccctaagctnttcctttgatttgaggttccattgaggacttcggacgattcaacacaagagtttagtgtatntnttttatgtcttaccc

SEQ ID NO: 72985 - DNA, 439 bp, Zea mays
  Clone ID: LIB3078-018-Q1-K1-F11
ccatagtgtactcccgaaaagcgccaatgagtccaggattaaggagaacattgacatatgtggctggtctattcctgaagatttgatggccaagttctctgaaatcaaacaggtcaggctgctgacagctgagtttgtagttcaccctcaggccggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgctgaacacaagtattgtgtgactaatctgtgttttgatgtggtaaatgtaattgggttagtcacaataagagataagtgtctttgccacaagacttttggttcattggttgaagcatgatgtaaaccgtaaa

SEQ ID NO: 72986 - DNA, 439 bp, Zea mays
  unsure at all n locations
  Clone ID: LIB3078-018-Q1-K1-F12
ggtagctggcaccaggagccgtgggcaatggaagaggccacaccctgccctgctctggggcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctncaacacccagagtcgccggactttcatcaagtcagtacc

SEQ ID NO: 72987 - DNA, 434 bp, Zea mays
  Clone ID: LIB3078-018-Q1-K1-F3
gtgacaccaaatgatttgcaggctatgctgtttttgaacttctccaccggaccttttggttctgtcaagtctgcctactctgctgccgcggaggaattcaaggacaaggaaatcaagttccttattggtgacatcgaagccagccagggtgccttccagtactttggcctgaaagaggaccagacaccccttatcctcatccaggatggtgactccaagaagttcttgaaggttcacgttgaggctgaccagatcgtcgcttggttgaaggagtactttgacggcaaattgacgccgttcaggaagtctgagcctattcctgaggtcaacaatgagcctgttaaggtggttgtcgctgacaacgtgcacgacttcgacttcaaatctggcaaaaatgtccttattgaattctatgcccccctggtgcgggacac

SEQ ID NO: 72988 - DNA, 439 bp, Zea mays
  Clone ID: LIB3078-018-Q1-K1-F4
gccgccgccgctgcagtgtccatagccaccgcaggagactgagatggggggttttgtcgagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatatctgctagtatagcaggtgatatggttcttgcttctgcttactcgcatgagttgccacgatatggtctcgaagttggtctgaccaactatgcagctgcctactgcactggccttctgttggctcgccgtgcgctcaagacccgtggtttagataaggaatatgagggcaatgttgaggccactggtgaggacttctct

SEQ ID NO: 72989 - DNA, 438 bp, Zea mays
  Clone ID: LIB3078-018-Q1-K1-F5
ccgacatcgtctctgcggctcccggcgtgtcgctgcagaaggcgcggtcctgggacgagggcgtcgccaccaagttctctaccacgcctctcaaggacatcttctacgggaagaaggtggtcatcttcggcttgcccggtgcatatacaggggtcttgttcacaagcgcacgttcctagttacaagaagaatattgacaagttgaaagcaaaaggaatcgactctggtatctgcgtagctgcgaatgatctcgtatgtactggatggatgggcaaaaaagctagacgctgaagatacaattgagttctatggcgactatgatgggagtttccacacacgcttggatatggagatagacctttctgctgctgtgcttggccgccgatctcacaggtggctcgcctttgttgacgatggtaagatcaagtgtttcaatgt

SEQ ID NO: 72990 - DNA, 433 bp, Zea mays
  Clone ID: LIB3078-018-Q1-K1-F6
accgctctacaggctatctggcgatcacaatgctgagcattcagacccacatagggcgcagcttgctgggcatgccgcatcataatgctattctatctgcctatttatagtcatatttgacatcgtggaagtcttcggggtagatgttggactgaaaagctctcagtttcaggctttcagcctctcctttcttagcactcgtccaagttaagcatcaggagaaacgttgataatctcagaaccaggttactaattacctaactgaagatcatagcatgattccagctatgactcgatgtattaactgacatccttacctgcgaattaacaggggcaaccaatttccaactcaatttataaccttttctataataaagaaaccagtgatgcacattgtagttcacagctagcacttatgatacgcacatgcact

SEQ ID NO: 72991 - DNA, 439 bp, Zea mays
  Clone ID: LIB3078-018-Q1-K1-F7
tgcttgcagggttggtaaagtgagtgagctttttgtttatcagaacttcagccgtgccggcgttgaatctgttagtgctggtgacatttgtgctgtatgtggaatcgatgatatcatgatcggggaaactatagctgataaagttacaggaacaccattgcccactatcaaagtggaggagccaacagtcagaatgtctttctccatcaatacatcaccttttgttggacgggaggggaaatatgttactagccgaaatctccgtgacaggttgtatcgcgagctcgaaaggaatttggctatgaaagtagaagacggggaaactgctgatacatttcttgttagtggcagaggcacactacatctcacaatattgatagaaaatatgcggagagaaggatatgaatttatgattggacctccaaaggtcataaaacag

SEQ ID NO: 72992 - DNA, 421 bp, Zea mays
  Clone ID: LIB3078-018-Q1-K1-F8
cgcgccgccgccgccgccgccgccgcagccgcaacaatgccgtcgcacaagacgggccggatcaagaagaagctggcgaagaagatgcgccagaaccggcccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttccttctgttttatcaatgtgtcagtttttctgtaagctagcaagtgttgctatgacgcttttattaagattctggtgagcggtgatgttaagagaaaattggcactactgtggtgtaccccaagattccttgcagcattgctatgctaagtaaagaaccctttatcttattatat

SEQ ID NO: 72993 - DNA, 200 bp, Zea mays
  Clone ID: LIB3078-018-Q1-K1-F9
cccacgcgtgcgcagttatctgtaaaccaccgagatcgagtgcaagcagacttggttgagttacaatttgcccggtggttgctaatgatatgggatgaaacggttgccggtttggctgctattaaggttgtgtaatctgatgggcaatttcagcattctaatgccctaatgatgaatctttggccaaaaaacaaaaatat

SEQ ID NO: 72994 - DNA, 444 bp, Zea mays
  Clone ID: LIB3078-018-Q1-K1-G10
gagctcgttttcttttcctctaggcagagaagaggcgatggcggcgatggcatctctcggcgccctggcgctgctcctgctgtccagcctctcccgctgctcagccgaggcctgcctggagccccagatcaccccttcctactacaccacttctgacgctgtcatttccactgagaccgtcttcattgtggagatctccctgacatgcaagaacagggtccagaacatggctctctatgctgacgtcggtggaaaacaattccctgtcactcgaggccaggatgtggggcgttatcaggtgtcctggagcctggaccacaagagcgcccacgcaggcacctatgaggttagattcttcgacgaggagtcctacagcctcctcaggaaggctcagaggaataacgaggacatttccatcatcccgcctctggttacagtcagcgt

SEQ ID NO: 72995 - DNA, 443 bp, Zea mays
  unsure at all n locations
  Clone ID: LIB3078-018-Q1-K1-G11
gcggcgccttccccaaggccgacaaggccgtcgtcgncgtggaacccaagttctaccctgccgacgacgtcaagccccgcgttcccagcacccgcaagcctaagcctaccaagctcaggtcgagcatcacgcctgggacggcgctgatcctcctcgcaaggcgcttcatggggaagagagtggtgtttctcaagcagctcaagtccggcctgctccttatctctgggcctttcaagatcaatggagtaccgatccgccgtgtgaatcagacctatgtcattgctacatcaaccaaagttgacatctctggtgctgatgtcgccaagtttgatgacaagtactttgccagggagaagaagcagaacgtgaagaagaccgagggcgagctttttgagacagaaaaggaggcatccaagtcactgcctgacttcaagaaggatgac

SEQ ID NO: 72996 - DNA, 440 bp, Zea mays
  Clone ID: LIB3078-018-Q1-K1-G2
gaggagcagctacactgcggacggacttcgggcatggagggccagttccaggttggcggggaggaggtcatgcaagcatggtacatggatgacagtgaagaggaccagaggcttcctcatcatcgcgagcccaaagaattcattcctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggctaagataaagaatttctttgaagaacacttgcatactgatgaagagatacgctattgccttgagggcagcggctactttgatgtgaaggaccaagatgatcaatggatccgtgtaacggtaaagaaagggggcatgat

SEQ ID NO: 72997 - DNA, 438 bp, Zea mays
  Clone ID: LIB3078-018-Q1-K1-E8
gaggcggtgtcgctcatcgcgcaccggctgggccggatggacccgccgctgcggcgggagtgcatcgagcacctctgcgaggcgcactcgcaccggtggagcatgcgccgcagcaaggcccacttcttccgcctcatggcggcgctggcgcccctgttcacggggctcaggtggttcgtcgacgtctgtcactggaagaacccgtccaccaccgtcgcggtccacatcatctacgccatgctggtgtgctgccccaacctcatcatgcccaccttcttcatgtacaagttcctcatcggcctctggaactaccggcgccggccgaggcacccgtggcacgtcgacaccaaggtgtcgcacgccgagatggcgcacctggacgagctggacgaggagttcgacgacttcccgacggcgcgtcgtcccgaggtgatccgc

SEQ ID NO: 72998 - DNA, 436 bp, Zea mays
  Clone ID: LIB3078-018-Q1-K1-D5
cccacgcgtccgtggacatgcactaccctgattttcgttgctgcatctattgccacttgggtcacctacctatctcacaaatggcacaagaaggaatggaactatgatatcaacttgtgttacctggtctgctggcttattctatggctacgtaacctttgttcctcttcttctatatgttattctcaagtatttctcagctcctgctggtctagtgcaattgtggtgcctatacggatactccctgttcatcttcattccagcatcgcttctgtctattgtgccaatagaaatattcagatgggtgattgctggtgttgctggtttcatgtctgctactttcgttgctgtaaatctccgtgcgcacattgtaaactctggcgagcgatggttcctgatcgttgcagggatattcctgttgcagctggggcttgct

SEQ ID NO: 72999 - DNA, 439 bp, Zea mays
  Clone ID: LIB3078-018-Q1-K1-D6
cccacgcgtccgggcctgttcttctttgatttctaccttccacctgagtatccggaaggtcctccgtcagcatactaccattctggtggtttgcgtgtaaatccaaacctgtatgtggatggaaaggtttgcttaagtctcttaaatacttggaccggcagagggaacgaagtgtgggacccatcatcatcaagtattctacaagtactggtttcacttcagggattggttctcaatgaaaaaccctattttaatgaggctgggtacgagaagcaagttggtactgttgaaggggagaagaatgcagtgccgtataatgagaatacgtacctgctgagcgtgaaatccatgctgtatatattgagacggcctcctttgcattttgaggattttgtgaagagccatttccgcaagcgtggccactacatccttaaagcct

SEQ ID NO: 73000 - DNA, 441 bp, Zea mays
  Clone ID: LIB3078-018-Q1-K1-D7
ggcctcgagtgcttttggcaccctcgcagtggcatgctgttaattcatttggagctctgaccggtggacaacttccagtacggagtacaaacctggcctgtttcctagaagccattgaagctggctgtacgaacacaacaggaaatgatgattaccacgtgatggagtttgactgcgaagatagtggcttaccactttatcaaattatgctacctaggccagccagccccactgggtctgggtgcaccgatgcagtcctcgtaacagaagcagatcttgagggctatgatacttatattggtaccaggaaagatgcggtgtcgttggaagtagccactcgcagtcccatcatgaggagattgtcctgcctctttggctccctcaaacttagtaacagcaactgtgagccagcttcaagccggttcactgaggttcgcgcct

SEQ ID NO: 73001 - DNA, 439 bp, Zea mays
  Clone ID: LIB3078-018-Q1-K1-D8
gaatagggcagttaaatgatgaaccaaatggttacgaagatgatgttatagaagatgatgagatatctcctagaaagccagaagctaaggctgtgtatgttaaagatgacttctttgattcactctcttgcaaccaaattgacaatggagggaggaacggaagagtgaaattctctgagcagaggaaaatagacactgagacctttggtgactcagcaaggcatcgaccaatgggcatccgaggtaggggcccccgtggcggcgctcgtggtcgtggctattatggtattagaggatatggatatacgggtagggggcgtggctactcttacccaaatcaccagccgtgatacctcggtgtctggaagcacactgaatggcaatggtaaattggccaatttgcgtggtaaaactgagatttatcgcagattacagtgcc

SEQ ID NO: 73002 - DNA, 430 bp, Zea mays
  Clone ID: LIB3078-018-Q1-K1-D9
cagccaagccccaatctgaatcttgctgcagttggcctaacagcaggatctaatggagggctagggggtccagaccgtatttttgtgggtggcctcccgtattacttcactgaagcgcaagttcgggagttgcttgaatcattcggtcctcttcgagggtttgatcttgtgaaggatagggaaactggtaactcaaaaggctatgcattctgtgtttaccaggacctcaccgtcactgacatcgcttgtgctgcactaaatggtatcaagatgggtgacaaaacccttactgtcagacgagcaaaccagggggcatctcagcccagaccagagcaggaaagtatcctattgcaggcacaacaacaggtgcaattgcagaaacttgtgtatcaagttggagcgctttctacaaaggttgtatgcctcacac

SEQ ID NO: 73003 - DNA, 440 bp, Zea mays
  Clone ID: LIB3078-018-Q1-K1-E1
catgcggcgctccgctcgctcttgtctggtggctggtgcgcgcaggcgccgggctcagggagccccggcaagagctggcgttgtggcgggccaccaacagtgatggaggtgcttgctgccactccttgtaggcgtcgccttccttgtcgagatcacctccctttgccgcctcgacatggcgaagaacgccgaggtggtcgagagctagaccagctccttttaccactgctcctcccattggggtgaagccgtgggtcggggcgtggtcccgaggtcaggcagcgatggcgaggatgaagagatccgatggtgcgagcagcggttcgagagggaggatgtcgtgccctacgaccgcgacgttgacagggatcccgtgcttgtcggtggcgcagccaaggactggagtaaatgctacgtaggttgtgaaatttgtttttttc

SEQ ID NO: 73004 - DNA, 320 bp, Zea mays
  Clone ID: LIB3078-018-Q1-K1-E10
gatgcacaagtcctgcaggatgtcgcatgataccatcgtcgtcgtgagcctgaaccgggggaatgcccttgggctgggggcatgccgatgcggttcaacggcgacaccgaaccaagcggatataccaccgagcaagaccgctaggaggaactgccatgctgtcgacggatgctcatacgctctgcaagagctggcagaactgatagctgtcgacgctgactggactaacgatgaatgcatatgtgagttccgagcttaccaccacacagagaacttgatttgtgacatctatcacatcacaagcaacaacgtcgacatgc

SEQ ID NO: 73005 - DNA, 438 bp, Zea mays
  Clone ID: LIB3078-018-Q1-K1-E11
aacgccggcgccggcaacgtcccagtcgtcgtgtccgagagcggctggccgtccgccgggggcgacgccgccaccgcgggcaacgcgcagacctacaaccagaacctcatcaaccacgtcggccagggcacgcccaagcgccctggccccatcgagacctacatcttcgccatgttcaacgaggaccagaagacgggagccgagtcggagaggcacttcggcctcttcaacccggacaaatcgccggcgtaccccatcaatttctcctaattcctaaacaagacgccgaggtccattccaagacatttataaggcaatacacacacatagatatatacatacacatacatacgggagaaagtagaataaataaactgcctgcagtagaatgcaaagtgtattcatgtaaggcaactgcttcgattatttcctaaagat

SEQ ID NO: 73006 - DNA, 442 bp, Zea mays
  unsure at all n locations
  Clone ID: LIB3078-018-Q1-K1-E12
cccacgcgtccggtgggaggaggccgacggcgaggagctggtgctggtggcccctaacgtcctgtccgtggagcacgcgctggagcgcatggagctcgtgcactcctgcgtcgagaaggtgcgcatgaacctgcgcacgggcgccgtgtcgcgcaccccgctctcggcggggaacctcgacttcggcgtgatccacccgggctaccttggccggcgcaaccggtacggatacctcggcatcggcgaccccatgccgaagatctccggagtggccaagctggacttggaccgcgccggcacgggcgactgcacggtggcgcggcgcgacttcgggcccgggtgcttcgcgggggagccgttcttcgtccccgacgacgtggagggggacggcaacgaggacgacggctacttagtgtgctacgtncacaacgagcgcaccggc

SEQ ID NO: 73007 - DNA, 433 bp, Zea mays
  Clone ID: LIB3078-018-Q1-K1-E2
ctcgtctccgctcgctctagcgtgggagaaggcggaaccggagtgccactcgtgcgagggcggctcgccaccctcgaccggcggcgtccccctgcctcccgtcagcataccgtcagtcccgctgccccctgtcagcataccgtcggtccccctgccccctgtcagcataccgtcagtgcccctgccgccggtgaccctccctaccattccgatcgttgggggaagcccgagcccgacgaagaagggacaccggaaggcgtgcccaccgcctacgtctaccccgacgccgacacccacgcccacgccgtactcggacaagtgccccatcgacgcgctcaagctcggcgcctgcgtggacgttctcgggaacgaggtgcacgtcggcgacgccaacgtccagtgctgcccgctcgtgaagggcatcgccgggctc

SEQ ID NO: 73008 - DNA, 346 bp, Zea mays
  Clone ID: LIB3078-018-Q1-K1-E3
agtcctgcgcgcggagccttcatggccaaccacttctgacctaccactactgccgtaagggagggctcagatacggataccaccagccttattgggaagcccctactttgtcacggtaccgaacatggcttgtgtctctaagaggacctcacacccgttatgctcagccatgatggagacgtccaagaagtctttgaacataacacctgaagctgtccagatcactcgtaggttgaatgaaaacatataatgctaatatacgccctgtaagacactggagcctattactgaggtcagcaatgatcctgttctaggggttgacgctgacaacgtccacgacttccgc

SEQ ID NO: 73009 - DNA, 435 bp, Zea mays
  Clone ID: LIB3078-018-Q1-K1-E4
gctttgactgccgtcacttggtgctcagttctttcccctgctcctccgcctcttctcggatctcggcgccttcttcggcaactgcgagcgagatggaggcgcaagacgactgcaagtggcggcagatcccggcgttcggcgactggaacgtgtgggacggcgacacgcccgtcacccagtacttccaggcaggggccttcttcttcgcggcgccggcggagaagggcgacgcggatctcttcaaggtgccccagttgcctgccaagccctacggctacaagaagtgcgttgttcgagtgaagggggagaaagaaaccgctgtgccgccggcggcgaggaagggacgcaagaggcgctgcgtgagcgagcagcacaagtggaagcccaagggagctgtggacgaggacctgtacaagatctccccgcagcttctct

SEQ ID NO: 73010 - DNA, 367 bp, Zea mays
  Clone ID: LIB3078-018-Q1-K1-E5
acgccatcgcgtccatccgtgccgcggaccttcatggtcaaccacttctacctacactactgccgtaagggaggcctcagatacggatacaaccatcattcttaggaagctcctactttgtcacggtaccgaaaatggctagtctcgctaagaggcctcaaccgctatgctcattcatgatggatacgtacaagaattcttgtgaacagaacacctgtatctgtccagactacgcgtagtttgaatgtaatcatatcatgctgatatacgtcctgtaaaacactggagaatattaatgaggtctgcattgatcctgttctaggggttgaagctgacaacgtccacgacttccgctctaaatgatcca

SEQ ID NO: 73011 - DNA, 438 bp, Zea mays
  Clone ID: LIB3078-018-Q1-K1-E6
cggacgcgtgggcggacgcgtgggcggacgcgtgggcggacgcgtgggctggcgctgagggcactgggcaggcccaacgccgtggacgggaccatccccgaggtgtcgccggcgctgcgcgaggagttcgtgattgcgtccaaggacgacgaggtcgtggacgcctgagcgagcatccacgcgccagcatgcaagcagcgtcttatctgggccggcgccatcacggggtttcttcttttaatctgggactttgttgttgttggacgaatgaattcccttcgatcggttagctttaatctgtctcgttagtgtgtcgtgttcgtgtagcaccatgccacagctacgccatgccgtgtgctctgtcacgtgggggccattcgtggggtctcctgctgctgtcagaacgaataagagaagatggaattgtggtgaaacaat

SEQ ID NO: 73012 - DNA, 438 bp, Zea mays
  Clone ID: LIB3078-018-Q1-K1-E7
ccgctatctgcctccttaccaataaatttatcattcctgagattagcaattatgctgggatgttcttcattcttcttttcgcctccatttttgccactggtatattggagcttagatggagtggtgttggcattgaagattggtggagaaatgagcagttttgggttattggtggcacctctgcccatctcttcgcagtgttccagggtctgctgaaagtgttggctgggattgataccaacttcacagttacctcaaaggcatctgatgaggatggtgactttgctgagctatatgtgttcaagtggaccagtttgctcattcctccgaccactgttcttgtcattaacctggtcggaatggtggcaggaatttcttatgccattaacagtggctaccaatcctggggtccgctctttggaaagctgttcttctcga

SEQ ID NO: 73013 - DNA, 306 bp, Zea mays
  Clone ID: LIB3078-018-Q1-K1-D4
aaaaatcagtgggctgatgaagatgttgaagaagatgatgtaaaagaatcatgggaaggagaggaggaggaggagaaacctaagccagcgccagtggaaaaggttgctgcaaaacctagcactaaggctcctgctaaaaagggaaaacagcaagcattgacaagtgctgaagaaccagatgagcctcctcttagtcccacttcacagaaaattcgccaacaaagacttgtggaagaagctgacttcaagtcgaccaccgagctttttgccaaaaaaggccatgagccaaaggcacttgaaaccttt

SEQ ID NO: 73014 - DNA, 428 bp, Zea mays
  Clone ID: LIB3078-018-Q1-K1-C12
cccacgcgtccggcgacggcgggggcgataatcctggcgtcccagctactgccgcccggggcgagtagcgccgccggcacgttcgacctgcagctcatgctgccggagaagtccagcgaggaggccaaggccgtggtgcggatccacgcgcgcaacctgctgggggtgaagcgctatatagacgccggggcgtggcggaagctgcacgcggctctgcgctccaatgcgtacaacctcaagcaggacctgtacgctatcatacaggcgaggcccacggggcagcgctctgagctccgcaggctctactgcgacctcttcaacagcgtcaccagcctggattacgccgccagagacaaggacgcgctccaggtgcaggagcactacggcaacatcgtctccgctctcgatgagattttctccaagatcac

SEQ ID NO: 73015 - DNA, 437 bp, Zea mays
  Clone ID: LIB3078-018-Q1-K1-C2
gtggagtagtggcaggcttttacttctatcgcattgcagctggtagccccaaagagctgagcagcaacagtgattcagtgaactaatgcacttggatgaatcagatgatcatgggggaacgcagacccagaaggctatggcctgtttgctttcgatttccttcatcatccttcaattcaggcaaagctcggttgtaaggtgtccgcatgatgaccacatggattcagaagaattgcttgtttactcggccctcttcccgcactcctttgttcctttgctcatgtagtatagatgatagacttgaacaacatcaataaacgacattcaaaggccatgcagttagctcttcagtttgtctgctgtttgtttttcatggggacagcccgaaaggtcggtgaagcgttcaatgtttcgtgaagtgtccgaaaacagtcagt

SEQ ID NO: 73016 - DNA, 445 bp, Zea mays
  unsure at all n locations
  Clone ID: LIB3078-018-Q1-K1-C4
gccaggactgcgaggcgtcgccggccggcgacggcttcgtctgcggtgactttatcttgagcctgaccgagcccccggtctgcacaccgaggccgtgggactgctgcgacagcgtggcctgcacaagggactacatccccaactgcatgtgcctggacaaggtggagtcgtgctcgagcaactgcgaacggtgcgagtttctgtatcattcggaccctcctcgcttccaatgccgagacatcttccacggctatcctggtcccaagtgcaggacatggatcagtacgagcaactagctcagctcagctacttgctaaaagtagcgtagcgcagcgcgcgcggctacttgctagtatacgtacgtncacaaataaaaataaaagtggctagcgtacaaagctaacatctggttgttcgtccccgacattggaccgattagcctagc

SEQ ID NO: 73017 - DNA, 334 bp, Zea mays
  Clone ID: LIB3078-018-Q1-K1-C5
ggagatatccagtgactgtagggatctttgtggaagccggaaaacgtctaacaggttgaggaagaattctgccttatggtctgtaccacatgtttttgctgctacgcaagtaaagaactccacgtctgtcaatgttagttttacaacatcgtctacggacaaaaaaaaaaccccccgctatttgattgttgctaagccttcgtacgacgtgtaaatggtttggtacaatgagtgctgcgactacgattgagcacccctctacctagtttgcaaaaaaacagtgtcccatggactgtctgttgtccctctatataaatgtccaatgaagcttgct

SEQ ID NO: 73018 - DNA, 441 bp, Zea mays
  Clone ID: LIB3078-018-Q1-K1-C6
cgccgtcgccgcccgcgacggagttgtcgcgctcggcgggccttcgtggaccgtgcttgtgggcagaagggactcgaccggttcgttccctagccagacaagcgacctcccacctccgacgtcgagcctccaagcactgttagccgcgtacagcaagaagaacctcgacgcgaccgacatggtcgctctctcaggcgctcacacaatcgggcaggcccagtgctcgagcttcaacggccacatctacaacgacacgaacatcaacgcggccttcgcgacgtcgctcaaggccaactgccccatgtccggcggcagcagcctggcgccgctggacaccatgaccccgaccgtgttcgacaacgactactacaagaacctgctgtcgcagaaggggctgctgcactcggaccaggagctgttcaacaacggcagcaccgacag

SEQ ID NO: 73019 - DNA, 442 bp, Zea mays
  Clone ID: LIB3078-018-Q1-K1-C7
gcggtgtggttcaaggcgggctcccagatcttcagcgagggcgggctggactacctcggcaacccgagcctggtccacgcgcagagcatcctggccatctgggcgtgccaggtggtgctcatgggcgccgtcgaggggtaccgcgtcgccggcggcccgctcggggaggtggtcgacccgctgtaccctggcggcagcttcgacccgctcgggctcgccgacgacccggaggcgttcgccgagctcaaggtgaaggagatcaagaacggccgcctcgccatgttctccatgttcggcttcttcgtgcaggctatcgtcaccggcaagggccccctcgagaacctcgccgaccacatcgccgaccccgtcaacaacaacgcctgggcttacgccaccaacttcgtccccggcaagtgagcgaagggcatgatgcttgcatgcg

SEQ ID NO: 73020 - DNA, 394 bp, Zea mays
  Clone ID: LIB3078-018-Q1-K1-C8
gctgcaccatctgcgaaaagatcagcggcctcggctgtttctcagacccaacattacgtgatgctaaatgctccttaagtgcctcttgaccaccacttcacgctcaagtgtgcatcatactacatgatatcaccgcgaaagttcaattcagatcacctcttgctgtacgcattgacacactcttgaatgaacatgatgtgggggctacctataaaacatgccgtcaaagctgtcattgaaagtctcgctaccatggcccatctgatagaacaagacgcccttactcgggacttcgtggaatctgacgatgccagtgtggatatctacgatctcaatcgagtgcctgtactgatcaacgaccacgttgacgttgctatggcatgctactcatata

SEQ ID NO: 73021 - DNA, 432 bp, Zea mays
  Clone ID: LIB3078-018-Q1-K1-C9
cggacgcgtgggcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgccggagatcccggaggatctctacttcctcattaagaaggccgtggcgattaggaagcatctggagaggaacaggaaggacaaggac

SEQ ID NO: 73022 - DNA, 394 bp, Zea mays
  Clone ID: LIB3078-018-Q1-K1-D1
cccacgcgtccgcccacgcgtccgcccacgcgttcgatcgagtacagtcggctaggtggtgctggtggtacgacgacatgggggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgacggccgcgccgtctgaagcgtgctgcgacgcgctgtgcgatggcggacctcaagtgcctgtgcggctacaagaactcgccgcggatgggcgtctacaacatctaccccaagcgcgccatggagctttcggcca

SEQ ID NO: 73023 - DNA, 380 bp, Zea mays
  Clone ID: LIB3078-018-Q1-K1-D10
cggacgcgtgggcgcgggatggcgcggcggcctggcggggacggctacggcgcgggccgggaccgcgcgcccacggagatggcgccgctgttccccggctgcgactacgagcactggctcatcgtgatggacaagcccggcggggagggcgccaccaagcagcagatgatcgactgctacatccagaccctcgccaaggtcctcggaagtgaggaggaggcgaagaagaagatctacaacgtctcgtgcgagcgctatttcgggttcgggtgcgagatcgatgaggagacatctaacaagctcgaggggctccctggtgttctctttgtgctaccggattcgtatgttgaccctgagtacaaggactacggagctgaact

SEQ ID NO: 73024 - DNA, 443 bp, Zea mays
  Clone ID: LIB3078-018-Q1-K1-D11
ctgaatcctccgcaactcgccgccgccgggaccgaccgacccgatcctatcgatcgaggatgtcgtacgcctacctcttcaagtacatcatcatcggcgacacaggcgtggggaagtcgtgcctgctgctgcagttcacggacaagcgcttccagcccgtgcacgacctcaccatcggcgtcgaattcggcgcccgcatgatcaccattgaaaataagcccatcaagctccagatttgggacacggctggccaagaatcattcagatctattactagatcatactacagaggcgctgctggtgcccttttggtttatgatattactaggagggagaccttcaaccatctcgcaagttggttagaagatgcaaggcagcatgcaaatgctaacatgactgtgatgctgattggaaacaagtgtgatctttctcatagacgtgct

SEQ ID NO: 73025 - DNA, 420 bp, Zea mays
  Clone ID: LIB3078-018-Q1-K1-D12
cccacgcgtccggcacactcagctatccagcaaaagagatcgagacgcaggagtcatgggcaccgtcagcgccgtcgtggtgaccaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggagcccgcgctggcgctcgtggacgagcgcatgtccacggagggcaccgggctgagcctcgggctcagcaacaacctgctggggtggatcctcctgggggtcttcggcctcatctggtccctctacaccatctacacctctgacctcgacgagga

SEQ ID NO: 73026 - DNA, 440 bp, Zea mays
  Clone ID: LIB3078-018-Q1-K1-D2
cttcaacgagttccaggacctcgtcgatcactacgagggggctgagctgtcggagtacggacttcggttgatcgggtcagaccttgagcactacatccgcaaactgctgtacgacggggtgatcaagtacaacatgaggtccagagtcctcaatttcagcatgggcaagcctcgcatcaagttcaacagcaaccagataccagaaaagatatagaatgtacttatccaacgcccttaaaagaatggtttctctccattcgattaccgagcaagatgtatactctgcagtcccagatacgatccagagcattccagaattcatattacgcagatgcaaagccatacaccgattctgttggcagaattttgtcacccctgcacagtaataaccacataacgagagtctgggcaaaataaggggtttggctcgagttttagat

SEQ ID NO: 73027 - DNA, 347 bp, Zea mays
  Clone ID: LIB3078-018-Q1-K1-D3
cttacacgagcgcccacacctccgcgcactctactaagcgactgcactctcctagtacgcacggctgtacaacgactggggggtctccaactacatgcggacactgttctacaactcggtgatcttgttcactatcacactgatagtgctcaacgtcatcacgggcaaccctctgatcaagttcaacaccgaccagatccccatgaacatatagcatgtactgatgcaacacccttaaaagaacggtacctctgaattcgactaccgagcaacatctatactctgcagccccacatacgatccaggaccttacagaattcatatgacgcagatactaagccatacac

SEQ ID NO: 73028 - DNA, 440 bp, Zea mays
  Clone ID: LIB3078-018-Q1-K1-C11
ggcattgtctacgtcgaccgcaaaaataactacacgcgctacatgaaggagtcagccgagtggttaaaagagttcaatactgcgaagaagcctagcaagaagattattacgccagcttaaaaacatgggacctcgtgatgtgggtacggtgccacccatgaaataaaaacctagtgtgtggtttgaaacctaaatttttctttttcttttttgcaccatgagagaggtagtggagtcatattctccagcaccgtggctaataatgtattgttgcagtacaatctagcattgtcgtcatgcaataaataaagtgactggtttccctatttcaaaaaaaaaaaaaaagggcggccgccctttttttttatctcattccgtattttatttcctttttcaaactccactctgcaaacagtgtcaaacagtgttgtcatctacag

SEQ ID NO: 73029 - DNA, 397 bp, Zea mays
  Clone ID: LIB3078-018-Q1-K1-A9
gcgccactgtccagtgcgcgcgtcaagcttgcttagctagccgccatggcctccctcggcgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgt

SEQ ID NO: 73030 - DNA, 426 bp, Zea mays
  Clone ID: LIB3078-018-Q1-K1-B1
ctgaggcacatcgtgcacagagcgtaccatgctctcgaactggtggctgacgtgccgggccacatccacgccgatggctcccacgctggtaatctgctatgaccgggttacgacaccgaacgcttcctctggggctcctactgctccttgcgcatctactacgatccttccccctccgacggcggcagcgagatccggtgggacgggccctacgcgctcgagcggcaagagccgtatatctggccatgcccgtgcttagccatggaggtcaacgtcagcagggacctcctgatctggctgtgcgagtggatcacactacagcgactgaccgggctcgagaccgtcgatggcggatgtatccatacaaaggggaccaacgtgtttgcttgggacgagcagctgggctctctagacgacagtcgacag

SEQ ID NO: 73031 - DNA, 437 bp, Zea mays
  Clone ID: LIB3078-018-Q1-K1-B10
ctgggaggcacacccctggtaccttcactaaccagctccagacctccttcagcgagccggggctgctcatccttaccgacccaaggactgaccatcagccaattaaggagtctgctctggggaacatccccaccattgccttctgtgatactgactctcccatgcggtatgtcgatatcggcatcccagcgaacaacaaggggaggaacagcattggatgcctgttctggcttttggccaggatggttctgcagatgaggggcactatcctccctgggcacaagtgggaggtcatggtggatttgttcttctacagggacccagaggaagcaaaggagcaggaggaggaagctgctgttgcccctgagtttgccgcaatcactgattaccaaggagctgatcagtggggtggtgaccagtggacctctgatgtgact

SEQ ID NO: 73032 - DNA, 440 bp, Zea mays
  Clone ID: LIB3078-018-Q1-K1-B11
accgcagcgacgagcgggaggagatgaagatcatcattgacacggatcccggcatcgatgacagcgtggccatcctgatggcattccagatgccgggcgtccaggtcctagggctcaccaccatcttcggaaactgcaccacagagcatgccacacgcaacgccttgatcctgtgcgagaaggcaagccatctagaggtcccagtagctgagggcagccatgagcctctcaagggaggaaagccgcacgttgctgacttcgttcatggacctgatggcctcgggaacgtagatcttcctgatcccactatcaagaaagtggaggaaagtgctaccgacttcttggttgataaggtctcgcgatttcctggagaggtctctgtgctcgccttgggtcctctgacaaacatagcattggccatcaagaaggatccctcattc

SEQ ID NO: 73033 - DNA, 442 bp, Zea mays
  Clone ID: LIB3078-018-Q1-K1-B12
ccgttaacctcacggtctccacgagcggactcggggccagcgtcaacgcgctgggatcggccgtcaccgtcctcacgtctggcaacgtcatggacgagaactccttcagtaacccgaacaaggttgcgccggtgaaaagccagctgagcaacgccgcggagcagatgcaggtcacgctggctcctcactccttcaccgccttcgatctggcgctggctgagcccaagcttgtggcggagatatgatgtgtgtgctgttagcgatcttgatcgataaaaaggctttgtactggtgtactacgtactgttgcttcatgaaataaaaaccacatcaggtttttgcttggtgttggttggtttcctttctcttgtacgtgtttgctttgcatgttcatcaccatctactgtacgggatgatggtacattgatggtgagaacgatag

SEQ ID NO: 73034 - DNA, 437 bp, Zea mays
  Clone ID: LIB3078-018-Q1-K1-B2
attaccttttgcttcactgttgtctcttacattggcagattgtatgatataatagatagacattttaaccatatgcgattctcttgcaggttgttatgttgctccttaccataatttttgctgtagtccatagtggtatggcaagcctacgggaaagtggtgagaaaatagtgggggagcgtgtttaccgtgtgctgttcgctggaatttcactgcctttagcagttactactattgtgagtccttggtgctcttttcccaaaggcagatatacctcaatgattaacaaatcttactgtgccttatacagtttccatatcttttcaggtatacttcataaatcatcggtatgatggtactcaattatggcaagttcagggaatcactggcattcatgagcttctttggttctcgtcgttcatttcgttcttctttct

SEQ ID NO: 73035 - DNA, 356 bp, Zea mays
  Clone ID: LIB3078-018-Q1-K1-B3
cttcatgcgcggacctaagacatcgcctagagacctgcagaatggttatgcgatggtaggcgggtttataacctacggatgctgtgggcaagatctacgttactctatgacaagtggcgcagggcatgagggtctaagtctgagatcactgataacgtgcttcggaaacatgacttatgccaatggatgcaccattgatgctgatgggctagagctcttactccatgcattgatcgatgcctggagatcatgttgtggggacaaacgtgggataaagtgcttgacataggtggacagacttgcgatctgacaggctggttcacattgcatgggggagacgaatgacatgagggaat

SEQ ID NO: 73036 - DNA, 437 bp, Zea mays
  Clone ID: LIB3078-018-Q1-K1-B4
aagaaaatcaccaacgcaagggatcttatcaacgttttggaagaagccatcagaggtgcgtacgcaatcctgataattgcagaggatattgagcaggaggctcttgctacccttgtcgtcaacaagctcagaggatcactgaagatcgctgccatcaaagcccctggttttggagagcgcaagactcagtacttggatgatattgccatccttactggagcaactgtaatcagagatgaagttgggctgtcacttgacaaggccgacaattcagttcttggaacagctgcaaaggttgtccttacgaaagagtcgacaacaattgttggtgatggcagcacccaggaagaagttactaagagggttgcacagattaaaaatctcattgaggcagcagaacaagaatatgaaaaggaaaagctcaatgagaggatagc

SEQ ID NO: 73037 - DNA, 439 bp, Zea mays
  Clone ID: LIB3078-018-Q1-K1-B5
cggacgcgtgggcggacgcgtgggcttcatcagagcagactactgatgctgatggaacgactaatggtgatgtatctgaaaatctgctttctcgaaagccgagctctgatgagttaaaggctcttttggctgattcggaacgaagtaagcttttgagaagactcagtgaagcaaatcaatataaccgattcctcaagagacagttgcaaataaaggatgatgcagtcgtaaaattcaaaggtgaacttgctgttttggaactagaactgcaggctctggttggcctagctgaagaggttgctaattttgatgttccgttagggtctaggaagataaacggaaaatatattcaatctcatcttctctccagattagaagctgtccatgataagattatggaacaggtaaagagtgttgacgctttaaagacccaagaaat

SEQ ID NO: 73038 - DNA, 344 bp, Zea mays
  Clone ID: LIB3078-018-Q1-K1-B6
cccacgcgtccgggccgccctttttttttttttttttttttttttaataatacacgtaggagtatagtactggattattacactcggcttgtacacacgatggtacatacggcgagtacgttacgtgaacacggccattattttagttattactaggctgacacgcacgtctcagcgctcaccactttattccgtacacacagataacgactacggtcacacggtcgccgcagcagcagcactcactcgcacacgtcgtacgcctcctgcctgcttgcactttattatgtagcactaggattcgtgtgcggtgcacgtgtgcgaagcctagttctagatcgcga

SEQ ID NO: 73039 - DNA, 425 bp, Zea mays
  Clone ID: LIB3078-018-Q1-K1-B7
gcgcatcaagggtgtggaggattacatcatgtctataaagccagaactgatagtacaagtggagcctattgaggacccttatggcccattcataactgatgataagttggatgccattattgacagtaaggatacattaaatggtggactggctgcaaataggaaaagagaagagaaagggttcccactgttgaaggatgaggttgatgatctcctttacggcggcgaggagggggaaaaattgactacttctgctttaaggaaacttgaggcataacaagctcaacagagtgatacataatctggtagcctcgaagctttttagggaggaaattgaatacttcgatctggctagctgaatgcacatatactggggcgatctgctacaagctcagtgtgaacaatgaatgtgatcaggagctgac

SEQ ID NO: 73040 - DNA, 267 bp, Zea mays
  Clone ID: LIB3078-018-Q1-K1-B8
tggtctcccaccggcgacgtctacgtcggtggaaccactgggcttctgatctgggccggcaccctcgctgggatcctcggcggcggcgccctcctcgtctacaacaccagcgccctctccggctaaggatatccaatgcatgcgcttcttgcgattcgtcgtgtaaaatcagggtgtctgtctataatctagcctccatggatgctcaaccttcgtcatgtaacaataatcagtgctactcttcattacataattttgatgctatat

SEQ ID NO: 73041 - DNA, 435 bp, Zea mays
  unsure at all n locations
  Clone ID: LIB3078-018-Q1-K1-B9
cacagtttgttcgccaaggagagcagtttgttgcgcggtctgccccagccctgaccccgggagatccggggctgttctcggttctttacgcggaggcggaggttggtttctgatctggggatcggttcgtgcggggatgaatacgaggccggtggtgctcgtcttcctcctgctcgtgctcgtcatcacgtcgcagttcgagtggaagcagcagatcggggaggccgcggacgccgacccggccgctgcccgccgccggcagcagctgcacgccagggaggatgccgtcaaggaaaagatcatattatcacaggagaaaaatatccaacagcttaaccagcttatcgagagccttcagcgccagctactgcactgccgtggtagcaataacactgttcatgctgctgccgncgttgccacagaagcgagtgaagt

SEQ ID NO: 73042 - DNA, 429 bp, Zea mays
  Clone ID: LIB3078-018-Q1-K1-C1
cggacgcgtgggcgcgagtccgcgactccgcaccaagcaaatcccctgcccccaaaatgttgctagggattcgaggggaggaaaatccaggcgcccaggcctggcaatccgttcgtcggagaggccatgagctcggcgcaggatccgttctacatcgtccgggaggagatccaggagtcgattgataaattgcaaagtaacttccaccgctgggagcaaactgcttcaaacacaggagaatatgttcatctgacaaaggagcttctgaccagctgtgaaagcatcgagtggcaggtagatgagctggaaaagacaatctcagttgcatcaagggatccatcatactatggacttgatgaagttgaactttccagacgaagaaactggactggttctgttcataagcaggttggtacagttaagagagct

SEQ ID NO: 73043 - DNA, 440 bp, Zea mays
  Clone ID: LIB3078-018-Q1-K1-C10
gttctagatcgcgagcggtcgcccttttttttattttttggcaaaccagggtgtgaatggaatgaataaaatatggcacagcatgtttaagttagccagcagctgctgtacacggggggtgctacaaatgaattaatatgtatattaaataaacaaaacaaaataaaacaaaaaaacaaatccggagcggtggttagatgatctgcaacagaacggggtcagggcgtctaccctacaagctcatcgaactctgctaaaccctacgagtgtacttccagcgcggtggcacggcgaagccgcagtccgaacaccttagaggaagctcaaagcgacatcgtctcgggcttctcggcagcggacacaaggctccagctcgattcgtcccgcatcacctctgtacagtgtgcattggcatgggaaaaaaaattctgcggttattg

SEQ ID NO: 73044 - DNA, 437 bp, Zea mays
  Clone ID: LIB3078-018-Q1-K1-A8
cggacgcgtgggttcgtaaaatgctggaagaacatgttgctgatggcacacttaatgcgggaactcggtggcgtgattactgtgcacagataaaagattcacagtcctacttggctgtagcgtcaaacacatctggctctacaccgaaagagttatttgatgacgtgatcgaggaacttgacaaacagtatcaagaagacaagacccaaattaaagaagtggtgaaatctggaaagattcctatgacaacatcatggacattagaggaattccaaactgctattctggaggatgatgctcttaaaggaatatcaaccatcaacatcaagcttatctatgatgatcagcttgaaaggctcaaggaaaaagagcaaaaggaggctaagaagcgccagcgtttgggtgaaaatttttcagatcttttgtattccatcaag

SEQ ID NO: 73045 - DNA, 418 bp, Zea mays
  unsure at all n locations
  Clone ID: LIB3078-017-Q1-K1-H5
ggccaacaggtgcaggttttcctcatttttattagatcctttcttagcgatcttggatctccactctccaggactccagggtttgccgtttgcttgacgatcacacgtatcaaaaagggttctcaagtattattggttgatgctatgctccaagaattagaaaaggagattgatgatgtggatgcacaaattggaaatcgttggcaactgcttgataaggaccatgatggcaaagtgacccctgaagaggtggcggcggcgacagcttatctcaaggacaccatagggaaagaaggcgtgcaagagctcatcagcaacctttctaaagacacagaaggaaaaaatccttgttgaagatattgtgaagctagcatcccanatagagaacaatgaagaggaagaggaagcacggtagatg

SEQ ID NO: 73046 - DNA, 301 bp, Zea mays
  Clone ID: LIB3078-017-Q1-K1-H6
tcgcggacgcgtgggcggacgcgtggggttgtcaccttcggtccaactggcctgaccagggatgtgaagtctgttgagatgcaccacgaggctctccaggaggcccttcctggtgacaatgttggcttcaatgtgaagaacgttgctgtgaaggatctcaaacgtgggtacgtggcctccaactctaaggatgaccctgccaaggaggctgctagcttcacctcccaagtcatcatcatgaaccaccctgggcagattggcaatggctatgccccagtgctggactgccacaccttccaca

SEQ ID NO: 73047 - DNA, 421 bp, Zea mays
  Clone ID: LIB3078-017-Q1-K1-H7
ctggcaacagttcggcaaccgctgctgcatatgttcaaggatcaaatgagccacttggtgttgaagtgactgaaacagatagtgcaccagctgtgactgaaacaggcaatgcaccaactgtgactggaacagacaacaatgcaccgaaacccacgtgtagtgtgccaagtgaacaattcggtggtgacgacggaacgcactcatcaggcaacaatggcgcagaagagtcttcagatactaagcagccaccaccgtcgaagaagcagagggtatacactgacgatgacttggttgtgataatgagtcggagcctcggcgagcttgcttcggctataaaaaggctttccgaacaacccgaccttcctgttccgaaggggttgtacgaagagctgaagagcatcccaaggttcgaggaggcaca

SEQ ID NO: 73048 - DNA, 363 bp, Zea mays
  Clone ID: LIB3078-017-Q1-K1-H8
tcggctgttctttggaggagaagagaaatgggaggcttgctcttgccgcatcaccgaacgtttccaaattctttgcaagcttccatcccgggacctctctctcttcacaaaggcgaccgcaaaaaccttcattacttggcacctgatgtgcacctcttctgttccctgcggcaaggctttccacgctcatcttggtcggccgtcatcagatcagaagccagcggcgacgcggtggtggcgtcgccaggcacggtcatcaagcgtagcaaggaggagctcatcaccttcttcagagacattcagacatccattgccgagtgctcgcgtaaagcttccaagaggacgaggaagcagccgcctgat

SEQ ID NO: 73049 - DNA, 427 bp, Zea mays
  Clone ID: LIB3078-017-Q1-K1-H9
tccacgcgtccggcgatgcagcattttgatgactgtatccctgaaagagcttttgacaggtttcagtttgtgaacttcactggtattatgtcaacaagtaaggatatgtcaaagaaggaggctgcatttgcccttgcagctcttatggaaataccttctcagtataaagcaacgcaaggccttcgacctccagaaaagcaagcacaaaggattggctctcctaggattcttcctcctccaaataaagttcttgaaaatgataatgccgccgtcgctgcttcgcaccctcctcaaactgcaagctcgaaatcaactggtattggcaaaagtgctgctgacgagcaggtatgccccatatgtctaaccaatccaaaggacatggcttttcagtgtggtcatctgacatgtaaggaatgtggcccaacac

SEQ ID NO: 73050 - DNA, 404 bp, Zea mays
  Clone ID: LIB3078-018-Q1-K1-A1
cccacgcgtccgcggacgcgtgggtgcctaccagtcgatacatgacttctcgaagccggtgatcaacatgatgaaggctgcaggttgggatcttgatggggctgctagtgcgatcgagcctggtgtggtttacacaagaagggctcacaagaagtttgcttttgaatcctatatttgccaaagaatgttcagtgggttccaagaagagagcttttctatcaaggattctaacatcagtgtttccaatgaggctttcttccaccaattcctcgcggtgcgagccatggatcctctggatgtcctgagccagaaccctgattcagtattcggaaagttctgcagaagcaagtacctatcgcttgtgcatcaaaaaatggaaggttctttcttcggcaacgtggatc

SEQ ID NO: 73051 - DNA, 436 bp, Zea mays
  Clone ID: LIB3078-018-Q1-K1-A10
ccaaacccgcacgacacgacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccaggacctcgccaagcagaagaaagtccccttcatcagcgacgacctcgagattgagtg

SEQ ID NO: 73052 - DNA, 438 bp, Zea mays
  Clone ID: LIB3078-018-Q1-K1-A11
ccgcccgtcccctcctgctcgcccatggctcccatcgctgtcggcgacgccctccccgacggccagctcgggtgggtcgacgagaacgaccagctgcagcaggtctccgtccacgcgctcgccgccggcaagaaggtcatcctcttcggcgtccccggcgccttcaccccgacctgtagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaagggctgggcgtgcgctcgaagaggttcgctctcctggccgacgacctcacg

SEQ ID NO: 73053 - DNA, 426 bp, Zea mays
  Clone ID: LIB3078-018-Q1-K1-A12
cccacgcgtccggaggatgcccccatggaaattgtggatgaggaagccaccaagcctgagggatggctggatgatgaacccgaagagattgatgatcctgaggcagccaagcccgaggactgtgacgatgaagaggatggtgaatgggaggcaccaaagattgacaaccccaagtgctaagaggcacctgtatgtggcgagtggaagaggccgatgaagcagaatgctgcttacaaaggcatgtggcatgcacctatgattgacaaccacgactacaagggaatctgtaagcctcacgagatacccaaccctgagtactttgagcttgacaggcctgattgtgatccaactgctgctattgggattgagatctggacaatgcacgatggcatactgttcgacaatatcttgattgctgatgatgag

SEQ ID NO: 73054 - DNA, 398 bp, Zea mays
  Clone ID: LIB3078-018-Q1-K1-A2
cagacgcgtggggccgctaagatcgacgcgccgactactaaccgcggcggcggcaaggtgcgagcaagccgaccggctgaggcaggacaagggcggtcactcgaagctggcgtgcccgatctgacgaaccctggagcccgacatgctaattcatgcagatccaccacgaggcgcgccaccccaagctaccattcgagccggagaagctcctcaacctgcactcctgcagccacgctgctgctgccgacgtcgtcgtcacttgcgaggccatcacctgcaagcccaagcccggcgtacgcagcagcctcaagaagtaagctcgctggcttggatggctcgcccgcctgcatggggcacaattccatgcggtttcaatcccatccgacgacccgatctat

SEQ ID NO: 73055 - DNA, 407 bp, Zea mays
  Clone ID: LIB3078-018-Q1-K1-A4
gccaaatgtctcgttaagacaccgatgcagtgcacactgtagagtgcagactcgtcgaggacgactacttacgaactatggcggttgcgtgcgctgatgctgacgagggagtgggagggatcatggtggcgccggacgtgtaggcggacacgatgaagctgatggatcagctgggtgccctagaggcggagatggacgccatcatcgcccgcctcactgcgagcggccgaccgggcatgaccggaggcctcgatactccgagggtttcccatggtccgacatcggcatgctgaacgtcctcgctcagcgccttaggcttgctgaattgcgcaatgaccacaaggatgttacaaactacattggtagaaatcttggggtgttacactcaggacagttatcaaggaatg

SEQ ID NO: 73056 - DNA, 403 bp, Zea mays
  Clone ID: LIB3078-018-Q1-K1-A5
cccacgcgtccgcccacgcgtccgcccacgcgtgcggcggcgacggcttcaagctgctgatcccgtccaagtggaaccccagcaaggagcgggagttccccgggcaggtgctacgctacgaggacaacttcgacgccaacagcaacgtgtccgtcatcatccagcccacgtccaagaagaccatcgccgactacggctctcccgaggagttcctctcccaggtcgactacctgctcggcaggcatgcctacggcggcaagaccgactccgagggcgggttcgagaccggcgccgtggccaccgccaacgtcctggagagctccacccacgtgatcgacggcaagcagtactacgccgtgtccgtgctcaccaggacggcggacggcgacgagggcggcaagca

SEQ ID NO: 73057 - DNA, 430 bp, Zea mays
  Clone ID: LIB3078-018-Q1-K1-A6
cggacgcgtgggggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaggcggtggcgagggtgaagacgtcggcgcaggacatcatcaacctcaagccactcatcgacaagaaggcgtggccgtacgtccagaacgac

SEQ ID NO: 73058 - DNA, 457 bp, Zea mays
  Clone ID: LIB3078-018-Q1-K1-A7
gtgggatcgactgcaaatgataaacctatacctgctccagatcctgaagtttcgcatataagcccccctctttcgttcattaagggtgtgttgccgaaatatttccactctgagtggtcagtagctcagttcaggctccatgagggggagcagtacattgttgcatttggacatgagaagaataccgtgtcagttgttggtatggatggaagcttctacagatgtcaatttgacccagttaatggaggagaaatgctgcagctggagtgctacagttttctaaaaccgtcagatcaaccgtagcgacacacaattatcatctatcaattgatgccctcctccccgtaccaagaactgtacagtatctttgtgcgccctcgttggccggaggtctaagctaaatatgataatattttctttgtgtatatatatttcttgttggctctgggtgatgtat

SEQ ID NO: 73059 - DNA, 446 bp, Zea mays
  Clone ID: LIB3078-017-Q1-K1-H2
cggacgcgtgggcggacgcgtgggcggacgcgtgggtggcttcggcctcatctacgataacctcgagtctgccaagaaggtcgagcccaaataccgcctcatcaggaatggtcttgctactaaggttgagaagtcccgcaagcaaatgaaagagcggaagaacagggccaagaagatccgtggtgtcaagaagaccaaggctggtgacgccaagaagaagtaaacagtcatttatatttctgtattactgtcctgaactctgggtggtcgtctagttgcaatgtcataattatggtcgtgttaggttttgttccgcactcagcagtaagtgaagttttgtaattcctggatgtgaacctacccggattggctgtagcatgttgtgagatgagaaggctattttgtcatgcagttgtgtcatttgcaagccaatccattttgtcatg

SEQ ID NO: 73060 - DNA, 331 bp, Zea mays
  Clone ID: LIB3078-017-Q1-K1-F9
gtttctgaccaagatcggcgtcctcaacacacccttctggtacacgggcggcgagcagcggtacttcaccgacaccaccaccctcttcatcatcgagctcatcctcatcggctgggccgagggccgccgctgggctgacatcatcaagcccggaagcgtcaacaccgaccccatcttccccagcaacaagctcaccggcaccgacgtcgggtaccctggtggcctctggtttgacccgctcggctggggcagcggctcgccggagaagatcaaggagctgcgcaccaaggagatcaagaacggacgcctcggcatgctcggcgtcatgggc

SEQ ID NO: 73061 - DNA, 372 bp, Zea mays
  unsure at all n locations
  Clone ID: LIB3078-017-Q1-K1-G1
agggcaaaatgtatcctgtatctatatggtttcaatgtgtgtctgtatgtactgaactgtacaggcttatcgagaaagatcactgcgagtctacaacaatccacacccaacacaggcggtggacacaacccatccaataatctttcatgagtacagtgtcggagtcatcggccaatttcttcaaaattatcattaatttatgatgttcatgtaactatagtcgtaggataaggcagggccggtttggtttcatcacgcggatgggagcaccttcttgacgatctcatcactgagcgaggcgatctgggcgtcgagcgccttaacagcctnctncttctgcgcctcgaggttggcgagcgcctctacgagctc

SEQ ID NO: 73062 - DNA, 143 bp, Zea mays
  Clone ID: LIB3078-017-Q1-K1-G10
taaagatttgataaactgttgcttagcctgacaatcggaagagtttaaatgttaaagagttgataaaaaaaagacataatggaaataaaaaaccaaaaaaaaaaaaaaaacaaaaacaaaaactaaaaaaacattaccaacaa

SEQ ID NO: 73063 - DNA, 343 bp, Zea mays
  Clone ID: LIB3078-017-Q1-K1-G11
cgcgcaccgccgtcgccgcccaaccgcagtaaggaggaaggagcaggaagatgccggcggggcacgggctggggtcgcggacccgcgacctgttcgcgcggtccttccgcaagaaggggtacattccactcaccacgtacctgcgcacctacaagatcggcgactacgtcgacgtcaaggttaacggcgccgtgcacaagggcatgccgcacaagttctaccacgggcgcaccgggagcgtctggaacgtcaccaagcgcgccatcggcgtcgagatcaacacgcaagttaatggccgcatcatcaggaagcggatccatgtccgcgtggagcatgtgcaacc

SEQ ID NO: 73064 - DNA, 428 bp, Zea mays
  Clone ID: LIB3078-017-Q1-K1-G12
cccacgcgttcgcatgatcgacggcaagcgggtgatccgcgtcaagtcggaccacttcggcaagttctggcggcgcagcccgaactggatctggtgcgacaccgacgacaccagcacggacaaccgtgacaccctgttcgaggtcgtcagggtcggcgacgacgcggacgccgtgtacgggctccggaacctcggcaacaaccacatctgccaccggctgacctacgagggcaaggagagctgcctgaacgccagcatacccagcgtcaggaaggaggcgcagctgaagatcgaggaggccgtcctgctgcggaagatctacggcgtggactaccacctcaaggacgccaagatcctgaacaacaaggtgaggaccctggtgactcgagaggcggtgaacgccggcagcatgcccagcatgaacacgc

SEQ ID NO: 73065 - DNA, 410 bp, Zea mays
  Clone ID: LIB3078-017-Q1-K1-G3
cccacgcgtccggccccaccgccgccgccggtggccgggccgccccggggctgaacgggcgctcctacagcgcctcctacgcggcctcctacgggcccaccctggccgataccggcgggcagctgaagcgctccggcagcgtcaccaactggacctccgccaaccgccgctccgtcaacctgagggggtacgccccgtccttcgccgcgatggacgacaccgccggcgcggtcccggcgcccaggaggaagctgcgggcgggggcggacgacgccgaggtgcagcggcggcggctggtcgtgtacaagacgtacggcgtggaagggaaggtccgggagtcggtgcgccgcggcgtcagctggatcaagggcaagtgctccggcgcggcctacggctggtggtgatcgatc

SEQ ID NO: 73066 - DNA, 455 bp, Zea mays
  Clone ID: LIB3078-017-Q1-K1-G4
cacgcgtccgcggacgcgtgggggagccggtaccgaagcccgccccctcggcagccgcggaggagggggcggagcggttcaggtcgctcgtcgaccccgatgatgtcgcctccatcaggcagacgcagcacctcataatggggcgattgcaagatagcaatgcagttctcacacattttaatgagtattccgaacgatgctttgtagaagtgtctggtgattttgctagtaaaactcgccttctcaagtctatgaaggctgatctcgaccatattttcacaaagctaagagagatgaaagctaggctagcagctacctatccagacgctttccctaatggtgcaatgtcaaagacgatggaccagagaccagaccttgaaagtcctttagattagtgcgtctaacatcaaaattccgcatattagtgacgacatttgttgtcataccaaagattt

SEQ ID NO: 73067 - DNA, 416 bp, Zea mays
  Clone ID: LIB3078-017-Q1-K1-G5
gaagaccagaaggtgagaagagagagagagagtgtgtgtgatcggtacaaggatcagcgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacaactatggcgttgacaagtatgacattggaacgggctttgggcatttcgcaa

SEQ ID NO: 73068 - DNA, 422 bp, Zea mays
  unsure at all n locations
  Clone ID: LIB3078-017-Q1-K1-G6
cggacgcgtgggcggacgcgtgggcttgcctgcttgtttacaccctaaaactaaagctanagtcgtcggcgggaacaagcggtacgtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgncacctgcaagaactgcgtccccgtgtccacgggcaagggcgccaccaagtacaggtgccgggacttccttcccgaaaacttgcggtgcaagatccactaaactcatccaattccaccatggccacagcagccgatggatccttcttccatatgcat

SEQ ID NO: 73069 - DNA, 192 bp, Zea mays
  Clone ID: LIB3078-017-Q1-K1-G7
gtgaagtggcagtaacttgaaaatcagcactggcactgttttggttagttactccagtcctttcgtcttttgtgtcccctttcaatagaagctggccttgtactaactccattctttttttagttgtcacggtttagttcaaaaatgaactagcgggcgacaattattgagttcaaaaatgctctgttcatc

SEQ ID NO: 73070 - DNA, 294 bp, Zea mays
  Clone ID: LIB3078-017-Q1-K1-G8
gcagggtggacattttgtgttcatagacaacgcttcagggttccactcggctgtcggctatgcgtgccgtaatcttctatcagtaaatggagaggagggattcacatttcctgatggcctaatatctgcgtgaagtggcatgttcaacaagcttgctcaacaacagtttacataaagcaaagatatacgattgtggaaatcattgcccatttccaccaatttgcttgtatacggattatgctgtgtatatattacataacaaatgtattagtatcatttaatgcacgatttgtg

SEQ ID NO: 73071 - DNA, 394 bp, Zea mays
  Clone ID: LIB3078-017-Q1-K1-G9
cgacccacttcgtgcggtaagaggagctgcgacgatgctgtagcgagagacatgggtgccgaggtcgatgtgctggggtggtggcaggagaagaaggaaacgaaaaagcaggagccagggttgttcaacaacgtgaccgagtcgctgaggcgaggaagagtaaggtgaaagcactcgtcgacgcctttgagactgacagagcgtcatctcgctgcaggaaaccagcaagcctgctgctgctccagctatgaaagtaggtgtcgtgccatgagtgcttcttgacctgcagtgtgcatgatcacctttcttggaattttaaactttttttggttgttagtgaccgtaaaagtggcgcttgttgaggtttgctcgttcccatgtaaactgacttttc

SEQ ID NO: 73072 - DNA, 352 bp, Zea mays
  Clone ID: LIB3078-017-Q1-K1-H1
cggacgcgtgggacgtacaccaagcccaagaagatcaaacacaagcacaagaaggttaagctctccgtgctgcagttctagaaggtggacgacaccactagcaaggtgacccgcctccgcaaggagtgccccaacacagagtgcggcgcgggcgtcttcatggccaaccacttcgaccgccactactgcggcaagtgcggcctcacctatgtctacaaccagaaggcgtaattgcttgccccgatttgctttatccgcctaccctatcgaacatccagctgttggttactcgaattgtatctcatgtagatctgtctgaggttgaaacttaaatggagcagtagtatctgtc

SEQ ID NO: 73073 - DNA, 223 bp, Zea mays
  Clone ID: LIB3078-017-Q1-K1-H10
tcggctgccctggctcgagggcacctcgcggtgccccttctgccgcgccgtcgtggacgccggcgccgtcgtcggcggcgacggggcctaaaagcggccgaggctctggtcttgctggggcttgccctgggctgggaccgcgccgggcgccttgtcgctgtcgggccaagccagccacgccaaccccatggcgttggcacgcctggcaatggctaatgggggt

SEQ ID NO: 73074 - DNA, 412 bp, Zea mays
  Clone ID: LIB3078-017-Q1-K1-H11
catctgcaggcgctccctcgacattgagaggcccaactactccaacttgaatcgccttgtgtctcaggtgatctcatcgctgactgcttctctgaggttcgatggtgccctcaatgtggatgtgaacgagttccagaccaacctggttccttacccgaggatccacttcatgctctcctcctacgcaccggtgatctcttctgcgaaggccttccacgagcagctgtctgtggcggagatcaccagcagcgcgttcgagccggcttccatgatggtcaagtgcgacccacggcacggcaagtacatggcttgctgcctgatgtaccgcggcgacgtggtgcccaaggacgtgaaacgccgcgtggccaccatcaagacgaagcgcaccatccagttcgtggactggtgcccg

SEQ ID NO: 73075 - DNA, 417 bp, Zea mays
  Clone ID: LIB3078-017-Q1-K1-H12
cttcacgctgccgctgcgctctgtgtcggcgccggcgccagcgaggcgggtcttcgagggcgttgccgtcgcggtgtcgtcggagtacgggaccgagggcgcggagcagcaggacggggagttctccgaggacctcaagctgttcgtcggtaacctgccgttcagcgtcgacagtgcgcagctggccgggctcttcgagcaggcgggctccgtcgagatggtcgaggttgtatacgatagaatgactgggcggagccgtggatttggattcgtgacaatgtcttcagctgaagaagccggggctgctgtcgagcaattcaacggttatacatttcaaggaagacctctgagggtgaactgcgggccaccgtcacctagagatggatccgcaccaagagcaccaaggggtggtggtgg

SEQ ID NO: 73076 - DNA, 420 bp, Zea mays
  unsure at all n locations
  Clone ID: LIB3078-017-Q1-K1-F8
cggacgcgtggggccgacaaaaccagaccatgaaacaagtgccagcgccctctcggagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactntgctgtcgacattggcaggaatgtcattcatggaagtgac

SEQ ID NO: 73077 - DNA, 413 bp, Zea mays
  Clone ID: LIB3078-017-Q1-K1-E5
cccacgcgtccgcccacgcgtccgcgctggtcggcgactacgggttcgacccgttcgggctcgggaagcccgtggagtacctgcagttcgaactggactcgctggaccagaacctggccaagaacgaggccggcggcatcatcggcacccggttcgagtcctccgacgtcaagtccaccccgctccagccctacagcgaggtgttcggcctccagcggttccgcgagtgcgagctcatccacggccgatgggccatgctcgccaccctcggcgccctcaccgtcgagtggctcaccggcgtcacctggcaggatgctggcaaggtggagctggtggatgggtcctcctacctgggccagccgctgccgttcaccatctcgacgctcatctggatcgaggtgcttgtgatcggc

SEQ ID NO: 73078 - DNA, 422 bp, Zea mays
  Clone ID: LIB3078-017-Q1-K1-E6
cccacgcgtccgcaccaagaaggagcaggtgttctccacctactcggacaaccagggtggtgtgttgatccaggtgtacgagggcgagaggacccggacccgcgacaacaacctgcttgggaaattcgagctctccggcatcccaccggctccccgtggtgtcccccagatcacggtctgcttcgacatcgacgccaacggcatcctgaacgtgtctgccgaggacaagacgacggggcagaagaacaagatcacaatcaccaacgacaagggccgtctgtccaaggaggagatcgagaagatggtgcaggacgcggagaagtacaagtcagaggacgaggagcacaagaagaaggtggagtccaagaactcgctggagaactacgcctacaacatgcgcaacacgatcaaggacgagaaga

SEQ ID NO: 73079 - DNA, 406 bp, Zea mays
  Clone ID: LIB3078-017-Q1-K1-E7
ggagatcctcccgcttggccctttgaatgatttcgagagagctggtctggaagcggggaagaaggaactgggcgagagcattcagaagggcatcgctttcatgagcaagtgaaagcggagcggtacggagggatcgtccctgagtcagatccggaccatacgtagtaacgtagatgtagggtgttgtgatatagtgctcctacctatacttgtaaggccacggtaaaaagaaggctaattaccctttagcaactgtgaccatctacttggcataatggcatggaataaatctttcgtcttcggtggcggacaagggccgtgcctgctctgtgctttgctggacggtgggtgagccacagcggggccgcaggaacaacagaatagcattggtttggagaccggtgtt

SEQ ID NO: 73080 - DNA, 412 bp, Zea mays
  unsure at all n locations
  Clone ID: LIB3078-017-Q1-K1-E8
aacagcaagtgtagattctcctaaggaacggattgtaccacctgcagagaaacctgccacaacttctttgagaattgaccgatttgtacgcccatttaccctgaaagctgtgcaggagcttcttggtaaaactggatctgtacaagacttctggatggaccatatcaagactcattgctatgtgacattttcttcggtggatgaagcaatggctactagggatgctgtttacaacctacagtggcccccaaataacggcaataagttggtcgccgaatttgttgatcctcaggaagtgaagctcaaggttgacccccctcccccgccagctgctcctgttagcccagctgctatcacaagggcacctnctcttcaacagactcaaagtgtgccacgccaggctgctacacca

SEQ ID NO: 73081 - DNA, 347 bp, Zea mays
  unsure at all n locations
  Clone ID: LIB3078-017-Q1-K1-E9
cgctcggctggggctccggctcgccggagaagatcaaggagctgcgcaccaaggagatgaagaacggacgcctcgccatgctcgccgtcatgggcgcttggttccaggccgagtacaccggcaccggccccatcgacaacctcttcgcccacctcgccgaccctggccacgccaccatcttccaggccttcacccccaaatgaggagctctgatgaacttggcagttcgaggagtgctaccacacatgcatgcattgttaggtttgatggccgatatggaactttntctttttgttgggggcggactactgggtagactgtcaacgatgatgatgatgaatgatgaa

SEQ ID NO: 73082 - DNA, 437 bp, Zea mays
  unsure at all n locations
  Clone ID: LIB3078-017-Q1-K1-F1
gtccttccgtgttcctactgtggatgtctcggttgttgacctcaccgtcagaatcgagaagggggcctcctatgaggatagcaanaaagctattaaggctgcttccgagggtccactcaagggtatcatgggttatgcggaggaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtagaggggttttttccccctgcttctcatggatggttgctgcttgtgtatgccgagaataaatgtggatggcgcgtgcctctgggtcgccaggttcatgctgagtctggacatgttntgcactt

SEQ ID NO: 73083 - DNA, 228 bp, Zea mays
  unsure at all n locations
  Clone ID: LIB3078-017-Q1-K1-F10
tcgctgcaaggcgcaggccggcgacaagaggtggttcaagggcgccaggaaaggagtcgagaaggccgtcgtctggttcaacgtcgcatgatgcagtaatattggttcttcgatgggatgggatgcacgcactacgtaaagagcttggctaggccaagcctggcttaacacccttgggtggtccttcgactggacatgagaaccaagacttagaactttgntccgttt

SEQ ID NO: 73084 - DNA, 390 bp, Zea mays
  Clone ID: LIB3078-017-Q1-K1-F11
ggatcgggaaggtctttcaggcatggtcgttcaatgtctccagaagagcacaggcatgggggcaggcatgaatgggatccatcatcgagagtgtccagaagtgcagcacatatcgaggatattaactcgagaggaggtgaagcatcccggaatggagatcctgatgctttggcaacaatgaacgcaactgcagaagctcttgaagcaaaagaaaagcaaaagccatcgtttgaattgtctggaaagcttgctgaggagaccaacagagttgcaggtgtaaatctattatattcagaacccccagaggctcgaaagtcagagattagatggaggctctatgtatttaaagatggtgaaccactgaatgaaccactgtatgttcatcggatg

SEQ ID NO: 73085 - DNA, 424 bp, Zea mays
  Clone ID: LIB3078-017-Q1-K1-F12
ggcggccgaggcggtgcgggaggtggaggaggccgcggcggtgggcggtgaggccgtgaagggggcggtgacggaggcggagaaggaggtcgccagcgagggcctgcagctggtggccggcgcggagctcgccggggacgggctagtgcaagccgcggtggtcgccggcgccgaggcgctcggggtcgtcgtgggcctatccgtggtaaatggtatcctgaagcccgaggcctagatggtgtaggctgctgggccttgtagtttcggccgaatacaagtgtttgggctttaacgcttcgttgtcggatgacctcttcttttgtgtgtaaattgttattattataacaattattggagtgcggatatgggcagctagaaaagttgtgatcaattgtaatgctgcaggatttgaacaccaaacatg

SEQ ID NO: 73086 - DNA, 431 bp, Zea mays
  Clone ID: LIB3078-017-Q1-K1-F2
gaagcttcagcggtgcttgtttcaactgcggcgaatccggccaccgcgcaacggactgcccaaacaagtagtaagatgggggagatggcgcggtctccccttgccgcacggggtcgatgatcctgattggccggagcatcaatcaggatgcacgcagagcgaaatcccaaagcccactccacctgctgatcggtgtactacgcccgacacccagccgacgttattactggctacagttttgcgtggtcgtctggcgtcggaaaacagaggaaggttttggcatcctgactacagttactacatcaagcggagttccttcagcttattcatgtcacacggacactactctacactacagggatatgttagtatttctttttttatatgtattttttttggggtaaaaaaaaaaaataaagggcggccggtct

SEQ ID NO: 73087 - DNA, 438 bp, Zea mays
  Clone ID: LIB3078-017-Q1-K1-F3
cggacgcgtgggtgcggttactccaggaactagtgcttttttctgaaatgccagaggggggaagcgatatgtggggagactgggagctaccaaggcagctccggcgcctgattattgaaggcatcgtcttctcacgacagcctcgatggatcaaccgctcctgtctgccacgcctctactccttatatctgatggtgcacgctgttgaagcacaggacctagataatctagcgaggttgccagagctccagtacctcatgctatttggtttcagctggcctccaaggtatactgttggcccagacgacttcaggaatctaaggttctgcgaagtgggcacaacgttcgagtttcgtaagggcgccatgccaaggcttgaagtgctgcgatttggagtttgtgtgccgttcgagcagttcccaacgaaggatgtgatcc

SEQ ID NO: 73088 - DNA, 433 bp, Zea mays
  Clone ID: LIB3078-017-Q1-K1-F4
gcgcttcgctgggcaagccggtgaaggggcttggcctgagcatgggccgcgagcgggcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctgggggtggagcaggacaagacgctggccacctacgggatcaacgccgtgtgcactcacctcggctgcgtcgtgccgtggaa

SEQ ID NO: 73089 - DNA, 416 bp, Zea mays
  Clone ID: LIB3078-017-Q1-K1-F5
tcgaccccgattcgtccgcccgcgaccgggattccctccgccaagcgcggatctgagcgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctcaagctcgagtacaacaaggccatcgctgcctac

SEQ ID NO: 73090 - DNA, 411 bp, Zea mays
  Clone ID: LIB3078-017-Q1-K1-F6
gtgagatttatgatcagtatggtgaagatgcgcttaaggaaggaatgggcggtgggggatcccatgttgatccatttgacatcttctcatcattttttggaccctcttttggaggaggtggtggaagcagcaggggaagaaggcaaaggaggggagaagatgtagttcacccacttaaagtttctctggaagatctttacaatggcacctcaaagaagctctctctttcgcgcaatgtcatctgctccaagtgcaagggcaagggctcgaagtctggtgcctcaatgaggtgccctggttgccagggctcaggcatgaaagtcactattcgtcagctgggcccttccatgatacagcagatgcagcagccttgcaatgagtgcaaggggactggagagagcatcaatgaga

SEQ ID NO: 73091 - DNA, 415 bp, Zea mays
  Clone ID: LIB3078-017-Q1-K1-F7
gtggtcgggttccgggagggcggcaacgtggtgacgcaggtgaagacggccgccagggacgggtacgacgccgtccaggtcgggtaccacggcgtgcgcgaggacaagctcacccgcccggagctgggccacctgggcaaggccggcgccccgccgctgcgccacctgcaggagttccggctcaccgccgtcgacgccttcgagcccggccagcccctcgacttcgccgacctcttcaaggagggcgacctcatcgacgtctccggcaactccatcggcaaggggttccaaggtggcatcaagaggcacaacttcaagcgcgggctgatgacgcacggttccaagagccaccggcagctgggttccatcggagccgggacgacgccgggccgcgtgtacaaggggaaagaagatg

SEQ ID NO: 73092 - DNA, 441 bp, Zea mays
  Clone ID: LIB3078-017-Q1-K1-E4
agagaacccagtgctgctaatcatgtggccaattctgatctggatgttgtatcacagaccacagatgaagtgaaggctgggacacctgccactgaaaaggcaggtcaagttgagaaagtcgtttcaggtaaaggaaaggaaaacagagggaaagacatcgtgagaaactcatacaaaacagaacttgcaaggcaaattttgctcagtttcattgtgaagtcagtgcatgacagtttaggttccgcccaagctgaaccagagaggaagccaagtggatcagatgaagctagtaataaacagagcagcaacttagtcaagaatgcttctggtcgcaaagattcagataaacaagagaaatccatggaggttcccaagggcctgaaggatacagagggatttacagtcgtttcaaaacgtcgaaggcggccccagccattcatg

SEQ ID NO: 73093 - DNA, 218 bp, Zea mays
  Clone ID: LIB3078-003-Q1-K1-A6
tacgggcgtaagaagacgacagaacggttgaacgacgttagcaaaaggctgccacggggaggagatccacagtgacggcggctagaccaatgccgtccgccagtcagcgaacatctggctaatggctcgacgtcaaaatctttattacgcaacaactccggctatgcctagctcgactagattatgtccatacactacatttatcacggctaaaccaa

SEQ ID NO: 73094 - DNA, 252 bp, Zea mays
  Clone ID: LIB3078-003-Q1-K1-E5
acccacgcgtccgcgacgcactcgtccgtacgcctgcgcgaacacctcagctggtttcacatctgttcttcagagcccactcatctgctacccttgatactctatcgagtttccacaacattatgtcttactccatcgttagaaacaccccaggacaccactaccataacgatcggttacgccataatatacattccatcattcattctcaccaatgttcaagacaatactaatatctcttaaatgctgatc

SEQ ID NO: 73095 - DNA, 422 bp, Zea mays
  Clone ID: LIB3078-003-Q1-K1-H2
tatccttctatccccattcccatcccgagacaggagaaggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtggaggtggtgcgcctggctccacaccccaagtacaagcgccgggagcgcatcaagaagaagtaccaggcgcacgaccccgacaaccagttcaaggtcggcgacgtcgtcgagctccaaccctcccgtcccatctccaagaccaagcacttcctcgccatcccgctcccgccccgcgacactcgccgcaagtctcagctcctaccgccgctccagtccgacgacgacca

SEQ ID NO: 73096 - DNA, 389 bp, Zea mays
  Clone ID: LIB3078-004-Q1-K1-D1
cccacgcgtccggatcgatctaaaccaatccattttatatatacatacgacatgccagcggtgaaacaacttattagagatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaacctagatgctgtcgcagtaaagaatcgtcaacaagg

SEQ ID NO: 73097 - DNA, 394 bp, Zea mays
  unsure at all n locations
  Clone ID: LIB3078-004-Q1-K1-D5
taagcactttgaagtttgctgaaagggtttctggagttgagttaagtgctgcaagaaggaacaaagagggtaaagatataaaagagctggtagaacaagtttcatatctgaaagacacaatatcacggaaagatatggaaatcgatcaacttctgaaggacaaagccaagtcaccaagttcatcaacagatataaatgacagtagccaacagatccgacgactatcatgggctgctggatcaggcgaggccgaatgcgaagataacatgtctgatgatggctgctcagtggcaggaaccgangtgtctgtangtggtgcttcagaggcgacagcagaacgaatgcagaaggccccatcaaggatagngcaggctgttctcacatagaatgggca

SEQ ID NO: 73098 - DNA, 442 bp, Zea mays
  Clone ID: LIB3078-004-Q1-K1-F5
taccgtcggactacacctgggttgatgccaccgagaagaagcggaggatgaaggctgggaaagccaagagcaggcggggcccagcccgaaaacagtcctcaaagaacactgcggaaggagcccaccgcccaatgatggatggcttcgaggagtaaaccatgctctcaccggcgttgtaagttgcctctgcattcattcttaagatgttagttgatgatggcagcttcacgccgaggcaggttgaaagttgtgccttggagcaccccctgtggtgttggtgtgtcaatggatgggagtcgaatctcattgaaaacgtacagatggcttataccccactaatctgtaattcagtcagcgctatttttgtccccacctacgattttcatcttgctggatgtatgcttgacagatgatgatactgacctcgtggtgttgaaaaaga

SEQ ID NO: 73099 - DNA, 408 bp, Zea mays
  Clone ID: LIB3078-004-Q1-K1-H9
tgcatttttgctacgagcatcctagaaatgagatggagtggtggtggaattgatgactggtggaggaatgagcagttctgggtcattggaggtgtgtcctcacacctctttgctgtgttccagggacttctcaaggtcatagctggtgttgatacaagcttcaccgtgacatcaaagggtggagatgatgaggagttctcagagctatatacattcaaatggactaccttattgataccttctaccaccttgcttctattgaacttcattggtgtggtcgctggcgtttcaaatgcgatcaataacggatatgagtcatggggccccctctttgggaagctattctttgcattttgggtgacttgccatctttatccctttctcaaaggtttggttggaaggcaaaac

SEQ ID NO: 73100 - DNA, 362 bp, Zea mays
  Clone ID: LIB3078-006-Q1-K1-F12
ctaactgctgcacctgtgcttgtttatcactgctggcgagttgggcagtcttggggcgtggaaaacatggcttgtgatgtaggaggaaggaatggaagtggtctgttgtacttaaagaaactagatgaataatgcttgaattactgaaacttcacccttctttagtgtataaagtattcacctatgtgttgaaaattcttgtaaaccatatgcatcttgcataaaacctggacctgctaactggtgctgtaagaggcggttcctctaaaggatctcaacgtacgtacgcgtacatactacgtctacgttactttatagtgccatctatattgatatcaatggccaacggtttacaacttcat

SEQ ID NO: 73101 - DNA, 417 bp, Zea mays
  unsure at all n locations
  Clone ID: LIB3078-006-Q1-K1-G4
ttgagggcctgctgagctggcaaagtgatacaaagaattcctttaaagttaaggtcaagtcactcatagaaattcttgtgaagaaatgtggtttagacgctgtgaaggctgtgatgcctgaggagcatatgaaattgctcacgaatattangaagattaatgagcgaaaaatgcgaaaggcaaaatcttctgaggatggggatgccatgtctatggcctcaggagctacaaggcaaagtaagtggaatcacacacaaatgttttcggactttggaagtgatgatgaatcagatgggcctttttctacccaacatactgctacttctcgatctcgtactgaatcaaaagcttcaactcggttgaatccgaggcgccaaggagataagaaactactagacaagttcattgaccattcaa

SEQ ID NO: 73102 - DNA, 459 bp, Zea mays
  Clone ID: LIB3078-007-Q1-K1-B9
gctctagaacgagtggatccctcgggctgcacgaattcggcacgagtttatattatctagctcgttgtctattccttctgctagggttatatccacataccgtgcgccaattccatataggccctgtatttacagattatcagggattatgtcatctgctatcatcctatgataccttaaaggagtgctttctaactatatccatctagagctgcgtcaaatgctcttcaaacacattcccataagcctcctacctcttcatctgcttctattttcagattataaccatcacagcctttttcatgaaattcaattcaagggatgtcaagagattttcaataaattagctttcttactgtctctgcacgcctaaagacagttcctgcttatattaatactctgatccgttcagatagaatatgcatttttagtgccatagtaaactaatctctatcaata

SEQ ID NO: 73103 - DNA, 436 bp, Zea mays
  Clone ID: LIB3078-007-Q1-K1-G8
ccaaggccaagaaggacgctgcgccgtttgaccgcccaatccttggacgcttttcctccgacctcaagatcgggatcgttgggttgccaaatgttggcaaatcaacttttttcaacatagtaacaaagttggctatcccagctgagaattttcctttctgtaccatcgaaccaaatgaagcacgggtgaatgttccagatgaacggtttgattggctctgcaaactttacaagccaaagagtgaggtgcctgcatatcttgaagtaactgacatagctgggcttattagaggtgctcatgctggggatggtctgggcaatgcattcctctcacatatacgtgctgttgatggaatcttccatgtcctaagagcatttgaagacgcagaaattactcatgttgacgatacagtagatcctgttagagacatggaaac

SEQ ID NO: 73104 - DNA, 302 bp, Zea mays
  Clone ID: LIB3078-009-Q1-K1-D3
gccaaaaaacattatccatgcaacatcatataggctcgagtaactgtaaacggtcatccacatagagcaaaattaaagctcgtcttgacaaacacagaaaacagcaacaccacccagagaggactagcttcatgccgccaagagccgccagagatgcctacagcctccttcccctcctaccgccctttctgcgagtgctgtccgtggggaccggggtaacgtcctcaatgcgtccgattttcatcccaaaacgagcaagcgccctgagggcagactgggcaccaagtccgggggtcttggtc

SEQ ID NO: 73105 - DNA, 392 bp, Zea mays
  Clone ID: LIB3078-011-Q1-K1-B5
cccacgcgtccgtttaaaacctgtgctcatcgagcttattgggggaaagacaaaggagcacaaagaaacccttgaggttgacgcagcccttatagctacaggaagggcgccattcaccaaagggcttggcttggaaaacatcaatgttgctacacaacgtggttttgtgcctgttgatgaacggatgcgagtcatggatgcaggtggcaatgtggtacccaatttatattgcattggagatgccaatggcaagctcatgcttgcccatgctgccagtgcacaaggaatttcagttgttgaacaaatctctggaaaggatcacatgctaaatcatttaagcatcccagcagcatgttttacccatccagagattagtatggttggattgacag

SEQ ID NO: 73106 - DNA, 416 bp, Zea mays
  Clone ID: LIB3078-011-Q1-K1-D2
ccgcgcgcagcgttagggtgcggggtccgtgttcaagtcccagacccaccaccgcaagggccccgcccgcttccgctccctcgacttcggcgagcgcaacgggtacctcaagggcgtcgtcaccgacgtcatccacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctctccatcggcaacgtgctgccccttcgcgggatccctgagggtgccgtcgtctgcaacgtcgagcatcacgtcggtgaccgcggtgtcttcgccagggcctctggggactacgccattgtgatcagccacaaaccctgacaac

SEQ ID NO: 73107 - DNA, 259 bp, Zea mays
  Clone ID: LIB3078-011-Q1-K1-F6
taacgaatgatttcacacaccatacagttacgcctaaatggcagcaagtgcatatagtgggaaactctcaaacaagacacaacagatactaaatccagaaggcgaccagccaagtgtcaattgtatgcctataacaaatgagaacgaagccgttgtccctgaagcacgcgctggagaagaagggctcagatcgtagatctcggattcttggccctggtcaacacaggtcctcaatttgacctcgacgtgaagtaagcgt

SEQ ID NO: 73108 - DNA, 370 bp, Zea mays
  Clone ID: LIB3078-012-Q1-K1-A1
ttaattggagacaatgttaagatactcaatgctgacaatgttcaagaagctgcaagggagacagacgggtacttcatcaaaggtggaattgtcacagtgatcaaggatgctttactccctagtggaacagttatatgaagtgaacgtgcgacatgcagctgtgtgtctcgacattcgacaatgatcagcacctggttacatgcgtgatctgcagatcagtctgttggagatcatcggagcaataaaagtgtcatccaaggcattttttctttcttgttgctcttttgtgtccttcaatgttgtagggtagaatgttgtagcagcaaatgttagttacatggtgaatcgacattgggggccttggattggg

SEQ ID NO: 73109 - DNA, 425 bp, Zea mays
  Clone ID: LIB3078-013-Q1-K1-D5
taaagagcctgcagatggaaggaaggtacctccgtgatgtatggtgacacatcacgggcaaataagccatagctctagcgtgtggaagtaaagctggctttgcgtgtatgacatgtctaatgccaacccaatcgtcagctttggaatgaagcgtgccattgatgatatactgaaatgagttgatcagtgcaattctttgacatctaactatttattattatatgagatgggaggaactgatggagaataaatgctgctgtagatttgtagaagttcaaaaaaattgggtacccctgacaagtttgtagccaaggtggtacatcatacagtttgagatgaggacactatgtatactgtttgagacgaggacattatgtatactactctagaaggctaccgaaaccaaattttgcatctggttatta

SEQ ID NO: 73110 - DNA, 221 bp, Zea mays
  Clone ID: LIB3078-013-Q1-K1-D7
gaaggtttctgggagctgacaagatggtgctgaagacagaactctgccgcttcagcggccagaagatttatcctgggaaaggcatccgatttatccgtgctgattctcaggttttcctttttgccaactcaaaatgcaagcgctacttccacaaccgcctgaagcctgcaaagcttacctggacagcaatgtacaggaagcagcacaagaaggatatccat

SEQ ID NO: 73111 - DNA, 429 bp, Zea mays
  Clone ID: LIB3078-014-Q1-K1-A11
taaagcttcaaatttgggatactgctggacaagagcgcttcaggacaatcactagcagctactaccgcggagctcacggaatcattattgtatatgacgtgacagaccaagaaagcttcaataatgtgaagcaatggttaaacgagattgaccgttatgcaagtgacaatgttaacaagctccttgttgggaacaagagcgatctaactgctaacaaagttgtggcaaccgagacagcaaaggcgtttgctgatgagatgggcatcccattcatggagacgagtgccaaaaacgccatcaatgtggagcaggccttcatggctatggctgcatccatcaaggacaggatggccagccaaccagctgcggctaacgcaaggccagcgaccgtgcagatccgcggtcaacccgtcaaccagaagacgtctt

SEQ ID NO: 73112 - DNA, 416 bp, Zea mays
  Clone ID: LIB3078-014-Q1-K1-B6
tgcggatgcagaacgcaagtttcaagaggttcaacgagcttatgagactttaaaggatgaacaaaaaagatcattatatgatcaggttggccctgagcagtatgagaaaactgcttctggcggaggcggaactggcttcgagggtggttttggaaatccatttgaggatatttttggtggtggcggtggcggtggtggaatgaatgatttctttaggaacattttcggggatagggactttggaggacgagatgttaaggttgcactcgaactatcatttgtggaagcagttcaaggttgcagcaaaacggtcaccttccaaacgtctgtaacatgtgaaatctgtggtggagccggtgtgccttctggaaccacacctggaacatgtctatcttgcacgggttcaaggtttatat

SEQ ID NO: 73113 - DNA, 346 bp, Zea mays
  Clone ID: LIB3078-014-Q1-K1-C8
tccaaagccagagccacaaccaaagccagagcctaagccagaaccaaaaccagagcgaaagccagagcctaagcccgaaccaaaaccagagccaaagcctgagcctaaacccgaaccaagaccagaaccagaaccaaagccagagcctaaacctgaaccaaaaccgaaaccagaaccggagccacaaccaaagccagagcctaagcctgatccaaaaccagagcctaaacccgaaccaaaaccagagccccaaccaaaaccagaacctaagcccgaaccaaaaccacagccagaacctaagcccgagcccaaaccaaagcctgacccttcacacattccaccagca

SEQ ID NO: 73114 - DNA, 410 bp, Zea mays
  Clone ID: LIB3078-015-Q1-K1-B3
cccacgcgtccgcccactcgtccgcggacgcgtgggtgccaggctggcatgggcgaggacagccctgtgtctgtgccgctgctcatctctcggctctaaaagcagacgagtagtagttgtgcatgggatggatcggcacctgagagtacgctgggacatcccactgattgccggacggaagcatggaggaagaagctcccctcgcttcgcttgtcctcggcatgaggcatgtgcctggcgttacttgtggcgtgccaagtgccatatttccctaaacttattctgcgtgggaaccctctattatgtatgtatactgtgaatttgtgactgttcaggtaacacgagttatcgtgacatcttcgtagagaaagataccgtatgtatgatgtatgtatgatatacatatgata

SEQ ID NO: 73115 - DNA, 422 bp, Zea mays
  Clone ID: LIB3078-015-Q1-K1-E9
gtacggcagtcaaatgtcaacagatttaagtgcaatagcatacgaagtaacctctttgagaggctaacaagggttgtcaggtcctacgcaaatgcagttctaagttcgtttgaagaccctgagaagattctagaccaggcagttctggagatgaatgatgacttgacaaagatgcggcaggccactgcacaggtcttggcatctcaaaagcggcttgagaataaatctaaagctgcagaacaagcttctgctgattggtatcggagggctcaacttgctcttcaaaagggtgacgaggatcttgctcgtgaagcccttaagcggcgtaaatcatatgctgacaatgcaagctccttaagatcccagcttgatcagcagaagggtgtagttgaaaatctgatttcaaatacccggcttcttga

SEQ ID NO: 73116 - DNA, 428 bp, Zea mays
  Clone ID: LIB3078-016-Q1-K1-A2
gacgactgaaccaccgacagacaacatggccgcctccgcctccaccgtctccggcctcggcggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacgtggcacctgggcctgttcatcgtgctcaccttcggccagatcggattca

SEQ ID NO: 73117 - DNA, 375 bp, Zea mays
  Clone ID: LIB3078-016-Q1-K1-D1
cggacgcgtgggcggacgcgtgggcgacgccgtcgtggcccgcctcgacacgcaggccaagatgcaggtcatcggcaagtccatgcagtccatcgtcaagtcgctcgactccgcgctcgccaccgggaacctccagaagatgtccgagaccatggacaatttcgagcgccagttcgtcaacatggaggtccaggccgagttcatggagggcgccatggccggctccacctccctctccacgcccgagaccgaggtcaacagcctcatgcagcaggtcgcggacgactacgggctcgaggtctccgtcggtctgccgcaggcagccgcgcacgccatccctgccgccaaggataaggagaaagtcgacgaggatga

SEQ ID NO: 73118 - DNA, 345 bp, Zea mays
  Clone ID: LIB3078-016-Q1-K1-F2
cccacgcgtccgcggacgcgtggggtagtgcgatacttttgagagcaagggatagcgaggatcttgggctttggaatagtattgttaatgacatttttttttccggttgtgtttctggagtaaatcgttgaacgacaacgcttcaggatgtctggatgtggattctgagtagaccttgaagccttgatgaagcagccagtcttggaaagaaagttccattaagctatttttgttgctgtctacagctctctcggtgacggtaagcgcgatttggtggtttaatgttttagtatatctgagccgaactgtagactgttgcttctgtgagaaacgaaaaagaaatat

SEQ ID NO: 73119 - DNA, 381 bp, Zea mays
  Clone ID: LIB3078-017-Q1-K1-H4
gtaccggtacgaaactctgctcgagccacgcgtgcggtgctcaagctgctggagaagcacgccttcgtatagacgtcccacgccgccggccggcccgtcttgctcgtctgctcttgtcgccgctgcggccacgtcgcttgcctctgctactgctgctgccgtcgccgtcattaatgctttgttgatttctctcctggtcgagacaacgcacgttccttcatcacttcactgttgagtatttgcattgggtgtgtatgtatcggattctgctttgcgtgatcacggtaccatatttatttatcggactcctcgttcatcaggtggaggttctcgtcatgaataacgatgaaatctccatttcaccgtccaaaaaacatgaac

SEQ ID NO: 73120 - DNA, 386 bp, Zea mays
  Clone ID: LIB3078-018-Q1-K1-C3
ggaagctgacggactgcatggactacgcgacggggcacgcggggtcggcctcgtccacctgctgcggcgacgccggcgacacggagaaggcgcgccccgagtgcctctgctacatcatccagcagacgcacacggggcgcaaccaggtgcagtcgctcggactgcgcttcgaccgactcatggcgctccccgccgcctgcaacctccccaactccaacgtctcgctctgcatcaccctgctgaacctgaagccgggctctgcggactacgccctcttcgccaacgcctgcaagatcacgccgtcagccggcggcaaccctgcgagcgacagcgccgcgggcagcggcgtcaagctccgggctggggtcagcggcggcgtcgcgctc

SEQ ID NO: 73121 - DNA, 412 bp, Zea mays
  unsure at all n locations
  Clone ID: LIB3078-018-Q1-K1-G12
acggctgcgacgtggggccggacgggcgcctcctccgcgggtatgaccagtacgcctgcgacggcaaggattacatcgccctgaacgaggacctgagctcctggaccgcggcggacaccgcggctcagatcacccagcgcaagtgggaggcggcccgtgtggcggagcaggacagagcctacctggagggcctgtgcgtggagtcgctccgcagatacctggagaacgggaaggagacgctgcagcgcgcggaccccccaaagacacatgtgacccaccaccccatctctgaccatgaggtcaccctgaggtgctgggccctgngcttctaccctgcggagatcacactgacctggcagcgggatggcgaggaccaaactcaggacaccgagcttgtggagaccagaccagc

SEQ ID NO: 73122 - DNA, 418 bp, Zea mays
  Clone ID: LIB3078-018-Q1-K1-G7
cgaaagacgccgcggctgttctggacgaagcgatctgctacttgcagtacctgaagctgaaagtgaagacgctgggagctgtctccctctagctaagcctatctagccctctctcctcgtcgtggtggctttgttgtcgaaggccgaagccactggcttctggtgagaggagagctagcctatatcacccatctgttcagttcagtcccagaggagctcggatcttctcctacccgactcactgtcggtggctgcatcacccatcttcctcatcgtgggttggtatgcaaaagctagaaacatctttccgctgagcgtgatccaaagcgaagcccccattccatgcaaagcgctgggtcgtgccgtgcgtggggtggctcctgctttatatacgcgttgagctcctgctttggctgat

SEQ ID NO: 73123 - DNA, 443 bp, Zea mays
  Clone ID: LIB3078-019-Q1-K1-B6
ctccgtccaaggctaaatacaggcgagagaccgatagcgaacaagtaccgcgagggaaagatgaaaaggactttgaaaagagttatggggagtgccaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaggggggccctttttaaaggaccaaagttaacttcccggtcattggaaagtaaaacttttttaaaagggcacctaaattcaattaaatggccctccatttaaaaacatgtaaattggaaaacccttggtgtacccaaattaaacgcctttgaaaaaaatccccttttcccaaattggattattaccaaaaaggcccaaacgaatggcctttcaaaaaagtggccaaccttaaatggaaaatggacccc

SEQ ID NO: 73124 - DNA, 249 bp, Zea mays
  Clone ID: LIB3078-020-Q1-K1-H11
gacggggaaggaggccacacccgccgatcctggccgaaccacccactgacgagccgggggggacggctgctccagtcgcaagagaccacaccatggccgggtctggaacatcggatgcgccaaaacgctcgtgtgctcaagcacgagcaccgcgcgagggctggctatagactgcctgagcacgctcgaggcatccattagcgcacccgagaggcagaggcaatgactgcacgctgatgatagtgggat

SEQ ID NO: 73125 - DNA, 445 bp, Zea mays
  Clone ID: LIB3078-022-Q1-K1-D6
cccacgcgtccgcagcagtcggacgagcagaccaaggcggagatcatgcaggtgctgcggaagatgttccccggcaaggacgtcccggacgccaccgacatccttgtcccgagatggtggtccgacaggttctacaagggcaccttctccaactggccagttggcgtcaaccgctacgaatacgaccagcttagggcaccggttgggagggtatacttcaccggtgagcacaccagcgagcactacaatggctatgtccatggagcctatctttcaggtatcgactccgctgaaattctcatcaactgcgcccagaaaaagatgtgcaagtaccatgtccagggaaagtatgactaggaagctacagcaaattgatttaaagctccagcaaattgagcagtgtggatgttgcatttctcagttcattttttccctggtttcaaca

SEQ ID NO: 73126 - DNA, 303 bp, Zea mays
  Clone ID: LIB3078-022-Q1-K1-F4
catatcctctcgcctcttgcttggagctacagacagagctagagaggaggttccgtacggagtgacttcagctagtgcatcactgatgactctaaatatgccaagcaagggttacaccagttgagctagttgtccggagcagcagttaccaacgacgatagtctctatgcttggaaggaaatcaacggctagagcatctgttgtcccacacccagactataggttaccaatcgctatacttggcatcgctagtgcctttgcatataccgacaatcttctcgctagctgacctgtaggactgct

SEQ ID NO: 73127 - DNA, 474 bp, Zea mays
  unsure at all n locations
  Clone ID: LIB3078-022-Q1-K1-H12
ctcgaggtacctgcattcgcagtcggccgtgtactcggagccgcgggagatggcggatggggagacagtagctgtggttgaggcacctaccgcggttctaggggaaccgatggacctgatgactgccctgcagctcgtcatgaagaagtcacgtgctcacgatggccttgtgaagggtcttcgtgaggctgccaaagccatcgagaagcatgccgctcagctatgcgtgcttgccgaggactgcgaccagcctgattatgtcaagctggtgaaggctctctgcgctgagcacaatgtccacctggttactgtgcctagcgccaaaactctaggagagtgggctgtgctttgcaagatcgactctgatggcaaagcgaggaacgttgtangctgctcctgtgttgatagcaaggactacggcgagaaatctgaaggccttaacatagtgcacgagtacgtcaaatcgcactagat

SEQ ID NO: 73128 - DNA, 423 bp, Zea mays
  Clone ID: LIB3078-023-Q1-K1-H8
cccacgcgtccgcggacgcgtgggtgagaaactcggctacacctgcaaaatggatatggcaatggcttccttcgtcgccgctacgcaccaccacggcagtcacctggccgccggcttcccctactccgcgcgagcaggcaggagcgttggccgcagcggcgtcaccatctccattagagcccagaagaagagtaatagcgactctgggagtagtagcggaggtggggacgtgcggaccagcagcgggaggcgagtgtggcgtcgtcggaaactgaccaaagaagatgacatgttgcgttacaagttggatcgtatccctttcttagaagagaaggtgagaaaggtaagggagaatgggaagatcatatgcctggatattaatcagctgatgttatctcaagagaatagatttgcgttcaccat

SEQ ID NO: 73129 - DNA, 357 bp, Zea mays
  Clone ID: LIB3078-025-Q1-K1-A10
cccacgcgtccgcccacgcgtccgtacactaccaccgtttcagtgctataggataggattttcttttgacggccatgaaaccccctcagctgccggccggggagcgctcctgggctcacgaggtcaagcaggccctccgtgagaaactccggcgctcctacggcgccgtcttcgccacaccggcggtcggtgaaccgagccgtggcgccgactgccgcggctcggccgccgaggaccccataaggagagtcatgttcttggctccctggggccacacataaaacacagacccagatctgggcttgcaagagcatggccggatctgcaaaaaactgctcaagctcaaccatacttaaa

SEQ ID NO: 73130 - DNA, 325 bp, Zea mays
  Clone ID: LIB3078-025-Q1-K1-C7
cccacgcgtccgggaagctacccgcagggggcctcgcattcccggcgaaatccttcttcggcgcgccgctggccgccaccgcggcctccgtcgcgtcgccgctcccgcgcaagccggccacctccaccacctcgctcgaggtcggcgcggcggggaagaagggctacaagatgaagacgcacaaggcgtccgcgaagcggttccgggtgacggggaggggcaagatcgtgcggcggtgcgccgggaagcagcacttgctcgccaagaagaacaccaagcgcaagaagaggctctcgaagatggtgcaagtcaacaagagtgacta

SEQ ID NO: 73131 - DNA, 182 bp, Zea mays
  Clone ID: LIB3078-025-Q1-K1-F6
tagagaacatggaagaaaggaccggttctatgtcattgacatcaactattttgctggatatggcaagatgccacgatattatcacatattcactgacttcctgctaagcctcgtgcaaagcaagtacaagaggcttactgggagctgaagcgtaaagaagatttactttcgatggagactat

SEQ ID NO: 73132 - DNA, 327 bp, Zea mays
  Clone ID: LIB3078-026-Q1-K1-C9
aaaaaaaaaaaaaaaaaaaaaaaaaaaaatttaaaattaaaaaaaaaaaaaaaaaaaaaaaagaaaagggaaaaattaaaaaaaataaaaaaaaaaaaaaaacataaatgcccatccattctaaatgatccttctttacctccccttcctttccacgccttacttttcctattttgtcacctaaattccttttattgtccccctttttacaactccttttctggtaaaacctttgctttccccagtttaatccctttgcatcccatccccctttccccaccttccctattacctaattacccccctcctttcccccttttaaacctt

SEQ ID NO: 73133 - DNA, 316 bp, Zea mays
  Clone ID: LIB3078-026-Q1-K1-E2
aagaagttggagctgctcgcctgctgcccctttcctcccccgggccccctcttcgctgcgacggcgagcccaagaaaactttcctctaggagcgcatggaggtgtccgctgggctccggccgccgcccgtcgctgcggcagcgtcgctccgaggccgtcggtttgcgtcggtgccgccgctcgcggcttcccattcggtgcggaccgtgtcccgcgcggttaagaataaagcaagtgcaatctatgaccttcaaaggaatagaagttaccttgaatcgctattctgctacgactaatctgtcccagaagagaatat

SEQ ID NO: 73134 - DNA, 385 bp, Zea mays
  unsure at all n locations
  Clone ID: LIB3078-026-Q1-K1-G8
cggacgcgtgggctccactcctaccccacacagaagcgggggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgagctttggagggtccagtatgcactgagcaggatccgtaatgctgcaaggcacttgctcacccttgacgagaagaacccccgtcgtatctttgagggtgaggcgcttcttcgccgcatgaaccgctatgggctgcttgctgagggtcagaacangcttgattat

SEQ ID NO: 73135 - DNA, 420 bp, Zea mays
  Clone ID: LIB3078-027-Q1-K1-B3
cacggtcctccatcagctgtacgagatgaatcccccagcctacacctggctctatagtgacatttctgtcaacgatccattagatggcgattacttccttcgcttgctcgccaaggagaggcaagacctcgctgagagagtgatgatcacgcgccttcacctatacggcaaatggatcaagagatgcgaccacgcgatgatgtacgagcggatctccaaagagaacctggatatcatgcgccaaaggttggtcgagacagtggtctggccgaccgatgacacaaacttcggcgagtctaaggattgacgcggagcaatagctgcttcaatagatgctgtatattttcttcaatgttttttgactggctcatttctgtatatggcagttctgcatgaatagaacagttgataggggtctgt

SEQ ID NO: 73136 - DNA, 326 bp, Zea mays
  Clone ID: LIB3078-027-Q1-K1-F8
gtgagaagcagacgattcgaatcgagttttcatccttgcaagtgaccgcacttgtacccaccataaccggaatgggagaccacgtctcaggtcgcgtgaggggatatgtccactgccaggttcactcaggagaagaacaggtggttcaagtggagccacacatcgaggagttcgattcgatctaggtggcgtctcccagttgactttatggcgccaaggatggactttagttcgattttatatttataatttgttttgtaagacttccgctatgtaataagtactctgattatattgtgacatttatctctatacactctgttatt

SEQ ID NO: 73137 - DNA, 204 bp, Zea mays
  Clone ID: LIB3078-028-Q1-K1-A7
ctttgcagcaagaagcctgcccagatacccaagcccgctgcggtatcgtcgtcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggc

SEQ ID NO: 73138 - DNA, 373 bp, Zea mays
  Clone ID: LIB3078-028-Q1-K1-D9
ccgcctcctctccctatcacccggagctcgaccgaacgccggtcaccatgatcatccccaagaagaaccgcaatgagatctgcaagtacctcttcaaggagggcgtgctgtatgccaagaaggactacaacctgtcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggcccgccatttggctctggccctcctggtga

SEQ ID NO: 73139 - DNA, 92 bp, Zea mays
  Clone ID: LIB3078-028-Q1-K1-H4
acggactacaatggccatggagacttgcttcatagcgtgtgcgcttcacgcccccgctggcaggaaggacaggctcctcgtcagcaacctgc

SEQ ID NO: 73140 - DNA, 308 bp, Zea mays
  Clone ID: LIB3078-029-Q1-K1-D2
tacttacataggttgggtcctcgaaagtatacctcaagatataattgatacacacgaggtacaaacaatcactctcgactacagaagggagtgtcaacaggatgatatagttgattctcttacttgcatagaggaaggagaggagaaaagcatgaacggctctgcttctgcagcagcgcctcacaaagaagagcggcagcagttcctgcattgcttgagatttgcagccaacggacacgagatcaaccgtggccgtaccgtgtggaggaagctagctagataaaagtgttctttcgtcataaatgatc

SEQ ID NO: 73141 - DNA, 161 bp, Zea mays
  Clone ID: LIB3078-030-Q1-K1-C1
cggcgctcgagcccgagcgccgccaacggcagtggcttgggttcccttgcggtcaacgggaccggggccttccggaagaatgggcaattgcctcaaaaggagattccttccaacgtaattggggccgaattcaagaacccgcttccagaactctttgggaa

SEQ ID NO: 73142 - DNA, 355 bp, Zea mays
  Clone ID: LIB3078-030-Q1-K1-D8
cccacgcgtccgtccacgcgtccgccgacatcggcaggtcctcgaaggccatgtccatcatgaactccttcatcaacgacatctttgagaagctggccggcgaggccgccaagctggcgcggtacaacaagaagcccaccatcacgtcccgcgagatccagacctccgtgcgcctagtcctccccggagagctcgccaagcacgccgtctccgagggaaccaaggccgtcaccaagttcaccagcaactgagcgcgctgcgggatccgcggatctgttagaagggttctttgctgtgtcctttccccagtcccccaccctacccgcctagtagctagcttgcctgctctataaat

SEQ ID NO: 73143 - DNA, 336 bp, Zea mays
  Clone ID: LIB3078-030-Q1-K1-E6
cccacgcgtccgcgggaacgcgagcctcatccacgcgcagagcatccttgccatctgggcctgccaggtcgtgctcatgggcgccgtcgagggctaccgcatcgccggcggcccgctcggcgaggtcgtcgacccgctctaccccggcggcagcttcgacccgctcggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgacctcgtcaacaacaacgc

SEQ ID NO: 73144 - DNA, 431 bp, Zea mays
  Clone ID: LIB3078-030-Q1-K1-F6
aagcaagcaagcaagcagcgagtacatacatactaggcagccaggcagccatggcgcccgaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggtctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccac

SEQ ID NO: 73145 - DNA, 310 bp, Zea mays
  Clone ID: LIB3078-031-Q1-K1-A6
cccacgcgtccgcgtcgaggccgcggcggagtggcgcgaggccgcccacggctgcagctgcggtggcaactgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatg

SEQ ID NO: 73146 - DNA, 331 bp, Zea mays
  unsure at all n locations
  Clone ID: LIB3078-031-Q1-K1-G6
ctccgcctcctcagaggttccagctatgctactaaaccatgtgtcaattgatgttactggcgaaatgttaaggggaacaacacttgaagctgacatggagaagaaaaatgcaatgacagtccacatgaagcttgtgaaaaagaattcaactcataatttcttctaatgccgaagtttctagtgaagagacttgtactctgtttttatgttatattgtctatttgtacatgtgaatggagatgatcttatgtgatgtgatgatggatatattaactntgttggttggatattaaatgttatttaagttaagcttaaaaaaaaaggatataat

SEQ ID NO: 73147 - DNA, 379 bp, Zea mays
  unsure at all n locations
  Clone ID: LIB3078-032-Q1-K1-A1
tacgaggagctgctcgtcgccggcggcgccatgtacgtggaggtcttcaaccgcggtgtcatcccgctggcatacagcatcaggaagaggaacagccgcaccgggctgccgtccacctactacgacggcatctacctcctcatcacctacttcaccaagccggagtccatggacgccctgcagcttaagctcaacgccgacgacgacgtcatccgctccaccagcttcaaggtccgccagcggaaggccgtctagttagacgggttgcctnctncgncttcaggccctgaacactggtttgttcacataccatactacaagaaatctgctgtacaagaatccacctttgccatggatggtgaagttttttttttttgat

SEQ ID NO: 73148 - DNA, 112 bp, Zea mays
  Clone ID: LIB3078-032-Q1-K1-A7
ccgcaccgccgtgagcccgctgctgcggggcgtcgaggtcggcctcgcccacggctaccggcgcgtcgggcccttcgcgctgaccggcccgctccggaacacgcccgtgcac

SEQ ID NO: 73149 - DNA, 207 bp, Zea mays
  Clone ID: LIB3078-032-Q1-K1-D11
cccacgcgtccgaaaaaaaaaaaaaaaaaaaatttatttaaaaaaaaaaaaaaaaaaacaaacaatggagagattctaaaaattaaatacacgtacatacaaaataaataaactcttatataatgtcacctaaaattaaattcactgaccgtcaaattaacaacataataactgtaaaaaccctttcgtaacccaacttaatcacct

SEQ ID NO: 73150 - DNA, 297 bp, Zea mays
  Clone ID: LIB3078-032-Q1-K1-F5
cagcagttgatctgtgcggtggacttctgccacagcaggggtgtctatcatcgagatttgggggcagaaaatcttttgctcgatgagaatagcaacctaaaggtatcagattttggtctaagcgcacttgctgaatgccatagacaagacggcctgctacacacgacttgtggcacgcctgcttatgttgccccagaggtgattaacagaaagggttatgatggtgcaaaggctgacatatggtcttgtggcgtcatactgtttgtgctattggctggttatcttgcgttccatgat

SEQ ID NO: 73151 - DNA, 352 bp, Zea mays
  unsure at all n locations
  Clone ID: LIB3078-032-Q1-K1-G10
nacaatcttcctcagcgccgccgctcccagacaccgagcccgactgcccaaccccgatccggcgagccgtctctttcctttcctgcgttctgcaggccccgatcgcttgcattcccgtcaaccatggcggcggcagcaggcggaggcgcggtgcgcgctctgtcccagaaggagcaggacatacagatgatgctcgccgccgacgtccaccttggcaccaagaactgcgatttccagacggagcgctatgtctttaaacgccgcaccgacggcatctacatcatcaatcttggcaagacatgggataaactccagcttgcaacgagggttatncgtgccatcgagaacccgc

SEQ ID NO: 73152 - DNA, 457 bp, Zea mays
  Clone ID: LIB3078-033-Q1-K1-B2
taaccagaagccacccattggcgtacgcgaggcgatcggagcatcccgtcccgagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctacggcacgctccttctcactcccgtcgtcggcacctaccaatacgtcatgtggtacatagagcaggagaagctttcccacagatactaaatgggatgtcctacaagttgctgcggcttgtcgcagttgaattttccatgatgggttgtataatctgtcaatgtcatttctttgctcaggtttagttcaacccattttcacctctccatatgcatatacggtatctgtgcctggcaaacat

SEQ ID NO: 73153 - DNA, 364 bp, Zea mays
  Clone ID: LIB3078-034-Q1-K1-G7
agctggcccaaggtccgtggtgtggccatgaaccccgtggagcatccccacggaggaggtaaccaccagcatatcggtcacgcctctactgtccgccgcgatgctccccctggccagaaggtcggtctcattgcggctaggaggactggaaggctcagaggccaggctgctgccacagcctccaaggctgacaaggctacctagagtattgttgttcttgttttatttatccctctgctgtgatttattagatggttaaaaggacgtgttccggtatggatggtactatggtgaaacattgtgtcagcttttgtggtctctatggattatgaagtatgcctaaagaagttttttggtgctcaat

SEQ ID NO: 73154 - DNA, 356 bp, Zea mays
  unsure at all n locations
  Clone ID: LIB3078-035-Q1-K1-B3
atcgaccgcacgcgtccgcatggcagcagcacaagcaagaaccacactttctcccttctcctgcgaacangncgnctgggtgccggggcaagttcaggtgcggctccagctgctcctgccgcagctgatgcatctgctgcggtatgtaccctgacgtgtagaccgacttccccaccttcgtcaagaccactgtcctcgctcagctgccgcctctattcaggatccaatctttcttacgcgtgcttgcaactttatattttttctatattcttacataaatttaatttattggccttcattttatatcctttttactggtaataccctatcgttattctgcttttatattcttttct

SEQ ID NO: 73155 - DNA, 171 bp, Zea mays
  unsure at all n locations
  Clone ID: LIB3078-035-Q1-K1-B9
cccacgcatccgggacatacaacttgagctttaaaaaacaacgaccccgaacggaaatgttggactccaagagccaaactacancccaaagcnaccccacnaaaaatttcagaccatccaaagagacctgctgatgaacacccacaaccaccatttaacatgctaaggaac

SEQ ID NO: 73156 - DNA, 152 bp, Zea mays
  unsure at all n locations
  Clone ID: LIB3078-035-Q1-K1-C11
gcaaaacatctctaatacacccaatgcaaagtctcacgcagngatagccatggcgcgtgncgtatctttttgccggcttctcgccctgctcctagacttgactgcctttaatggcagctttgcagctcgacatctcttggacacagcagctt

SEQ ID NO: 73157 - DNA, 441 bp, Zea mays
  unsure at all n locations
  Clone ID: LIB3078-035-Q1-K1-E6
gctcaaccatctaccagcgactcagcgagcgagagcagtcacactgcacgcagctagctaggagcagcagcagcggcggcgatggcggcctccatgatctcctcgcagctctggcggtggcgcctcagggcctgccgcccctcggccgccgcgcctccttctttgccgtcgtctgcttcangangaagatcaagaccgacaagccctacggtattgggggtggcttgtcttttactttgataccatttcttgagagtgcgtttatgctactaatgatttcatttatttctatctatttaaatttgactcctattcagttgactaactatttttctttattctcatataccattttatttctttcctatgggcaccattttttttttgtatttaatttgactttttcttttttatatttctattcttcataaaaactttttt

SEQ ID NO: 73158 - DNA, 273 bp, Zea mays
  unsure at all n locations
  Clone ID: LIB3078-035-Q1-K1-H9
aaacagtatcgcctacagtacaaaacagtgttttgcacgctcgtttgcatggactgttggagatggccttatgctcccatacacagaaggaatgtgttgtatcgcgattttcctgatgtaattatttatttttctaatcaagctcgtacaggcttattgtgcacagacaaattaattgtttttcatgtgcgttcctttaggttcagacatatttggaataccagactcccccaattcttgccaaaaaataggcagttatcaaattnaaaaata

SEQ ID NO: 73159 - DNA, 415 bp, Zea mays
  unsure at all n locations
  Clone ID: LIB3078-036-Q1-K1-F11
cctccttcttcgtcggcgcggctgccggcgccgcgggcgggggctacttcctctacaaggactacaagctcgccaacgactctctggccctcaaggtgaaatgtctccaagactcaactgacactcgctacgaagcccttgaaaagcgactcgctgctttggaaggtctgcaaagccctgaggctgcaccggatgtggatacgccatctgattagtctgttcgctacgagactttgatttacgtctgttttcgtttgccccagttgtcttctcctttgaaagcaagtacctgaccaacaacaaaataatctaggatgcttctttgtactgcaaatgtctgaggctgagaatctnccctacatttcatgccagaaaagcacatgaacatcaaaactctgattactcaggcatactg

SEQ ID NO: 73160 - DNA, 606 bp, Zea mays
  unsure at all n locations
  Clone ID: LIB3078-037-Q1-K1-C7
ggtccgtgtaattcccgggtccgactccacgccgtctcgtcggaccgccgtaggggggcagcccatcatgttctcgcagcatctcggctctcnnnggcaaacntcncnnaagaactctgggggcgcgtcctaggggctcnctagcaccagttanntcgctcgtctnaccagcttcgcnntcgcgtagcccanngcttcctggttttccctttcttccttcccgcgccctcggaccatcgcnncagtgaagggcccgcgccgcgccccgtcgtttgaaaatcctggttttcttccctatctcgcnntgcgctcatcgtcgtcgtcttccctgctttcgttccgcgaccgtcgcttcccagtccaacagctcgttggctttcccttgtgcgcccggttgcggatgnnccgtcgcccgatcccttgttngccttggcccgatcccttggtgccttgccgaagctcatcanccgccgcgaggactctgnncatcgctgtgctcaagccacgccttncctagtccgtcttgcacatacctcatctccaaacaggggaccacgctgccgactatttgaccccgtcgttgcctcgcagcgctcgaacactatc

SEQ ID NO: 73161 - DNA, 355 bp, Zea mays
  unsure at all n locations
  Clone ID: LIB3078-038-Q1-K1-E1
tgcaatcacaacgaacaaaagctttcgatctcaccgaccccgaggaagaagagatcaatggcgtncgaacagggagtcgtgatcgcgtgccacagcaaggctgagtatgacgcccacatgaccaangccccangaagccggctagctggtggtcattgacttcactgncgcctggtgcggtccatgccgcgccatcgncccactgttcgtcgaacacgccaagaagttcactcaggtcgtgttccttgaagtggancgtgacgaagtgaangaagtcaccgctggctacgaggtcgaggcgatgccgacctttcacttcgtcaagaacggcaagacggtcgcgaccatcgtgggt

SEQ ID NO: 73162 - DNA, 225 bp, Zea mays
  Clone ID: LIB3078-039-Q1-K1-G10
tacttaacaggtaggtcgatattagcagcaaataaagctccatcataataggttcagagaaacgactgactgatttgtcttagcacaaaactctggatatagctagaaaccacgatagatggcctactgaagtgcaggtttccaagacgagccattggacccatggcaaacggtgacgacgaactaggatgtgacatctctccatgaactcacgccatcgaaaaa

SEQ ID NO: 73163 - DNA, 453 bp, Zea mays
  Clone ID: LIB3078-045-Q1-K1-G8
gcgcgcgctttccttgccttggcgcaggccgcgacctcccttctcggagttcgtttaaggtgttcgggagttgaccctgacgagcaccccatcagaaaggagtttgaaaggttaagcctaatgcatgagaagttaaatcaatttgagaactgggacaaagcaccacttcgcccttctactacactaaatacacaagcagcagcaaggttcattggacactcactttcccatctgacatctgatcagaagaggagcatgcatgaaataagtagaggagaaaggcggagttggtctgggcagaagagaaagcctgaaccttcaatagaaaagaagtctgttcgtgctgctgcagaagagttccttgcaaaggcttctcaagaacttattggacatagtgattgcaaggtcaagggttctgttatactaatttctgatgaagatgaagactagatc

SEQ ID NO: 73164 - DNA, 420 bp, Zea mays
  Clone ID: LIB3078-046-Q1-K1-E1
cccacgcgtccggtggatgggtatgtgtacagtgcagcggaagagccggaaatcatgattacagggaagtggaacaagtccctgagttgccaaccatgtgaccaagaaggcgatcctcttccaggcacggagctgaaggagatctggagagttgctcctgccccacagggcgacaagtatcagtacacacacttcgcacacaaaataaacagcttcgacacggcacctaagaagctgttggcatctgattcacggctgaggcctgatagatatgccctcgagaagggtgacatgtctaagtccggggcagagaagagcaggctcgaggaacaacagagagctgagaaacgaactcgagaggccaagggcgagcaatttactcctagatggttcaacctgacagatgtggtcttccctaca

SEQ ID NO: 73165 - DNA, 455 bp, Zea mays
  unsure at all n locations
  Clone ID: LIB3078-046-Q1-K1-E4
cgcctgtccactttgccggtgcttctccgtcgtcgaggccgngtcccagtgcgaagagacgacgactcagatggccagccgctgggtccggcccgaggtgtacccgctgttcgcggcaacgggcgtggccgtcggcatctgcggatttcagctcttccggaacatcaccggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactactacttgctactgtggattttacactttgctggcaactcaatatgttggggacatccatgacctctaaaagtactttgagcgcttggtgat

SEQ ID NO: 73166 - DNA, 456 bp, Zea mays
  Clone ID: LIB3078-046-Q1-K1-F3
taaaaagaaacatataaaaatcaaaatgatttatttatcactacgaaaaaagaaaacaattagtgagggcttgatacatcatactggaaggagacaaaaagtgaaaaaacactcacagtgcaatgctaactttggactgaaacggatcttagacttaactaaactggtgcatgaatcatgatgtcatgagacctttgcttagctacactgaccgctgtcatttctctagctatacgcgtactcgaatttggatacatgcgttgctagaggattatgcgtatgtttgtcactaggtgtccctctcattcatactttgcaactttacgtcactgggatccatctatctactagataattgagctctctgatagactaaaggtgcgaatgatcgtactagagctaatatatagttgactcactgaaattagctagcttaccaatatctagctaactatt

SEQ ID NO: 73167 - DNA, 328 bp, Zea mays
  Clone ID: LIB3078-047-Q1-K1-F5
tgacaagccggcggcgtggcggtcggtggtggagcggtacatcgagcatctgatggcgctggcgtgcaggctcctgggcgtgctctcggaggccatgggcctggacacggaggcgctggccagggcctgcgtggacatggaccagaaggtggtggtcaacttctacccgaggtgcccgcagccggacctcacgctggggctcaagcgccacaccgacccgggcaccatcacgctgctgctgcaggacctcgtcggcggcctccaggccacgcgcgacggcggccggacctggatcaccgtgcagcccgtggagggcgccttcgtcgtc

SEQ ID NO: 73168 - DNA, 383 bp, Zea mays
  unsure at all n locations
  Clone ID: LIB3078-048-Q1-K1-A3
gctaagttgaggctggagactcattaccaaaatatcgagtccttgctatcaacatgtgagaacattattgtcaaagtgcaaggagatgccacagtggatgctgtctttgctaagatcgacgagctgctgggttctatcctggagaagaaaaatgaaatggtttccagcacatgagcaaggtaaaaatgattgggtgcagtgcagatccgacaagttcatgtaatgcaagtcacctctcatgataggaacttctccaggggaatatatctgaagcacaggacgacacgtacaagtaatgtaagccagtctcacgtaatggaaatttctccatgtggatgtggtcaaagcatangaatttttttcctccaattattaactgtacg

SEQ ID NO: 73169 - DNA, 300 bp, Zea mays
  Clone ID: LIB3078-048-Q1-K1-E11
tcccggcgtccgacagcagcgttgcctagagaattatgactgttttccatcatacgatgccatcacatttttgtgcctggcttttgctgcttgtacagacttcatagctgtccacgttgttcctcctaccagatctgtgatgggaagtctttgacatttgtatttagttctcttttaccgaggagaaaatctatgtacctacatatcttgttgtctgaagcccaatgactagatacttatcttgaagccatatccataatcttatcagcaatgtgattatttttaaaaaaatactgcttt

SEQ ID NO: 73170 - DNA, 338 bp, Zea mays
  Clone ID: LIB3078-048-Q1-K1-E3
cccaggcgtcctttttaccaatccctcactcaacagccttttgacgtcatacaatccttccatgctgttgtctactgcatattatcgaatggatctttatgaacgtcccttaaatgaggtgcctgtgacaaatttttttggatcagtcatgaagactctccacactgattcagcctacacaggtttcttggctgcgcatgacaatgaaactccaatgtccacgggagataaccttgatgatcatttcatgttaaagggcagggctatcgcacgaagatcaaccatagaaaaggaagcacaattaacaccgcatggatggactgaagttcttgctgaac

SEQ ID NO: 73171 - DNA, 356 bp, Zea mays
  Clone ID: LIB3078-048-Q1-K1-H10
accccacgcgtccgcccacgcgtccgcccacgcgtccgtcgacttcgaggccgggcagggcaagacgccgctcggcgcgctcggcctatgatttgcatgctgccggcgaccgagtcagttctcgattgcgcgcggggtgggtgagctcctagggacgtacggctgcagcggatcagacgccttgcctcgcagattggaggctaaagaagagcgtagcagcaatctactgtctgtgttggtggtttcttctgggtaacgtgcgtgaaccagatggggtgttcctctctgtttttttttttcttttctgtgtatgtatgtaccatgtaatgtatagtatggatcgatttcattgcatt

SEQ ID NO: 73172 - DNA, 417 bp, Zea mays
  unsure at all n locations
  Clone ID: LIB3078-051-Q1-K1-A6
gatgtcctcgcggggcctttggtttcacttgcgtatcctgtgtgtgcctctgttagagcaattgaaacaaaatctgctgtggatgatcagcaatggctcacgtactgggtgctgtactcatttatcactctattcgagctcacctttgctccggtactcgaatggcttcctttctggtcttatgcaaagctgttcttcaattgctggttagtattgccacagttcaatggagctgcacatgtatatgagcattttgtgaggccaatgattgtaaatcagcaagttgtaaacatctggtatattccaaagaaggatgaatcaagtagacctgatgatgtaatttcagctgcacagaggtacattgagcaaaatggatcaaaagcgtttgagaatctngttaacaagtttaagagttcg

SEQ ID NO: 73173 - DNA, 147 bp, Zea mays
  Clone ID: LIB3078-051-Q1-K1-G10
tatagatcctcaaatgaagtaattacacaggtattaggtcgtggcaaccgattgtcaggcaatcaggctgtatatgttcgatgcggtatccggttgcagaccgtaagaattatattttctatttgtcttttgatttggttttcctct

SEQ ID NO: 73174 - DNA, 425 bp, Zea mays
  Clone ID: LIB3078-051-Q1-K1-G4
tagaaaaaacacggtatgatagagggacataactaatcagaagtctagactttatgttgtgcatcctgtaatagtaaaaatttccccattgttgtgatgtccattgctgatgttttgctacatattgcttatgcgtcaattccttgctgctgctgagggctgcaaactttcaaaactaggctgcaaggtggtgtctatattgttaagctgaggaggctgaaatgatttcaatcgttgattatgcatttcagcgaggaacacaacgtcagaaaaggcaattgttagttgaactgtactcccctgaacttcagctattcaaggatctgactgtgcaaagttcctcctgatacaatttccaagcttgggttgcagatatcatctgtcctgcttcatatgactattgtgattgataaaatcttggagaa

SEQ ID NO: 73175 - DNA, 451 bp, Zea mays
  Clone ID: LIB3078-052-Q1-K1-H12
gcgtgaagaggaccatcttactgcaccagtagccaatcccgaaccttggccccaatcaggaccataaccgaaggcttaagcctaaccccaaccaaaggcagaacctaagccagagccaaagctgagccgaaaccgaaaccagatccaaagccagagccacaaccaaagccagagcctaagccagaaccaaaaccagagcccaagccagagcctaagcccgaaccaaaccagagccaaagcctgagcctaaacccgaaccatgaccagaaccagaaccaaagccagagcctaaacctgaaccaaaaccgaaaccagaaccggagccacaaccaaagccagagcctaagcctgatccaaaaccagagcctaaacccgaaccaaaaccagagccccaaccaaaaccagaacctaagcccgaaccaaaaccacagccagaacctaagcccgagcc

SEQ ID NO: 73176 - DNA, 386 bp, Zea mays
  Clone ID: LIB3078-053-Q1-K1-A8
gggagaaatcagacggtcccaattaataccacgaaattcgcatgttcatcatgttgaaaacaacgatagagacatcaagttgtgtgcatcgtgtactctgattcgtatgaactatgcatttgcctatggacaaggaatctgagtatttaagaactcacgcctgctgtacatgtacccatttatttggcttttctactttccacacgccggagcatcccacacgcgagatgctttgtggcatgccttgaatttgaatatacttcaagctccatccacggagacgcttaccatttgttatgtgtgtcatcaaagattagggactcaatatcttgcaccacatgatcatctatctcaattctcagggtagagttatgacccaacttgac

SEQ ID NO: 73177 - DNA, 334 bp, Zea mays
  Clone ID: LIB3078-053-Q1-K1-C11
acctgggcgacctggttggtaccgcctaggctgctaaccttgcttttggggcgcactgtgagtcatcgactctagtcataccttactgtgatgggctttcggtctcttacattttatgggttgagaatgcctctgatgtgatatgcaactggcttgctgctattaggcatgatgggctggccgggcaaatggtctacatatgcttctacttctgtggcatatcattcctcatctgtatcgctgatagaggcatggacctcgtcttagatatactaggtgtgccgacgtgcacggagatgtagatgagcatgccatattgatcgatatatatttt

SEQ ID NO: 73178 - DNA, 238 bp, Zea mays
  Clone ID: LIB3078-053-Q1-K1-E12
gaaactagcactgaagagcgagattgttcgcttcagattaaaaatggctgtttagactggtatagttataatttattgagacaaactatcacagagagtggcctgctcgctgatgctccatccacatgttgattttggttttgggtcgtcaaagcttggcccgctcatcctcaactttgcattctgaacctatgttctcttcctccaaccacagaaatgcatctctgtatgtatcgat

SEQ ID NO: 73179 - DNA, 242 bp, Zea mays
  Clone ID: LIB3078-053-Q1-K1-G5
gacggacacactcgtatacataactagccacatctaatacgcgcaggcaggctcgggggctcatgccaccaatggcaagggatggcgatacgcctcggagcggcaacagctcaggggttcgcgggaccggctgacaagaagcaatgcgacggcgtcacgcacgtggtggatatgaacgattacagtgatctaaatgggctcaccaaggtgaacatgctaggagtgcgcatgaccgtctacta

SEQ ID NO: 73180 - DNA, 323 bp, Zea mays
  unsure at all n locations
  Clone ID: LIB3078-053-Q1-K1-H5
cttacggaccgtacggcagggacgagggcaccccgttccgtgtcaaggtgatgaacaacggccacgtcgctggcttctttggccgctctggagattgcctggacgcgatcgggctctacgtgaaccccaactaataactaaaacgatggatcggatcatctgcatgcatgcatatgcagtatgcatgctgcttgcctgcctgtaacgaatatgaatgcataaaataacgcccctgctgctcccatgcatcagcagtgtgtaccactatggtatatatatatatattatactggaatttcgctaaccgaataaaaacatanatt

SEQ ID NO: 73181 - DNA, 406 bp, Zea mays
  Clone ID: LIB3078-054-Q1-K1-B1
tacatctttgccatctgcatacactagccctggtgtccgaggttttatcctagcaacaggatttggtgcatcactgtatttcctggcaaagaaaaatatgaacttaggtaaggctgcattgatcactgtcgggggacttgcagctggtgcaactgtcggatctgcagtggaaaatttcctgcaggttgatatcgtgccctttctaggcatccactcccccgccgtcgttgtcagtgaatttattctgttctcccagttgttggtatcactgtttgttaggtaggatctgaaatcaagctgtcatcctgatcatggcatgtaagtaactgaaatggttcgtgttcaaacttcaaagggtcagggaaatgcttattttccgctcaaggtgcaagcagctgtgtatagc

SEQ ID NO: 73182 - DNA, 432 bp, Zea mays
  Clone ID: LIB3078-054-Q1-K1-F6
tatggaaccagacatttgatttcatggtagaagatgcactgcatgatttgcgcatggtggaagtatgggaccatgatacatttggaaaggattacatagggaggtgcatcttgacactgacgagagttatactcgaaggtgaattccaagatacctttgtcttgcaaggtgccaaatcgggaaaactaaacttgcatttcaagtggacgccacagccaatctatcgtgatcgtgacagggatcagtgagacttgtaaacgaaaaaggccgataaacacttatccccaacggtgctatgtatattagtcgttctgtatttacaaaatcccacggttcttatagccacgtgaccaaaaagagatcaacccaccgacctgtattttctcctttgtgatgcaagtcagcaagtgcatggacctgtatatttgagtc

SEQ ID NO: 73183 - DNA, 386 bp, Zea mays
  unsure at all n locations
  Clone ID: LIB3078-055-Q1-K1-D3
atcgttcggtttccttggtgaatgcccgatcgctcgctcgctcgaaaagaaagaagctagcttttagcatggcgtctctggcgttcggcagcaccgtagcggcggccgtggcggcgacctcggggaggacgcggccggcgcgccggtccgtgctggtcgtgccgcccgctgccagcaggggcggcccggcgccggccaaggaggagaagggcctcggcgagaccatcttcggcttcatcttcaagaaggaccaactggtggagacggacccgctcctcaacaaggtcggcgccgcgccggccgccgnctcccgcgccaagacgaccgccggcaagaaggctgccggcggcgacgacagcggcagcggcggggggttcaacctcggc

SEQ ID NO: 73184 - DNA, 420 bp, Zea mays
  Clone ID: LIB3078-055-Q1-K1-D7
cccacgcgtccgcggacgcgtgggcggacgggtgggcggacgcgtggggtgatgatttccttgcaatgttggaagaaagcaaggagcttacatcatcaacaagatggagcaaagcaatacttatgtttgaagatgatgaaagattcaaagcagttgagcgtccaagggagcgtgaagatttatttgagaactatcttgtggaactgcataagaaggaaaaagccaaggctgctgaagaacacaaaagatatgtagcagagtacagagcttttctagaatcatgtgacttcatcaaggcaagcactcagtggagaaaagttcaggaacgcctggaggacgatgaacgttattcccgacttgagaagtttgatcggttggatatttttcaagagtacattcgacacctagagaaagaagagg

SEQ ID NO: 73185 - DNA, 381 bp, Zea mays
  unsure at all n locations
  Clone ID: LIB3078-055-Q1-K1-E4
cacggaccacagcggcgttccaacaaatttggtcacaacaaactgttctctgcacatgagctgtgtacaaccctgccacaatgtttggaattcatgtcacttctggccccatccacctgatgtattcagagatcccaatagcagtcggtcaggttcggaggtattaccaaccgaggaagagccaccggatggtgactgcggtcatccacggcgagaaggtgccgctgtacggcgccgggggcagactgatgctgtcgacgagcacgggcggngcggtgcccctgacgctggactaggacctgaccttgacgggctacgtgatcggcaagctcgtgcgggtgacgcacaaagtgcacgtgacgtgcctcgtcgtcgtggacg

SEQ ID NO: 73186 - DNA, 183 bp, Zea mays
  Clone ID: LIB3078-056-Q1-K1-B8
tacacacgtactatcccagcttttctttatcaatatgtccgactattttctttcagggcggagtacaatatgcgcgactctcgacacattacttatgagtaactttacaaatcatacgccagaaccatatcctttctctatacattgctcaacgcactttcattgactatacaccaataatgt

SEQ ID NO: 73187 - DNA, 371 bp, Zea mays
  Clone ID: LIB3078-057-Q1-K1-B10
gaagatggcagtcgccgaaccacaagatatgatattgacatgaccaaatgcatttactgtgggttctgtcaagaggcttgtccagtcgatgctattgttgaggggcctaactttgagtttgccactgagacacacgaggaactactgtacgacaaggagaaattgcttgagaatggtgatcgctgggagactgagattgctgagaacttgagatctgagagcctctatcgctgaatctgtcttccattatggttgataaactgggttcttccattttccatattttgctcaactagctgatgaataagcaaacgatgtatcataacttaggtacgatgtttttgtaccttggcaccatctgtgtgttttgt

SEQ ID NO: 73188 - DNA, 359 bp, Zea mays
  Clone ID: LIB3078-057-Q1-K1-B2
gaagatggcagtcgccgaaccacacgatatgatattgacatgaccaaatgcatttactgtgggttctgtcaagaggcttgtccagtcgatgctattgttgaggggcctaactttgagtttgccactgagacacacgaggaactactgtacgacaaggagaaattgcttgagaatggtgatcgctgggagactgagattgctgataacttgagatctgagagcctctatcgctgaatctgtcttccattatggctgataaactgggttcttgcattttccatattgtgctcaactagctgatgaataagcaaacgatgtatcataacttacgtacgatgtttttgtaccttggcaccatc

SEQ ID NO: 73189 - DNA, 320 bp, Zea mays
  Clone ID: LIB3078-057-Q1-K1-E5
gttcgtgggtgagcggatcgagatggcggcgtaggatgttgagtaccgctgcttcgtcggcggtctcacctgggccacggacgaccactctctgcacaacgcctttagtacctacggcgaggatctcgagtacaagatcatgctcgatcgggagactcagaggtcccgagggttacgctatgtccccttctccacggaggaggcgatgcggaacgccattaagggcatgaacggtaaggagctgtacggctcgaacatgaccgtgaacgatgcccagtcctgaggcggacgtggatgcggaagcggcgggtacggtggtg

SEQ ID NO: 73190 - DNA, 472 bp, Zea mays
  Clone ID: LIB3078-008-A8-R1A
cgagaacaacggcggcacagcgacagttacggcgataggcgcggcggcggtggccctgcggcgggaggcaccagcaccaccaccagctgcaatggcttcgatggtggcgagcacaacgaagccgcggacgcgcaggcgacggggcaagctgccgccgccgccgccgcctccacggagctgatccgggaccccaagagggtgaagaggatccttgccaaccggcagtcagctcagaggtcgcgggtgaggaagctgcagtacatctccgagctcgagcgcatgctacaacactgcagaacgaggtgtccgcgctgtctccccgtgtggcatttctggatcagcagcgtaccatactgaccgtcggcaacagccacctcaaacagcggatcgcagctcttgctcaggacaagattttcaaggatgctcatcaagaggcgtttgagaaggagatcgagaggctgcgccaggtcta

SEQ ID NO: 73191 - DNA, 443 bp, Zea mays
  Clone ID: LIB3078-013-H9-R1A
ggcacgcttgacgatacgtgaagacagatgctcaaggcgggtgtgactccagtaaggctcagaataaatcggcgtgcatctcgtcgattctcgtgcgcaagatctgcgaaaccttgcaaaggcgctggtatgcagcggtcgatccttcaatcattcaggctcagtggagaagggaccttcatgagagattacttcatctagttagactcattcttactcagtggaggataattcgacgtattgtaggactaataccatcagagggtcttgatcgttttaagaagctgcttttcaccggatgtctaatggctgacgattatgaggctaatgataatcttaggtagatgcgacctggcaagattaactcaaacgtttagtcagagcccaaaattcctgatactattgatatagctgaagctggatcaggaatgctttcttaggca

SEQ ID NO: 73192 - DNA, 474 bp, Zea mays
  Clone ID: LIB3078-022-D12-R1A
cccacgcgtccgccagaccacgcacgccggcagagaaaaaccagaattctccaagcaatcctatcgccaacccggccacggatcggggctgccgtctgtttccgccggcgctggcgccgacgccgatgggctccgccgatcgcagtaagctgcagatcgacgggatcgtggtgacggagaaaggcgccaggagctgcgtcgaatgccgcgccaccaccacgcccatgtggcgcagtggcccgaccgggcccaggtcactttgcaacgcttgcgggattcggtaccgaaagaagaggaggcaagagcttggcctagagcacaacaagcagcagcaacaacaacaaaataatggcgaggcgaagactggagtaaaagacagctctagcaacagcagtagcagcgggagcagcaactttcacgtggtgcagaaacggaggctcctaatggaagtggaggaagctgctctgctgctga

SEQ ID NO: 73193 - DNA, 560 bp, Zea mays
  Clone ID: LIB3078-008-A8-F1B
ggtaaccagattcccaggaatgtaatgcttcaaaaaagtgatttacacaacagatcagtttccctgatgactttaccacaatttgcacagtgaaccaaatcccaaaatcaacatacaaagaattaacgcacacgtgtcaatggaagaagacagaaagacagaagacaacatccacataatccgaaaaaaagagacatcatgatgcaatgttccctccatgttaattaatgataaggcgggcgggctgcactgcacagcgggcacgcgtggatcgactgggtagctagctcatgagctctttctccgcgcgcaccggtggcgggccatggtcagaggcagcagcgccggctgacatcttgaggttctgctgctcgtagacctggcgcagctctcgatctccttcttcaacgcctcttgatgagcatccttgaaaatcttgtcctgagcaagagctgcgatccgctgcttgacgtggctgttgccgacggtcagtatggtacgctgctgatccagaaatgccacacggggagacagcgcggacacctcgttctgcagtgttg

SEQ ID NO: 73194 - DNA, 569 bp, Zea mays
  Clone ID: LIB3078-016-H3-R1B
aacacttcctgcacccatatcctactgatggagacaagcaaatgcttgctaaacaaacgggtttaacacggaaccaggtatccaactggtttataaatgcaagggttcgtctttggaaaccaatggtggaagagatccacaaccttgagatgaggcaggtgcacaaacaccctgttctcgacaagggccagcacgtgctgcatcaccaaacccagcattcgttcgagagcagtggaaagccttctgacccttccgactctcagcttggccaaagcagcagcatcacgaggaaccacaacatccctgcgtcccagggatttgccgatgagctctccgagatgtcccattctattcagcaggggcacgtaaccttcgcatacaatgggatgtcggcgccacaccacagcctcgcttcgtcacagcaccaccagcaggccgggccgatgagcggcattggtggcgcggggaacggtggcgtctccctcatcctcggcctccaccagaagaacagagtctgcatagccgagccactcccggcgtcagtccctctcaacctcgctcatcgtttt

SEQ ID NO: 73195 - DNA, 571 bp, Zea mays
  Clone ID: LIB3078-016-H3-F1B
ctccatcctcaggaattgattcaaactgatcaagccaaagccaccaagtgatacacttatataccattctaacatactagtagtggtacaaatacatgcttgtgcaccatcagcaagctgagatcagatcagctgaccagaagcaacaatgcagcagcagctgccatgtcagccaacaaaatcatgcaccaaatggccgccaatctccttgccgaaatgccggtcctggttcccgaaagagcccatcatgtaggggtcgctgacctcctccaacccaaaacggtgagcgaggttgggagggacggacgccgggagtggctcggctatgcagactctgttgttctggtggaggccgagggtgagggagacgccaccgttccccgcgccaccaatgccgctcatcggcccggcctgctggtggtgctgtgacgaagcgaggctgtggtgtggcgccgacatcccattgtatgcgaaggttacctgcccctgctgaatagaatgggacatctcggagagctcatcggcaaatccctgggacgcagggatgttgtggttcctcgtgatgctgctg

SEQ ID NO: 73196 - DNA, 461 bp, Zea mays
  unsure at all n locations
  Clone ID: LIB3078-001-Q1-K1-C12-M1
ctttctctggcattattggcacgctgcacaatactagttagcttggcataggcccagcagtctgaagatggatgctctgcctctgctgcggtagtttctcgggggcaaaccttccacgcggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacgcagtgcatgtataattgtatgggttaatgacgcagtgcatgccttgcggagtgggccggtagacaaacatttcggcggctggtcacttggtcagtgacccgttgatattattattattattggatctaatgcaacaaccagttctggtgttggtgtccaaaannaaaaannnnnnnnnnnnnnnnnnnna

SEQ ID NO: 73197 - DNA, 335 bp, Zea mays
  Clone ID: LIB3078-001-Q1-K1-C12-N1
gggacaccaacacctgaactggttgttgcattagatccaattataataataatttcaacgggtcattggccaaaagaccagccgccaaaaatgtttgttaccggcccactccggaagggattccctgggtttttaacccaaacaattatacctgccctggggtaatatagagaaaaaaaaaggggggggggggaaaacaaaaaaccacggtttattaagtgtttacaaaaaaaggcaaatggggcaattccaacacttacatacaggtttttcaaccaaataattggacattaacaattccatggcctgccgcgttgaaagttttgcccccagaa

SEQ ID NO: 73198 - DNA, 600 bp, Zea mays
  Clone ID: LIB3078-034-Q1-K1-E1-M1
tgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcattgacttcactgccgcctggtgcggtccatgccgcgccatcgccccactgttcgtcgaacacgccaagaagttcactcaggtcgtgttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggcccagatcgagaagcatgctgcgcctgcgcctgcgattgcgtctgcctaaaggagatcagatcagtcgtcgccgtcaataagggccagcacgtatggctgtaaatgttgtcgttatcagttctggctttgtcgtttgtgggcgattgtgaactagtagtatgtttgtttctatccgagccggaggcgatacttaaccatggatacttgttgtgagttcgtttca

SEQ ID NO: 73199 - DNA, 445 bp, Zea mays
  unsure at all n locations
  Clone ID: LIB3078-001-Q1-K1-A4
gcgaaggcggacgcccacgcgtccgcccacgcgtccgtccaggcntgcgcccacgcgtccggtaatttcatgatggtgtggtggaaccgtgggcgcttggaacatcaatacagtacaagagattgcttgttggaacagtcacattggtccgattacagcattgaagtgggcccctcgtcgagcgatgtttgcaactgcatcaactgccctaactttctggattcccaaccaatcgaattaggatcaggtgcctggagaaagaagggatgtgacttcatgtatgttaacgtagcaaatgttcatatcttgttcttttgtccaaaagatagatgccatgtatgaaatcacttcattaccatctgcggaaacattgacatgtttccaggcagatacttgctgtagtgctcccttatttatatgtactgtactaatacacctggcctgt

SEQ ID NO: 73200 - DNA, 441 bp, Zea mays
  Clone ID: LIB3078-001-Q1-K1-F1.F1
agaggagcaacaggagctatatgtccattggaaccaagatggatgcaatgtacacgtacgcacgcacacacgttacaaagtcaccacctgcaggcacctgccaggccggcggcgcgtatcgaggctgctgagtctgatcttaacaacgacgacgtagggatctagccgatgatctggtcgagggcgccggtgttcttgagcccgagcacgatgccgacgccgaggatgtggccgacgggccgcagagtcgtgtcggcgagggtgaacccggcggggtcaccttctgcaggccggagtcgcgcgcctccagcttcagccccgccgtcgccttgcggttcgccgacggcccagccgtaaccgccccgcgaacagcatcagcgtcgtcgtcgtcaccatgatcaggtttggtgccggacgattgttagtcgcagtggattgccc

SEQ ID NO: 73201 - DNA, 546 bp, Zea mays
  Clone ID: LIB3078-001-Q1-K1-F1.F2
agaggagcaacaggagctatatgtccattggaaccaagatggatgcaatgtacacgtacgcacgcacacacgttacaaagtcaccacctgcaggcacctgccggccggcggcgcgatcgaggctgctgagtctgatcttaacaacgacgacgtagggatctagccgatgatctggtcgagggcgccggtgttcttgagcccgagcacgatgccgacgccgaggatgtggccgacggcgccgcaggccagcgtgtcggcgagggtgaacccggcggggtcacccgtctgcaggccggagtcgcgcgcctccagcttcagccccgccgtcgccttgcggttcgccgacggcgccagcccgaaccgccccgcgaacagcatcagcgtcgtcgtcgtcaccatgatcaggttggtggcggagccgatgtagtcgcagcggatgccctgcgacgacgacctcttcctgcccaccctcacggacggcagcgctgccaccgcggacctgggcgcggcgttaccccggaagccgtggaaccggggcacggcggc

SEQ ID NO: 73202 - DNA, 432 bp, Zea mays
  unsure at all n locations
  Clone ID: LIB3078-001-Q1-K1-F1.R1
cccacgcgtccgcccacgcgtccgcccacgcgtccgcccacgcgtccggggagcttcnnacgcgctaagctgaggacggtacagcggcacagaggtgcgacgtacgacgacgacgacgcagcgccacacatggcatcccagctctccgccgccgtgccccggttccacggcctccggggctacgcgcgcccaggtccgcggtggcagcgctgccgtccgtgagggtgggcaggaagaggtcgtcgtcgcagggcatccgctgcgactacatcggctccgcaccaacctgatcatggtgacgacgacgacgctgatgctgttcgcggggcggttccggctggcgcgtcgggaaaccgaaggcgacggcggggctgaaactgcaggcctcgaatccggcctgcacacgggtcacccccccgggtttcaccctcg

SEQ ID NO: 73203 - DNA, 513 bp, Zea mays
  unsure at all n locations
  Clone ID: LIB3078-001-Q1-K1-F1.R2
cccacgcgtccgcccacgcgtccgcccacgcgtgcgcccacgcgtccgcggacgcgtgggtccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctggtcgcggggcggttcgggctggcgccgtcggcgaaccgcaaggcgacggcggngctgaagctggaggcgcgcgactccggcctgcagacgggtgaccccgccggggtcaccctcgccgacacgctggcctgcggcgccgtcggccacatcctcggcgtcggcatcgtgctcgggctcaagaacaccggcg

SEQ ID NO: 73204 - DNA, 396 bp, Zea mays
  Clone ID: LIB3078-001-Q1-K1-F4.F1
aatgtactctggattcgacatggaggtatggtatatataacacagcagtagcagacggctggctgcttgaattgatcatatcccgtatgcaaaggctactagagatacacatatgtgtttagtcgtcgatgcatgtatgcatggcatggcatggcatgctcatgaactaccgatgtacttgtcgatgagggtggtgagcgtggacttcgggacggcgccgatgacgctctccttcttctcgccgcccttgaagatgagcacggtggggatgctgcggatgccgtagtcagacgccacgttggggctgtcgtccgtgttcaccttgcagcacgtgatcttgccggcgtagtccttggccagctcgtcgatcaccggcgcgatcatccggcacggccc

SEQ ID NO: 73205 - DNA, 569 bp, Zea mays
  Clone ID: LIB3078-001-Q1-K1-F4.F2
aatgtactctggattcgacatggaggtatggtatatataacacagcagtagcagacggctggctgcttgaattgatcatatcccgtatgcaaaggctactagagatacacatatgtgtttagtcgtcgatgcatgtatgcatggcatggcatggcatgctcatgaactaccgatgtacttgtcgatgagggtggtgagcgtggacttcgggacggcgccgatgacgctctccttcttctcgccgcccttgaagatgagcacggtggggatgctgcggatgccgtaggtagacgccacgttggggctgtcgtccgtgttcaccttgcagcacgtgatcttgccggcgtagtccttggccagctcgtcgatcaccggcgcgatcatccggcacggcccgcaccacggcgcccagaactccaccagcaccggcgtctcgcacgccatcaccaacccgtcccagttcttctcgtccgccaccacaacttcgtccactgcgttcttggactggcagacgtgccccggccggcgcgtggcgaccccggccacggacagcggcgcgagcgcccgct

SEQ ID NO: 73206 - DNA, 169 bp, Zea mays
  Clone ID: LIB3078-001-Q1-K1-F4.R2
ggagacgtgcttcagagcgtgggcgctgcacgcccccgctggcagcaaggacaggctcctggtcggcaacctggtgctgacggacaagcgggcgctcgcagccgctgtccgagggccgcgtcgccacgcgccggccgcagcacgtatggcaggccaagaacgcagtaga

SEQ ID NO: 73207 - DNA, 448 bp, Zea mays
  Clone ID: LIB3078-002-Q1-K1-A6.F1
cgttctgtatatgcatagcagctccattaccacgtttgctgtagaatatacacagcatggcacattgaacgattgacatcatgcacatgtagctaagccaggaggccaggaccaagagacgcgccgatcgatcactcggaggtcggaggcgcaggagggaagctagcggcgccgccatggcctgctccaaacccttgtccttcctcgctgaagctgccgctctgatcgacatccgctgccccttgctgccaggccgggtcccaggccggaacatgccaggccggcatcatcggcgccggctgccccatcggcggatagtagtagggcatcccggcggctggcgcccggtcggcgatcgaccgtacgccggtcccaggcgccgcgaaccgagggcgctgccgggttcctcctatggctcctcgcggggcacgatgtctacgaggaaatc

SEQ ID NO: 73208 - DNA, 617 bp, Zea mays
  Clone ID: LIB3078-002-Q1-K1-A6.F2
cgttctgtatatgcatagcagctccattaccacgtttgctgtagaatatacacagcatggcacattgaacgattgacatcatgcacatgtagctaagccaggaggccaggaccaagagacgcgccgatcgatcactcggaggtcggaggcgcaggagggaagctagcggcgccgccatggcctgctccaaacccttgtccttcctcgctgaagctgccgctctgatcgacatccgctgccccttgctgccaggccgggtcccaggccggaacatgccaggccggcatcatcggcgccggctgccccatcggcggatagtagtagggcatcccggcggctggcgccccgcccggggcgccagccccgacgacgccggtcccaggcgccgcgaagccgagggcgctgccgggctcctccttggcctcctcgcggggcacgatgtctacgaggaaatcgaagacgtcggtgcgcgcgatggccgcggcgacgtccatgcgctgcatggtgcggcgcttgttctcctcggcgtggagccaggagcggatagtgagctcgaggatgaagagctcgcaggccttggcgaacagcacgggcgcctcggcggagatcatgcgcac

SEQ ID NO: 73209 - DNA, 482 bp, Zea mays
  unsure at all n locations
  Clone ID: LIB3078-002-Q1-K1-A6.R2
ctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtagacatcgtgccccgcgaggaggccaaggaggagcccggcagcgccctcggcttcgcggcgcctgggaccggcggtcnngggggctggaactnctgnaaaggtcagggaggtcccctgacgacatctccagcgttgttctaggcgagaaagacaggtctttcatcaagtctgaagcggtgctgaggataatggagtacctgaa

SEQ ID NO: 73210 - DNA, 419 bp, Zea mays
  Clone ID: LIB3078-002-Q1-K1-B10
cccacgcgttcgggagcaaggagcacgactcgatgggccactccaacgtttggaactcgcagcctaataactacggccctggctcccgcgtctgccgggtctgcgcgaaccctcacggtctgatcaggaagtacgggctcatgtgctgcaagcagtgctttcgcagcaacgccaaggacattggtttcatcaagtaccgttgaagaggccactgtgctgctgcggagaacttgctacatcagagaaatgggtccttcattagaaggcctaatttatgcgctttagctatttgttcagaacttgagactcatgtgttaaactcgacttgttaaagttttgatggctactttgtgcttgctggaccagctatcatcagaagattgagactttctcactcaacagagagatccagaccttcg

SEQ ID NO: 73211 - DNA, 258 bp, Zea mays
  Clone ID: LIB3078-002-Q1-K1-C1
taggatcgtactgttgcatccttgattaataaggaggcaagtacttaaacctgggtgatgagtaaatgacctgtgggccagagcgtgattaacggccaggattcagtctctgtgctttgtctggtgctgtagatgatcgttcctggtcaggagcccctggctaagggtggcccacaggttgtctgacaggtcattttaaataaaaataagaaatataaacagaaactaaagaaacaaacagaacacattcagaacaaa

SEQ ID NO: 73212 - DNA, 261 bp, Zea mays
  Clone ID: LIB3078-002-Q1-K1-D2
atccttccgcccgccttaggaaccaggcaccaggtttcacgatggcggaaaagaaccatatccgagtaggttataggaaagacggggcgtacatctactgattgatgctgccagatgcatgtctgtcttatgtttcacgctgcattgcataggcaagtccagatgatgagttcgcgttgtacactaagatgaaccatgtttgtgcaatagtggcggtttctgtttcctgctggttaattgctgatatccaaaaaaataaat

SEQ ID NO: 73213 - DNA, 392 bp, Zea mays
  Clone ID: LIB3078-002-Q1-K1-E5
ggaagtgatagtcctgataatggcaagcgtgaaattgaactgtggttcaaagaaggcgagctctgccaatgggaatcagttcaagcaccgtggcttatagaataactcttgctaatcatttccagagttgtattcaatgtttttttttgtgttcgtcttgattcaaggagccatgcaagagtgtatgagtttagttcggctaagtaattagctcatgagggcttgaattatcggttctttttgaggattgaggatttgtgcaactgaaacctttgatcagttgctcatgttgagaagctaatttcttgtcatatttacatgtaataaagtccctctactacagtaataaattagtatttcctatggtccaattaagaaaaaaaaaaataaaa

SEQ ID NO: 73214 - DNA, 427 bp, Zea mays
  unsure at all n locations
  Clone ID: LIB3078-002-Q1-K1-F12
cccacgcgtccggccagagagaagacactttctgatcagtttgaggccaagcgtgcaaagagcaaggcaagccgtgagaggaagattgctaggagggaggagaggctggcccagggcccaagagaaccaacagcacctgtcgcagccccagctccatctactggggtgccaaagaaagcaaagaagtgaagtatggaaacaaagctgtagctttttggtactatataagcatgactttggagcacctgaagtattttgctgttatatagatcgtgtctcaatattctgagtcttgtatctctaccgttctgttggataatgcatgccgtaagagttgtttatggagcttttgttgttacaggacccctaaaaatgtttgtttgacggatgtttggaattgtggtcatgtttatgaaaaacaanaaac

SEQ ID NO: 73215 - DNA, 420 bp, Zea mays
  Clone ID: LIB3078-002-Q1-K1-H4
gctggaggtcatccactctcgctggtcaactcgagattatggagccctgctgtagcgtggaggacaggatagggtacagtatgataaatgatgctgaacagaagggcttgattactcctggaaagagtgttttggtggaagcaacaaagtggaaacacacgcattggtcttgctttcattgctgcttccaaaggatataagctgatactaacaatgccttcatcaatgagcatggagagaagagtcctccttagagcttttggtgccgaacttgtccttactgatgctgcaaaaaggatgaaaggggccttagataaggctacagagattttaaacaagacaccaaattcttacatgcttcaacagttcgataaccctgccaaccctcaggtacattatgagactactggtccagagatc

SEQ ID NO: 73216 - DNA, 299 bp, Zea mays
  Clone ID: LIB3078-002-Q1-K1-H8.F1
agagcaaggtttttttgtttgagctttgtttagatggctaaaactacgcacacatagatgttcgtggtacatcatgtatgcagactgttgacatcgaatcgtatagactaagtatcgagatctcaggggcacaagttgttacagtatctcgcatgcttctgcttcggaccggccaaacatggcgtacctgttgttcgcacgttgtcgtacgcgagtccctcaggaacagagggacgaacttgaaggagacggcgaactgcgggaatggcaggtttaagtactccattatcctcagcacc

SEQ ID NO: 73217 - DNA, 539 bp, Zea mays
  Clone ID: LIB3078-002-Q1-K1-H8.F2
agagcaaggtttttttgtttgagctttgtttagatggctaaaactacgcacacatagatgttcgtggtacatcatgtatgcagactgttgacatcgaatcgtatagactaagtatcgagatctcaggggcaccagttgttacagtatctcgcatgcttctgcttcggaccggccaaacatggcgtacctgttgttcgcaacgttgtcgtacgcgaagtccctcaggaacagagggacgaacttgaggaagacggcgagctgcgggaagggcaggttgaggtactccattatcctcagcaccgcttcagacttgatgaaagacctgtctttctcgacgagaacaacgctggagatgtcgtcaggggacctccctgacctctgcaggagcttcctcccggactcgctctgcagcggcacgtacctgatgctcctgttggggtcgtgctcccgcacgaagcggacgccggcgttgcagaggttgcagacgccgtccaagagcatgattggcctggtgtcggaaggctggaagaactcggcgt

SEQ ID NO: 73218 - DNA, 123 bp, Zea mays
  Clone ID: LIB3078-002-Q1-K1-H8.R1
attgttcacaagttcagatcttcgccgacgacggccgatgatgctaatcgctagggcactgctcctcctgctattatacgtcaccatcctgctgctacagctccaacgacggtacagccacct

SEQ ID NO: 73219 - DNA, 499 bp, Zea mays
  unsure at all n locations
  Clone ID: LIB3078-002-Q1-K1-H8.R2
attgttctcaagctcagagcttcgccgaggaggcgacgacgatggcaatcgccgggcagtgctcctcctgctattatacgtcacccaccctgcagctccagctccaacgacggcacagccacctgccgctgcagccccaagccgcacgaagagcgcggcggccgaggttgcaggtggccacagctgccggcagcgggcccatcagggcggccacggacgccgagttcttccagccttccgacaccaggccaatcatgctcttcgacggcgtctgcaacctctgcaacggcggcgtccgcttcgtgcgggagcacgaccccaacaggagcatcaggtacgtgccgntgcagagcgagtccgggaggaagctcctgcagaggtcagggaggtcccctgacgacatctncagcgttggtctcgtcgagaaagacaggtctttcatcaagtctgaagcggggctgaggataatggagtacctcaacctgcccttcccgcagct

SEQ ID NO: 73220 - DNA, 459 bp, Zea mays
  unsure at all n locations
  Clone ID: LIB3078-003-B2-R1A
cacacgcgtccgcaaacgcaaaaccgcactctctcatcagctctcttccacattcgtctcgagatctccgcccgtngccatggacgcgctcgacagcctggtcgatccnctccgngacttcgccacacgacagcgctcgcatcgtcaagggctgccacaagcccgcaccgcaaggagttcaccaaggtggcggcgcggacggcgatcgcgctcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaatactactgttaatgaaatttttcgcttggttgtgtttctgatgtaatcgttgtactgagtagaccttctggataccggattctg

SEQ ID NO: 73221 - DNA, 481 bp, Zea mays
  Clone ID: LIB3078-003-C3-F1A
aaaacgcaactgtcatctttcattgaagaaacaaactaagcacaaaactgtcgtgggttaatttcccaacccccattgggacaaatcatttctggcaaagtggcactcgacatgacaattcatgcatcatcgacaccggtcattggttcattatcctcggatccatctccgccatcttcatcatccgcgtgtgcaccctcgctcccaccgtcctccatccgataatccaccttgaaatcgtagtccgcgtccatgtcgttcagcgcgctgggcctgctcgccttgcgccgtttcttctctgctttgctcttgcgagggtcgagtacgccctcggcggtgtacaacttgtcgttctgcgtgctggcgctggctgccttgcttcctcctgagtccttcacgtcgggcatttgctcctccctgtcccggctttcctggatggcttcgcttggtttcttgccaccatcctctagcatctcttcat

SEQ ID NO: 73222 - DNA, 463 bp, Zea mays
  Clone ID: LIB3078-003-C3-R1A
gtcccgagtggtcaatgtcggttctactccagggattactagatcaatgcaagaagttcaattagacaagaaggtaaagttgttggattgtcctggtgttgttatgctcaaatcttccaacagtggtgtgtctgtagcccttcgaaactgcaaaaaggttgagaaaatagaagatccagtcgctcctgttaaggagatcctaagtatttgcccacatgagaagttgctgtctctatacaaggttccaaactttggttcagttgatgatttccttcagaaagtagcaactgtacgtgggaaattgaaaaagggtggtgtagtggatgttgaagctgcagcgagaattgtgcttcatgactggaatgaaggtaaaataccatattttacactgccgcctaaaagagatgctggggaggactcagatgcagtgattatatccgaggatgggaaagaatttaatatc

SEQ ID NO: 73223 - DNA, 412 bp, Zea mays
  Clone ID: LIB3078-003-Q1-K1-A3
gcgctcggcgatgtcaagggcgcctccgaggaggtgaagcagctggaggaccaggcggcgggcatcatgaaggcggcgcgcgccgagatcgcggcggcgcttaacaagatgaagaaggagaccaccgcggagctggaggccaagctggacgaggggcgcagccgtgtggaggccgagctcgtagaggcgctcgccaacctcgaggcgcagaaggaggaggctgttaaggcgctcgacgcccagatcgcctcgctcagtgatgagatcgtcaagaaggtgctcccatccgcgtgatgaaaccaaaccggccctgccttatcctacgactatagttacatgaacatcataaattaatgataattttgaagaaattggccgatgactccgacactgtactcatgaaagattattg

SEQ ID NO: 73224 - DNA, 59 bp, Zea mays
  Clone ID: LIB3078-003-Q1-K1-B2
cccacgcgtccgcaaacgcacaaccgcatcctctcatcagcttccttccacattcgtct

SEQ ID NO: 73225 - DNA, 154 bp, Zea mays
  Clone ID: LIB3078-003-Q1-K1-G6
ggttatggttagttaaacctactgttctacggttgtggacgtcatgcactgctgtcggagtgggtgattaataatttaactttccttttcttttttttttaccggtcagtgtaatctcgttgctcttcagatttaccatatgtgtttcacattc

SEQ ID NO: 73226 - DNA, 375 bp, Zea mays
  Clone ID: LIB3078-003-Q1-K1-H11
ggagaaggagatgcagctggccgtggccgtgtaagggtacgacagcgacgagggcatcgtgggggtcgaggaggttgctgccaatgtgcgatggctcttggagtccgatggcgggaggatgctccggaagcgcacgctggcggccatgcggcaggccaaggacgcgctgcgtgagggcggtgagtcggaggccacactgaccggattggtggacgagtggaaacgcatttgacgcggtacgtggggattgggaacgggtgacgttacgcgacggatgaagtgccggtcatcatttcttttaaaaaaatatatattagtaatatattcatgtatttatcaataaaagatacaatctattgcattaaaaagataaca

SEQ ID NO: 73227 - DNA, 521 bp, Zea mays
  Clone ID: LIB3078-003-Q1-K1-H5.F1
gttcaaaacgacgtgaaactggtgcattcagcgtttccattttcatctctcaacaataaactcctgaatctctatcccagtgtgacgggcggcgccatgtttcctcaccagaacttcatcaccgactttcagcgaagtcacaggaatggcggtccttccacttgatcctgtgttaggggtaataagtgctactgtttctgcgttttgtagaaaaatgctatacgtctcgtctccagagtgatccttcgcttctacaaggatcagaggccttgattcgatcttcacacgaccgacaattgcagtacgccatagcccactctgattgatcacgatgacttcctttcctgaccccaactctgagaggtagcttgtcttgccaccaggaacggtgacatatgcatgtacaggccctgtattgactctgaaaggcctgcttgtaattgtaattagtctccaagcattcagattgcacaagaaacattcctctcgtattaggtttcaactagtaggccttcaccagg

SEQ ID NO: 73228 - DNA, 612 bp, Zea mays
  Clone ID: LIB3078-003-Q1-K1-H5.F2
gttcaaaacgacgtgaaactggtgcattcagcgtttccattttcatctctcaacaataaactcctgaatctctatcccagtgtgacgggcggcgccctgtttcctcaccagaacttcatcaccgactttcagcgaagtcacaggaatggcggtccttccacttgatcctgtgttaggggtaataagtgctactgtttctgcgttttgtagaaaaatgctatacgtctcgtctccagagtgatccttcgcttctacaaggatcagaggccttgattcgatcttcacacgaccgacaattgcagtacgccatagcccactctgattgatcacgatgacttcctttcctgaccccaactctgagaggtagcttgtcttgccaccaggaacggtgacatatgcatgtacaggccctgcattgactctgaaaggcctgcttgcaatgtaattagtctccaagcattcagaatgcacaagaaacattcctctcgcataggatccaaccagaaggccttcaccaggtcgcatgatactgcaaagatccacacaaacgcgatcacccataccaacaacctcgacctttgttacagtagcctttgtcaatggtaattgact

SEQ ID NO: 73229 - DNA, 591 bp, Zea mays
  unsure at all n locations
  Clone ID: LIB3078-003-Q1-K1-H5.R1
ggatgatatcattaagctcaaggattattgttgatcgaaggaacgaggcaaagagtcaattaccattgacaaaggctactgtaacaaaggtcgaggttgttggtatgggtgatcgcgtttgtgtggatctttgcagtatcatgcgacctggtgaaggccttctggttggatcctatgcgagaggaatgtttcttgtgcattctgaatgcttggagactaattacattgcaagcaggcctttcagagtcaatgcagggcctgtacatgcatatgtcaccgttcctggtggcaagacaagctacctctcagagttggggtcaggaaaggaagtcatcgtgatcaatcagagtgggctatggcgtactgcaattgtcggtcgtgtgaagatcgaatcaaggcctctgatccttgtagaagcgaaggatcactctggagacgagacgtatagcatttttctacaaaacgcagaaacagtagcacttattacccctaacacaggatcaagtggaaggaccgccattcctgtgacttcgctgaaagtcggtgatgaagttctggtgaggaaacagggcgccgcgtncacactgggat

SEQ ID NO: 73230 - DNA, 510 bp, Zea mays
  Clone ID: LIB3078-003-Q1-K1-H5.R2
ggatgatatcattaagctcaaggattattttgatcgaaggaacgaggcaaagagtcaattaccattgacaaaggctactgtaacaaaggtcgaggttgttggtatgggtgatcgcgtttgtgtggatctttgcagtatcatgcgacctggtgaaggccttctggttggatcctatgcgagaggaatgtttcttgtgcattctgaatgcttggagactaattacattgcaagcaggcctttcagagtcaatgcagggcctgtacatgcatatgtcaccgttcctggtggcaagacaagctacctctcagagttggggtcaggaaaggaagtcatcgtgatcaatcagagtgggctatggcgtactgcaattgtcggtcgtgtgaagatcgaatcaaggcctctgatccttgtagaagccaaggatcactctggagacgagacgtatagcatttttctacaaaacgcagaaacagtagcacttattacccctaacacaggatcaagtggaag

SEQ ID NO: 73231 - DNA, 416 bp, Zea mays
  Clone ID: LIB3078-006-Q1-K1-A2.F1
ggtgtgagaacagattttattgacttgagattgatcacttcaaaagcataagttcagtaataagagattgatcacttcaaaagcataatttcagtaataaatcttccgagataacgaagaacacaaatttaagcacattttctatggacaagagcacgaacggatcaagaactgaagaacatcggtctgcaatccagtaaccaagaagcaaaagggggaggagcagcacctcagaggctcagactagctagtagttggacggcggcactggcgtgtaccatctcccggcctcgtcgtcgatgctgtcggcggggcggtgcagcagtgcgtggagcaggacgagcagaagcccgacgagcagcgaggtgaggatgaagcccgtggcgccgtgtgagcagcagcagggctagcgtgac

SEQ ID NO: 73232 - DNA, 537 bp, Zea mays
  unsure at all n locations
  Clone ID: LIB3078-006-Q1-K1-A2.F2
ggtgtgagaacagattttattgacttgagattgatcacttcaaaagcataagttcagtaataagagattgatcacttcaaaagcataatttcagtaataaatcttccgagataacgaagaacacaaatttaagcacattttctatggacaagagcacgaacggatcaagaactgaagaacatcggtctgcaatccagtaaccaagaagcaaaagggggaggagcagcacctcagaggctcagactagctagtagttggacggcggcactggcgtgtaccatctcccggcctcgtcgtcgatgctgtcggcggggcggtgcancagtgcgtggagcaggacgagcagaagcccgaccagcagcgaggtgaggatgaagcccgtggcgccggtgagcagcagcagggcgagcgtgaccgcggagaggaccgcgacgaccacgccgtncccgacgccccgcccgcaaatcacgagcgtcccgtccacgtcgcggtcgcggaggaagtagagcacgagccaggcggcgaagcaggcgagga

SEQ ID NO: 73233 - DNA, 70 bp, Zea mays
  Clone ID: LIB3078-006-Q1-K1-A2.R1
cgtccgcgcgtctactccggcgcccgtgggctcctcccagctcgacttcatctcccacgcctaggcccgc

SEQ ID NO: 73234 - DNA, 474 bp, Zea mays
  unsure at all n locations
  Clone ID: LIB3078-006-Q1-K1-A2.R2
ctcgtctactccggcgcccgagggctcctcccagctcgacttcatctcccgcgccaaggcccgcggcgcgtccgcgctcgccacgcgccgtccctggcgcgagctcgcggacccgcgcgcgctctccgtnccgcgcggcttctcagacgcctaccgccgggcgcgcgccaacctcgcgcacttcgccgccaactacgcgctcgtcgtnctgctcgtcgtcttcgtctccctgctctggcggccggtctccatgctcgtcttcctcgcctgcttcgccgcctggctcgggctctacttcctccgcgaccgcnacgtggacgggacgctcgtgatttgcgggcggggcgtcggngacggcgtggtcgtcgcggtcctctccgngggcacgctcgccctgctgctgctcaccggcgccacgggcttcatcctnacctcgctgctcgtggggcttctgctcgtcctgctccacgcact

SEQ ID NO: 73235 - DNA, 311 bp, Zea mays
  Clone ID: LIB3078-006-Q1-K1-A3.F2
ggtgcctaaattaccaaatacgaaaactaaaatagacaattcaggcaataaatacagtgtttcagtatccaagcaatttgtttcaacagaaaaaaaactcactgaattctggtacataccgtacattacatatgcaagtaaacacaagtgttcctatgaagcaacagctttagacataaatcaccagactaggaaaaaaagttcaaagcaaatgacagctgcagctcaactgaagtgttggcttaatcctttctcaggtcgatatactcgcgcatagtaccggccttgttaatgactacaatttccaactt

SEQ ID NO: 73236 - DNA, 273 bp, Zea mays
  unsure at all n locations
  Clone ID: LIB3078-006-Q1-K1-A3.R2
tggaagacctagctgccagagaattgctgtaccaacaccagcataataaaaggatgagctgccccgccatggcacagctcctctccaataccctggactacaagcgattcttcccatattacgccttcaatgtgctcggtgggcttgacagcgaggggaaaggatgcgtgtcctcctatggtggaatgggtccctggcatagagcatgctacaggactcatgacattgcaagcaggcctttcanagtcaatgcgggggctgtacatgcatatg

SEQ ID NO: 73237 - DNA, 160 bp, Zea mays
  Clone ID: LIB3078-006-Q1-K1-D1
cggatatctcggctctcgcatcgatgaataacgtagcaaaatgcgatacggggtgtgagttgcataatcccgcgaaccatcgagtttttgaacgcaagttgcgcccgaagccttctggcggagggcacgtctgcctgggcgtcacgccaaaagacaatat

SEQ ID NO: 73238 - DNA, 325 bp, Zea mays
  unsure at all n locations
  Clone ID: LIB3078-006-Q1-K1-D3.F1
ggcaggaagtttttttttttaaaaaaaaagacgaagcaatattagtaccaagatttctcaaacaacnttggatggcagcagaaacgggtcctctcatgtacaatcaaagaaacacacaacaagcatggcgagccaggccatgcctagctctctacgtacacacggtgcgtgcatgtgcatccctgatgaaaagcatcaaagaaacaatagtttacgtcggtcacgcgacgctgaaggaggcggcggcttctcgacgccttcctggcgcccttgaaccaccgcttgtcgccggcctgcgccttgcagatgtagagcttgccgtcgg

SEQ ID NO: 73239 - DNA, 557 bp, Zea mays
  Clone ID: LIB3078-006-Q1-K1-D3.F2
ggcaggaagtttttttttttaaaaaaaaaagacgaagcaatattagtaccaagatttctcaaacaacttggatggcagcagaaacgggtcctctcatgtacaatcaaagaaacacacaacaagcatggcgagccaggccatgcctagctctctacgtacacacggtgcgtgcatgtgcatccctgatgaaaagcatcaaagaaacaatagtttacgtcggtcacgcgacgctgaaggaggcggcggccttctcgacgcccttcctggcgcccttgaaccaccgcttgtcgccggcctgcgccttgcagatgtagagcttgccgtcggagacggtggcggtgatgagctggtgcttgccgccctcgtcgccgtccgccgtcctggtcagcacggtgatgctgtagtactgcttgccgtccaccacgggggtggagctctccagcacgttggcggtggccacggcgtcggtctcgaacccgccctcggagtcggtcttgccgccgtaggcctgcttgccgagcaggtagtcgacctgcgagaggaactcctcgggggag

SEQ ID NO: 73240 - DNA, 347 bp, Zea mays
  Clone ID: LIB3078-006-Q1-K1-F7
tgccacgcgtccggtccatcgtcaccttcgccaagactgacaacgaggcgttcaggttgctggtcctcctcggcatgccgttctcggagaacatcaagaccgacgtggtgatccggaagaagaggttgaagcgccaccacttcctgagcaagggcaaggggaagggaggacgacggtgaggagaggaaccagccagccagcccatggttgcacacgctctgctcagcttgttttaattccgatctttttgcagaatttggcttacaaattcgatgctgttgttgtctgtcaattatgtaacttgtgcacctatgaaaaaggtttgcaatgatcatgtccgttttgct

SEQ ID NO: 73241 - DNA, 438 bp, Zea mays
  Clone ID: LIB3078-007-Q1-K1-F11-R2A
agattagtaaagctgtttttcactgcaaccgaatccaaaataacgaatacagaacaacgacgctaatacggcctattttttggtaactagacattcatcagatcctcggagatgatggctacgcgcgctcgccacggatgcggcgggcgagctggatgtccttgggcatgatggtgacacgcttggcgtggatggcgcagagggtggtgtcctcgaagaggccgacgaggtaggcctcggcggcctcctggagcgccagcacggcgtggctctggaaccggaggtctgtcttgaagtcctgcgcgatctcgcgcaccaggcgctggaagggcagcttgcggatcaggagctccgtgctcttctggtacttgcggatgtcgcgcagcgcgactgttccgggcctgttcctgtggggcttcttcacgccgccggtcgtcg

SEQ ID NO: 73242 - DNA, 506 bp, Zea mays
  Clone ID: LIB3078-007-Q1-K1-F2.F1
aataaaaaaacatgacatatgtattattaatggccatctatcagaagcatgctcataagggattaattggatatactgtatctggactcgaggatgtcgttgataaagtagtagctaaataaatcaacatacagctagcaagcagatggagatgaacatgtaaatgtatatagtagtatatgcctccgcaccacgcagtacctaatccagccacccagattgatgtcaaataaagccaggccgggccgggccgccgcgcgccagagtctagcctcgctcagcccggcggcgacgacgggatcttagctagccgaggtaaatgtggacgccgacggcaggtaggaagatggcgaggagggcgaagtagatgacggcgtggatgaggatggagaggccgctggtctggaagttgccgaactcgatgatccggcccttgcccgggatctggaagagcaggcccggggagagcaggatgaagagcaccagcccgatcagcaccggccccc

SEQ ID NO: 73243 - DNA, 568 bp, Zea mays
  Clone ID: LIB3078-007-Q1-K1-F2.F2
aataaaaaaacatgacatatgtattattaatggccatctatcagaagcatgctcataagggattaattggatatactgtatctggactcgaggatgtcgttgataaagtagtagctaaataaatcaacatacagctagcaagcagatggagatgaacatgtaaatgtatatagtagtatatgcctccgcaccacgcagtacctaatccagccacccagattgatgtcaaataaagccaggccgggccgggccgccgcgcgccagcagctagcctcgctcagcccggcggcgacgacgggcgactagctagccgaggtaaatgtggacgccgacggcgaggaggaagatggccaggagggcgaactaaatgacggcgtggatgaggatggagaggccgctggtctggaagttgccgaactcgatgatccggcccttgccggggatctggaagagcaggcccggggagagcaggatgaagagcaccagcccgatcagcaccggcccccagtccgccatgccgagatcgatcggtcggtcgatgagcgaagcacagcacacttctcgcagc

SEQ ID NO: 73244 - DNA, 453 bp, Zea mays
  unsure at all n locations
  Clone ID: LIB3078-007-Q1-K1-F2.R2
ggtagctatagcagcctagcacacaccaccacccaccaccaccgcgccacagagctgccgagagtgtgctgtgcttcgctcatcgaccgaccgatcgatctcggcatggcggactgggggccggtgctgatcgggctggtgctcttcatcctgctctccccgggcctgctcttccagatccccggcaagggccggatcatcgagttcggcaacttccagaccagcggcctctccatcctcatccacgccgncatctacttcgccctcctcgccatcttcctcctcgccgtcggcgtccacatttacctcggctagctagtcgcccgtcgtcgccggcgggctgagccaggctagctgctggcgcgcggnggcccggcccagcctggctttatttgacatcaatctgggtggctggattaggtactgcgtggtgcggaggcatatactactata

SEQ ID NO: 73245 - DNA, 463 bp, Zea mays
  Clone ID: LIB3078-007-Q1-K1-H9.F1
atatttttatttttttttgaaagaaacgattatatatgtctttcatcatatataatgtatgtacatcgatagaacgacgacgagccaaacgattcgattgatctccgcaatactacgtacaatgcaatgcaaactcatcaccaccagattgcttgagctgaacagtataatgaaggatcatcatcagtagacttcgacgttccattgctcgctcttcttgagctgcttcttgtagtccaaccagttgatcccgtccttggctgcgaggtcgagcatgatgtcgtcgatgcccttctccatgcccttgagcccgcacatgtagacgtaggtgttgtccttcttgagcagctcccacagctcctccttgtactccgccatgcgcgtctggatgtacatcttctccccggccgcgttcgtctgctctcggctcaccgcgaagtccagccggaagttgtccggcgcc

SEQ ID NO: 73246 - DNA, 170 bp, Zea mays
  Clone ID: LIB3078-007-Q1-K1-H9.F2
gaaagaaacgattatatatgtctttcatcatatataatgtatgtacatcgatagaacgacgacgagccaaacgattcgattgatctccgcaatactacgtacaatgcaatgcaaactcatcaccaccagattgcttgagctgaacagtataatgaaggagtcatcatcag

SEQ ID NO: 73247 - DNA, 270 bp, Zea mays
  unsure at all n locations
  Clone ID: LIB3078-007-Q1-K1-H9.R1
cccacgcgtccgccacgcgtccgccacgctccgccacggatcgtgagccgtacgtcgggacgtgnctgctcaacaccaggatcaccgccgaccaagcgcccgtgagagacgtcggcacatggctcttcagcacagaaggcgaggtccctacagagagggccagtccatcggcgtcatcgcagatggcgaggacaagaacggcacgccgcacaagcttaggctctactccatcgccagcagcgccctccgaaatttcngcgactccaagac

SEQ ID NO: 73248 - DNA, 545 bp, Zea mays
  unsure at all n locations
  Clone ID: LIB3078-007-Q1-K1-H9.R2
cccacgcgtccgcccacgcgtccgcccacgcgtccgcccacgcgtccgaaggagccgtacgtcgggaggtgcctgctcaacaccaggatcaccggcgaccaagcgcccggggagacgtggcacatggtcttcagcacagaaggcgaggtcccctacagagagggccagtccatcggcgtcatcgcggatggcgaggacaagaacggcaagccgcacaagctcaggctctactccatcgccagcagcgccctcggagatttcggcgactccaagacggtgtcgctgtgcgtgaagaggctggtctacaccaacgatcagggggaggtcgtcaaaggagtctgctcgaacttcctctgtgacttgaagccaggcgctgaggtgaagatcacagggccagtgggcaaggagatgctcatgcccaaagaccccaacgcaacaatcatcatgctcgcancgggtaccggcatcgctccgntccgctccttcttgtggaagatgttctncgaggagcacgaggactacaagtacaccgggctcgcgtggct

SEQ ID NO: 73249 - DNA, 381 bp, Zea mays
  Clone ID: LIB3078-008-A8-F2A
ggtaaccagattcccaggaatgtaatgcttcaaaaaagtgatttacacaacagatcagtttccctgatgactttaccacaatttgcacagtgaaccaaatcccaaaatcaacatacaaagaattaacgcacacgtgtcaatggaagaagaaagaaagaaagaagaaaacatccacataatccgaaaaaaagagaaatcatgatgcaatgttccctccatgttaattaatgataaagagggcgggctgcactgtacaaagggcacacgtggatcgactggggagctagctcatgagctctttctccgcgcgcaccggtggcgggccatggtcagaggcagcagcgccggctgacatcttgaggttctgctgctcgtagacct

SEQ ID NO: 73250 - DNA, 426 bp, Zea mays
  Clone ID: LIB3078-008-A8-R2A
cgagaacaacggcggcagcagcgacagttacggtgataggcgcggcggcggtggccctgcggcgggaggcaccagcaccaccaccagctgcaatggcttagatggtggcgagcacaacgaagccgcggacgcgcaggcgacggggcaagctgccgccgacgccgccgtcttcacggagctgatccgggaccccaagagggtgaagaggatccttgccaaccggcagtcagctcagaggtcgcgggtgaggaagctgcagtacatctccgagctcgagcgcagcgtcacaacactgcagaacgaggtgtccgcgctgtctccccgtgtggcatttctggatcagcagcgtaccatactgaccgtcggcaacagccacctgaagcagcggatcgcagctcttgctcaggacaagattttcaaggatgc

SEQ ID NO: 73251 - DNA, 406 bp, Zea mays
  Clone ID: LIB3078-008-Q1-K1-B9
tgcacgcgtccgcccacgcgtccgatggatattgaagattctggtctggagattgaaggcttacggtccttggggggcaccagcctgaagttcaaagtccactcctttgagattcgtgagtgcattctgtggctcagtatagtgttcgtcacaatactgtgcacaccacaactaacggttatcaggtggtctccgaacccaccggtgtcagccgatgtcttgcatcagtggaaaggattctgtgctctaatcgcgaacgcttactatgtcaaaggaatggcatggttgccagtgaaaaccttgcagctggaacagatggctgtcacaggaagttcagagaaaccatcagtcgttgctagccgcatgcagttagttttcagcacattataagtagtcagcccacagt

SEQ ID NO: 73252 - DNA, 268 bp, Zea mays
  Clone ID: LIB3078-008-Q1-K1-C3
atcgactgctcgtgtcgcgtcgggccacggccggtcgtcagtttgggtgtgtccactggactggaaagctccttttttgggtactccctgcatgccaaaattagcggacgtgtactaagtgtggttcggagcaacatgttgaattacttaccacccactctgtgacgtaagaacgcgtgctgaaattatcatgtcgataccaagttatggcatatggattggataagaatgggaaaaaatatgatagatcttgacttaaaaaaagaaa

SEQ ID NO: 73253 - DNA, 355 bp, Zea mays
  Clone ID: LIB3078-008-Q1-K1-E9
atcaccgatgaacctgcgggtgctgcttcacacggaataagtgataggctgtacgaataccatctaagggatggcaaccggtagtgaagcctcgaaagcagctgaagctgtggttgactggcataaacacgacagcaagaggatgctacatgctgcttaccgtgatggggatctgaaccgcacaatcaagtactacacggaatgctttgggatgaaactgctgaagaaaagggatgttcctgatgagaagtacaccaatgccttccttggctttcggccagataacaccaactgttcagttgaattgacttacaactatggcgttgacaagtatgacattggaacaggctttggg

SEQ ID NO: 73254 - DNA, 305 bp, Zea mays
  Clone ID: LIB3078-008-Q1-K1-G9
cacaaactggaattggcacgtccattgccatagctggtgttgctatgtactcttacatgaaggctaagattgaagaggagaaaaggaaaaagagcgcatgactgctgtgaataatattatcgggaccttcctcggacacaacatcgtcgacaatcacgacctacttctataccttgttttggtttcatcttgagtcagtcggtccattgtttgttcccagtctggtgattaaaagtctgcaaattctgtttgtggaattggcagcgatacaaatttggcttctttaagtaaaaaaaaaagaaaaa

SEQ ID NO: 73255 - DNA, 145 bp, Zea mays
  Clone ID: LIB3078-009-Q1-K1-A8
tcgcgctggccaggtcaccgtgcacgacggcgcctccgtctggagcggcgccgtcctgcggggggacctcaacaagatcacgctcggcttctgcgccaacgtccaggagcgatgcgtcctacatgccgtatgggcggggcccaca

SEQ ID NO: 73256 - DNA, 143 bp, Zea mays
  Clone ID: LIB3078-009-Q1-K1-B6.F1
gactgaacagcgatacatttaacatcagattcagatcaaccaactgaggacgcacacagtagcagagaacaagaacatcagccactaaacaagacattacgggccaaattaaacaaagataaaaacacattcttccttttttt

SEQ ID NO: 73257 - DNA, 542 bp, Zea mays
  Clone ID: LIB3078-009-Q1-K1-B6.F2
gactgaacagcgatacatttaacatcagattcagatcaaccaatgaggacgcacacagtagcagagaacaagaacatcagccactaaacaagacattacggccaaaattaaacaaagataaaaacacattcttcctttttttttgaaaacacacacattgttgctactagcaagctggtactgaagatagacggtgtgcacccagccggggaggtctgtcgacgtgcttgtacttcgtgacgatggcaacgatgcgtcgatgccatgacggcgacccagatgacgagctcgctcgtccatggcgagctcgctcacgagtcacgaacgtgagcagcagaacgcggatggaggagcatggcacaaggtacgcgcccatctggggagcctgtcgaggcgcatgtacttggtggcgatggcgagcagcgccatgacgacagcccagatgatgaggtcccagaagagcgacgtgcgcggctgcgacttcacgaacgtgagcacgaggctggagtaggccagcaggaacgcgaaccggacgaagcgcg

SEQ ID NO: 73258 - DNA, 65 bp, Zea mays
  Clone ID: LIB3078-009-Q1-K1-B6.R1
ccacgcgtcctggcgccaaatggcagtagcactacacatggtcaacaaacacaagtgacaaaaga

SEQ ID NO: 73259 - DNA, 440 bp, Zea mays
  unsure at all n locations
  Clone ID: LIB3078-009-Q1-K1-B6.R2
cccacgcgtgcgggagcaaaaaggcagtagcagagcacatgtcaacaaacacaagtgacaaaagaaacgaggatgacggagcagagcaccagagacgtgcgcgcgatgctcaccggctcaccgtcgagactcgatcgagagttagtgcaagaagaaagaggtgcgagcaagagggatgaacggcgccggcaatggtgagccctgccttgtaattgtagcggaggaagggccgccgaacgatggcatcggcgccggcgttcacgcacccaacttcggcgcgaatgaagcggacacgctgctggtggtggcgacactgatcacagcgctgacgtaccagctgggcaccaacattccgggcgggtactggcaggacnatctcaatgggcacgacagcgtcgnggggcacgttgccggagacccgatcatgcgtgacaagcacc

SEQ ID NO: 73260 - DNA, 231 bp, Zea mays
  Clone ID: LIB3078-009-Q1-K1-B9.F1
ggacaacagttcaaatatacatatgcagcacaagatcgttcgactgctatccgacaagccaacaacgtgcccagtagaactgaatgtacctgtgatttcagcactaacttacagcaacgttgtgaaaaaacaaaaacgaaaacaaccggcagaaaaaccagatgtatttgttctacagtttacaccaattattttctgggtccttttcagcacaaccaagagccataacgc

SEQ ID NO: 73261 - DNA, 329 bp, Zea mays
  Clone ID: LIB3078-009-Q1-K1-B9.F2
gcacaacagttcaaatataacatatgcagcacaagatcgttcgactgctatccgacaagccaacaacgtgcccagtagaactgaatgtacctgtgatttccagcactaacttacagcaacgttgtgaaaaaacaaaaacgaaaacaaacggcggaaaaaacagatgtattgttctacagttacaccaaatattttctggtcctttcagcaccaacaagagccatacgcatatctagaagacaaaattcctctaatttcacccctacgtgggagcaggtcctcctcaacacagatcacgtgctagcgtcgagttctttgggccgccacat

SEQ ID NO: 73262 - DNA, 361 bp, Zea mays
  unsure at all n locations
  Clone ID: LIB3078-009-Q1-K1-B9.R1
ttcaagaatggtgcctccactatattgatatattcagcggcctactgatattgcatggggcaacgagccgtgtcatattggatgtgggttgtggagttgccagcttgtggaggctacaggtttgatagagatgcgcttaccatgtcttttgctgccaaaagatgagcatgaagctccagtacaagttgcattaganaggggaattccagcactatcagctgtgatgggcaccaagagacttccgtancccagcagagtctttgatgtcatccattgcgctcgcagcanggtcccttggcacatcgaacgtggcatgcctttcgtcggaattgaacagcttgttacgccctggtggttactt

SEQ ID NO: 73263 - DNA, 632 bp, Zea mays
  unsure at all n locations
  Clone ID: LIB3078-009-Q1-K1-B9.R2
ttcaagaatggtgccctccactatattgatactattcagcaggcactacctgatattgcatggggcaaacgaagccgtgtcatattggatgttggttgtggagttgccagctttggaggctacatgtttgatagagatgcgcttaccatgtcttttgctccaaaagatgagcatgaagctcaagtacaatttgcattagaaaggggaattccagcaatatcagctgtgatgggcaccaagagacttccgtaccccagcagagtctttgatgtcattcattgcgctcgctgcagggtcccttggcacatcgaaggtggcatgcttttgctggaattgaaccgcttgttacgccctggtggttactttgtctggtctgccactcctgtttaccaaaagctcccagaggatgttgagatttggaatgccatgtctactttgacaaagtccatgtgctggaagatggtcaacaagactaaggataagttaaaccaagttggtatggtcatatatcagaaaccaatggacaatatttgctatgagaaaagatctgaaaacagccccccattgtgcaaggaatctgatgatgcagatgctgcttggaatgtaccgntggaagcatgcatgcacaaact

SEQ ID NO: 73264 - DNA, 179 bp, Zea mays
  unsure at all n locations
  Clone ID: LIB3078-009-Q1-K1-D12
aactgaaacttaacccttctttggtgtatgaggtatccaccttcggcgggaaaattcttgagaacggtttcatcttgcanaataaaagaaactaaatttaatgaaggaaatattgacaaggcaaggaaagctgaaaaggaataaaaaaaggcaacaagcaatagcgcaagaacaataaa

SEQ ID NO: 73265 - DNA, 605 bp, Zea mays
  unsure at all n locations
  Clone ID: LIB3078-009-Q1-K1-D9.F1
aacacacatgactgatgtttactacactatataatggtgcgcagatatcatatacctgaataaaacaacacaaatggcaggcaatatgctacatgtatagatggtacaatttcgcgcaccgctccggaggatcactcccgaattcccaatcaatcaggttgtccttcctctgcttgagctctcgctcgccctgagatcggcttcgatcttcctgtccacgttcttgcagaacccaggatacggctcatagcgnaacagtttgttcagtatctgcaggaagatgaggaacggctccatcaagaacacctcaggaagatcactaacactcggccccttcttctcgaagagccgtggccgnggaactgccaggtccagcagaagagctgcgtgacgaggacaagcttccaggagagagcgaccngaggcgggccgcgagggcgcgcatggcggcccatgcggcgaggaagagcagccccgcgactgcgccggctctgcggtcgacagcgaggtaggcggcggcgtatgcgagcgcgagggccagcgcgggggagacgggcagcggcagggccaggaagtggaggatcaagaggttgcggaccgtgggt

SEQ ID NO: 73266 - DNA, 581 bp, Zea mays
  unsure at all n locations
  Clone ID: LIB3078-009-Q1-K1-D9.F2
aacacacantgactgatgtttactacactatataatggtgcgcagatatcatatacctgaataaaacaacacaaatggcaggcaatatgctacatgtatagatggtacaatttcgcgcaccgctccggaggatcactcccgaattcccaatcaatcaggttgtccttcctctgcttgagctctcgctcgccctgagatcggcttcgatcttcctgtccacgttcttgcagaacccaggatacggctcatagccgaacagtttgttcagtatctgcaggaagatgaggaacggctccatcaagaacacctcaggaagatcactaacactcggccccttcttctcgaagaggccgtggccgaggaactgccaggtccagcagaagagctgcgtgacgaggacaagcttccaggagagagcgaagccgaggcgggccgcgagggcgcggctggcggcccatgcggcgaggaagagcagccccgcgactgcgccggctctgcggtcgacagcgaggtaggcggcggcgtatgccagcgcgagggccagcgcgggggagacgggcagcggcagcggcaggaagtgg

SEQ ID NO: 73267 - DNA, 393 bp, Zea mays
  unsure at all n locations
  Clone ID: LIB3078-009-Q1-K1-D9.R1
cccacggtccgcccacgcgtccgccacgcgtccggacccacgcgtccgcccacggtccgcggagacgnatcccaggcacnctgcttggatcctccacttcctgccgctgccgctgcccgtctcccccgcgctggccctcgcgctcgcatacgccgccgcctacctcgctgtcgaccgcagagccggcgcagtcgcgagggctgctcttcctcgccgcatgggccgccagccgcgccctcgcgccacgcctcggcttcgctctctcctggaagcttgtcctcgtcacgcagctcttctgctggacctggcagttcctcggccacggcctctgtcgagaagaaggggccgagtgttaatgatcttcctgaggtgttcttgatggaaccgttcctc

SEQ ID NO: 73268 - DNA, 81 bp, Zea mays
  Clone ID: LIB3078-009-Q1-K1-D9.R2
cccacgcgtccgcccacgcgtccgcccacgcgtcctgacccacgcgtccgcccacgcgtccgcggacgcgtgggcggacgc

SEQ ID NO: 73269 - DNA, 271 bp, Zea mays
  Clone ID: LIB3078-009-Q1-K1-G12
ggccgccccttgttgaccccaatattgagagggagctcaagaaggtagttaagaagactgcggcaacctttgcaccaagggcgtccacgaaaacaaagaaccctgctgtccctggaagtaccctgtacaccgtctttgaagtccagggctatgtttccatgctgttgggcggagcactttccttcaatctcatattcccatcgaatgagccagacatctggaggttaatggggatgtggtccatttggatgttcagtaagtaagaattttg

SEQ ID NO: 73270 - DNA, 649 bp, Zea mays
  unsure at all n locations
  Clone ID: LIB3078-009-Q1-K1-H3.F1
aaagtagctctcagggtcataagccacacnattacccagtttccagtagtgtggtccaaacaacaaaatgcaaaaatagcacgtcttcgttctcagaagcaaggtcatggtataacgcgttcggagaaactcaggtttgcacctaaaatgggaaatctttcaacaggaacacacaacaggttcatactactgctcagagtgagcaaagttgcacgcactagagtaacacagatgtagaactgggtactgcaggtagatggaccaaacaacctagtatccacccttgagatcattgaccacatcatatgggatgggagttacggtctcaatggtggtgccctcgaccatgaagccgggcttgggacccaatggctgcctcttggtgctgataacctcgccgcactttttggcatccgccttcagctggtcattcttcgccttcctcaggcggaactcttctgtgcagcgggacggctgcacatgctccacacggacatggatacgcttcctgatgatgcgcccattgacctgcttgttagactcgacgccgatggcgcgcttggtgacgttccagacgcgaccggtgcggccgtggtagaacttgtgcggcatcccttgtggacggcgccgtcacttgacatcgacgtaa

SEQ ID NO: 73271 - DNA, 502 bp, Zea mays
  Clone ID: LIB3078-009-Q1-K1-H3.F2
aaagtagctctcagggtcataagccacacattcccagtttccagtgtgtggtccaaacaacaaaatgcaaaaatagcacgtcttcgttctcagaagcaaggtcatggtataacgcgttcggagaaactcaggtttgcacctaaaatgggaaatctttcaacagggacccacaacagggtcatactactggtcaaaatgagcaaagttgcacgcactagagtaacacagatgtagaactgggtactgcaggtagatggaccaaacaacctagtatccacccttgagatcattgaccacatcatatgggatgggagtttacggtctcaatgggtggtgccctcgaccatgaagccgggcttgggacccaatggctgcttcttggtgctgataacctcgccgcactttttggcatccgccttcagctggtcattcttcgccttcctcaggcggaactctttctgtgcagcgggacggctgcacatgctccacacggacatggata

SEQ ID NO: 73272 - DNA, 598 bp, Zea mays
  Clone ID: LIB3078-009-Q1-K1-H3.R1
cccacgcgtccgggcctgcgctcgcggacggcgacctcttcgcggccccttccgcaagaagggctacatcccgctcaccacctacctccgcacctacaagatcggcgattacgtcgatgtcaaggtgaacggcgccgtccacaaggggatgccgcccaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgcaaaaagtgcggcgaggttatcagcaccaagaggcaccatttgggtccaagcccgggttcatggtcgagggcaccccattgagaccgtaactcccatcccctatgatttggtcaatgatctcaggggttgatactaggttgtttggtccatctacctgcagttaccagttctacatctgtgttactctagtgcgtgcaattttgctcactcttgacataatatgaacctgtttttgtttcctgtttga

SEQ ID NO: 73273 - DNA, 585 bp, Zea mays
  unsure at all n locations
  Clone ID: LIB3078-009-Q1-K1-H3.R2
cccacgcgtccgggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagtgcggcgaggttatcagcaccaagaggcagccattgggtcccaagcccggcttcatggtcgagggcaccaccattgagaccgtaactcccatcccatatgatgtggtcaatgatctcaagggtggatactaagttgtntggtccatctacctgcagnacccagntctacatctgtgttactctagtgcgtgcaactntgctcactctgagcagtagtatgaacct

SEQ ID NO: 73274 - DNA, 401 bp, Zea mays
  Clone ID: LIB3078-009-Q1-K1-H7.F1
tatttttttttttttttttttttttttttttttttttttttttttttttttttattaacttagaataaagcctgacgggggtaacagcatccatcgatccgcagtccatgctgtttgatgcatgggtctgctgaaaccgaggatgaacacagcactaacaactgacacagagcgaccttgcaatcaaaaacacagatgggcaacaacaaacacgacacgaacgaagataaaccctctggactagggtaaacatcacggtagcgaacaggataacttggccgcgcgggccccaccgctcagttcctccagttcccgtcggagttgccgtagccgccgccacggttgccaccgccgtagccgccgccaccaccaccgtagccgccgccgccaccgtagccgcc

SEQ ID NO: 73275 - DNA, 348 bp, Zea mays
  Clone ID: LIB3078-009-Q1-K1-H7.F2
attaacttaaaataaagcctgacgggggtaacagcatccattgatccccagtccatgctgtttgatgcatgggtctgctgaaaccgaggatgaacacagcactaacaactgacacagagcgaccttgcaatcaaaaacacagatgggcaacaacaaacacgacacgaacgaagataaaccctttggactagggtaaacatcacggtagcgaacaggataacttggccgcgcgggccccaccgctcagttcctccagttcccgtcggagttgccgtagccgccgccacggttgccaccgccgtagccgccgccaccaccaccgtagccgccgccgccaccgtagccgcc

SEQ ID NO: 73276 - DNA, 349 bp, Zea mays
  Clone ID: LIB3078-009-Q1-K1-H7.R1
ggcggctacagtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgttgaccctagtccagagggtttatcttcgttcgtgtcgtgtttgttgttgccatctgtgtttttgattgcaaggtcgctctgtgtcagttgttagtgctgtgttcatcctcggtttcaacagacccatgcatcaaacagcatggactgcggatcgatggatgctgttacccccgtcaggcttttattctaagttaatg

SEQ ID NO: 73277 - DNA, 401 bp, Zea mays
  unsure at all n locations
  Clone ID: LIB3078-009-Q1-K1-H7.R2
ggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaataaaaaaaaanaaanaaaaaaaaanaaaaaaaaaaaaaaaaaaaaaaaaaaana

SEQ ID NO: 73278 - DNA, 253 bp, Zea mays
  Clone ID: LIB3078-011-Q1-K1-E8
gcgcacacgcgtgagctcacgcaatgccatgttcgatgactactgcgcgaagtgcagacgttaacatcctatttataatcggtggtgctacactgcgttacattacgtgcatgctcgcccgtatcgaacctttactgtatatggtgcccagttcgatgaatgtaatgcatgatgctacttttgagcttcaatgtaaaatctatgccgtccggccccaacgcactcaggtttaatttgatgcaaaaaataagaa

SEQ ID NO: 73279 - DNA, 451 bp, Zea mays
  Clone ID: LIB3078-011-Q1-K1-F3.F1
tttttctttttttttaacaaagaacatctgtcaaatatccttaatgcacaacaatctttttggcaagaaatactgaaataggaactcattaccatgaatccagagtgataaagaaaacaatactcacccctgatcaagcagacagttttacacataaagaaaacagtacacacaccaatctaccacataacacggcagttttacaccttgcgtatcagtagaaagagtatctgatcaagcttgaagcgagcagcagtggaagggtcatccctaagcagctacaggagcccgcagaatgatgcataaatctcccttgaaatgcgtactgttcacatgtttgaaaggagtcagatcaactaagcttgaatatttgggtattcatataaccaatccttacagcatacaaagcattcaagtggtttctgggtgtcattgtgcttcgattatcatc

SEQ ID NO: 73280 - DNA, 518 bp, Zea mays
  Clone ID: LIB3078-011-Q1-K1-F3.F2
aacaaagaacatctgtcaaatatccttaatgcacaacaatctttttggcaagaaatactgaaataggaactcattaccatgaatccagagtgataaagaaaacaatactcacccctgatcaagcagacagttttacacataaagaaaacagtacacacaccaatctaccacataacacggcagttttacaccttgcgtatcagtagaaagagtatctgatcaagcttgaagcgagcagcagtggaagggtcatccctaagcagctacaggagcccgcagaatgatgcataaatctcccttgaatgccgtactgttcaacatgtttgaaggaagtcagatcaactaagcttgaatatttgggtattcatataaccaatccttacagcatacaaagcattcaagtgtttctggtgtcattgtgcttcgattatcatcaagaatacgaccaccagcgctgaacgcaaactccgaaggaacagtgctcaaaggtattgctaaaatatcacgcgccatagctg

SEQ ID NO: 73281 - DNA, 491 bp, Zea mays
  unsure at all n locations
  Clone ID: LIB3078-011-Q1-K1-F3.R1
ggagctatgcnattcaagatgatgaggcaagagctaagaaatgagctacaaagtcttaactctcggatttgcttgacaactaatcttgtggacctcaaatcagaagttgggttatctttgcttgacagcccactacattaatgcagactttatctgtgaaaaaaagattattgcgttcaaatatttgaaatatccacatacaggcctagcaatcaaagaaggaattacagagtgtctcaaagagtgggggataaaagagaagatgtttactatcacattagataatggttctaacaatctgtcagtgcgtgaccttcgagaaagtgggctatttggaggcgatcttcgtattgtccaatgttgtgcacaatattgattctcttaagtcaagattggatggcaattgctcaagggacattctataagattcctgaactggtcagacatatcaatttcctcacctcccggatacaagcctttaatggggattg

SEQ ID NO: 73282 - DNA, 633 bp, Zea mays
  unsure at all n locations
  Clone ID: LIB3078-011-Q1-K1-F3.R2
cggacgcgtggcagattcaagatgatgaggcaagagctaagaaatgagctacaaagtcttaactctcggatttgcttgacaactaatctttggacctcaaatcagaagttgggttatctttgcttgacagcccactacattaatgcagactttatcttgaaaaaaaagattattgcgttcaaatatttgaaatatccacatacaggcctagcaatcaaagaaggaattacagagtgtctcaaagagtgggggataaaagagaagatgtttactatcacattagataatgtttctaacaatctgtcagtgcgtgaccttcgagaaagtgggctatttggaggcgatcttcgtattgtccaatgttgtgcacacatattgattctcttagttcaagatggaatggcaattgctcatggagcaatctataagattcgngagctggtcagacatatcaattcctcaccctcccgcatacaagcttttaatgggattgctgagaggtctgnattgccttcaaaggatagantaattcttgacgntccaaaccgttggnattcgacacacgacatgattatggangccattgagtacaaggttgtcttgaaaagatatgctgaagaacaacttgagcct

SEQ ID NO: 73283 - DNA, 321 bp, Zea mays
  Clone ID: LIB3078-011-Q1-K1-H3
cttggttctcaataaggcaggcaggaatgcatctgccagtggaacagagcaacctgcacattatttatgtatgcctgttcattggagggcttgttcattacatgttcgtctatactagaaaaaacagaatattagcattaatctatagttaattaaagtatgtaaatgcgcctgttttttgttgtgtactgtaatcatctgagttggttttgtgaaattttcgtagaaagaatgaatgtgagatacagaaaatgtaatgccgtggtatatgcgtatggaacgatgtagtatcttttatggttcaaaaaaaaaaacggacaa

SEQ ID NO: 73284 - DNA, 475 bp, Zea mays
  Clone ID: LIB3078-012-Q1-K1-A11.F2
gttcaaccaacaggtacattctccatttcagagcaactttatgattcacaacacaagttaaatccagaatcaaaacaactcgtctaaaaacaactctgcgaacataaatctctttacagcaggcataatattacagtactattggaaaagcttataaagcttgttttgagcggcggagtggactgtcactacccactgaggaaaggcagcacggtcagcatgaaggcctcgtaggtgaaagtcgccgacccagagtaggcggcgtgcttctccttgaacttctgtgtcagccccttaacagtgaggcaggattcaatgaagctgtcatattcgattgctttgctcttgcccccagtcttgtcaaatttagacacacgcagatcaaggacagttggagacacagaatatccgagactgacaagagcatcccgcagttctgacatgtttatcctgccacttggatcacgatcaaacc

SEQ ID NO: 73285 - DNA, 291 bp, Zea mays
  Clone ID: LIB3078-012-Q1-K1-A11.R2
cggacgcttgggcggacgcgtgggcggacgcgtgggcggacgcgtgggcggacgcgtgggcggacgcgtgggttgagaggtttgatcgtgatcgaagtggccggatcgacatgtcacaactgcgcgatgctcttctcagtctcgcatattctgtgtctccaactgtccttgatctgcttgtgtctaaatttgacaggactgcgggcaagagcaaagcaatcgaatatgacatcttcattgaatgctgcctcactgctaacgggctgacagagaagttcaagcagaaggaca

SEQ ID NO: 73286 - DNA, 454 bp, Zea mays
  unsure at all n locations
  Clone ID: LIB3078-012-Q1-K1-E4
gcgagcgccacgccgtccgtnngatggcatgtaaaatgggactcgttaatagttgtctgnaattttggtgtatgcacgtgttaacagcgcgagatctggagttatgggactgcgagaagnactggtgacttatccgttggaatgggcgcccagaaggtgcatttgagcanctaaacccttatgatcactaagggcttgatgtgttttaaagttttggaaattttcgatgtcgggaaacttnactcacagggaacgaattccttaatgagtaccctgacttccacttacaaagccgctgttcggtgtgagtgcagaaaggggattacggcctacnaattccaagagcataactttcacgcaaagcttnnntccgaagcttcttcaagaaaatgcttggcaagcaaggactcctatcccaaaagaccaagacnnttctncnngaaatattagaaac

SEQ ID NO: 73287 - DNA, 442 bp, Zea mays
  unsure at all n locations
  Clone ID: LIB3078-012-Q1-K1-F1.F1
gaattctccaggatttactaattcagcagattaaaacatcgggcaaaaccaaaatgccaggaactgcatgtccagcttccatgatatgcactcaaagtgtcaagcgatctcactagcattagctaacagtatagccctatttcggcctgcagataataggatctttgcactagaggacatcagtttccttcgtacttcgggtctgccatcacgaagtgtacgcaataaccaagacaaagatgaagatgcccaggaaattggcaaagaagcccaggtcttgatcgtcaaacatcttgcccgccgcgccgccttgcctctccttcgcctcgcctactgtgtgtcgcagtgtggtttggtgtggcttgaagacccgacaagacgaccccacgcgtccgtccacgcgtccgcccacgcgtccgcggaggttnccganacccgggga

SEQ ID NO: 73288 - DNA, 419 bp, Zea mays
  Clone ID: LIB3078-012-Q1-K1-F1.F2
gaattctccaggatttactaattcagcagattaaaacatgggcaaaaccaaaatgccaggaactgcatgtccagcttccatgatatgcactcaaagtgtcaagcgatctcactagcattagctaacagtatagccctatttcggcctgcagataataggatctttgcactagaggacatcagtttccttcgtacttcgggtctgccatcacgaagtggtacgcaataaccaagacaaagatgaagatgcccaggaaattggcaaagaagcccaggtcttgatcgtcaaacatcttgcccgccgcgccgccttgcctctccttcgcctcgcctactgtgtgtcgcagtgtggtttggtgtggcttgaagacccgacaagacgaccccacgcgtccgcccacgcgtccgcccacgcgtccg

SEQ ID NO: 73289 - DNA, 413 bp, Zea mays
  Clone ID: LIB3078-012-Q1-K1-F1.R1
ggactgtgaacggtggtcggacggtggggtcgtcttgtcgggtcttcaagccacaccaaaccacactgcgacacacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaattagggctatactgttagctaatgctagtgagatcgcttgacactttgagtgcatatcatggaagctggacatgcagtccctggcattttgggttttgccatgttttaatctgctgaattaggaaatcctgcagaatgtc

SEQ ID NO: 73290 - DNA, 419 bp, Zea mays
  Clone ID: LIB3078-012-Q1-K1-F1.R2
cggacgcgtgggcggacgcgtgggcggacgcgtggggtcgtcttgtcgggtcttcaagccacaccaaaccacactgcgacacacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttttgcccatgttttaatctgctgaattagtaaatcctggagaattc

SEQ ID NO: 73291 - DNA, 423 bp, Zea mays
  Clone ID: LIB3078-012-Q1-K1-H10
ggccctaattgagaaaaagttgctttctctccgtccaggtgttcaaaggttaatcggggaagctttaggaaaggcagttaaagttgcagtgtgcagtacatcaaatgagaaagctgtttcagcgatagtgtcgtacttattggggcctgatagagctgataagattaccatatttgctggagatgtggttcctcacaaaaaacctgacccagcaatctacatattagcagcaactacacttggagttgatccacaaagctgtgttgttattgaagacagtactatagggctcgcagcggcaaaagctgccggcatgaagtgtatcgtaacaaaaagcagctacactgcagaagaggacttcgagacagcagatgcagtgttcgattgcattggtgacccgccagaagtgcgcttcgatttgga

SEQ ID NO: 73292 - DNA, 478 bp, Zea mays
  Clone ID: LIB3078-012-Q1-K1-H6.F1
gaacactgaaatgccaaccatttttacccttaaactagcaaaagagatacaaacaacatccaacagacaaacatctgccaccatccgagtttctgaactgaagtgcgttgcaggtgagctgagcctataaagatcgccgagttaaccataaaactcaagctgaactgggcctatagatagacaactgagttaacgataattacacctgcacagcaacatcccccaaaaacaagggatcaccattcctgctcaccacatacaccaaaactcccgtgccacggtgccagtaggctcagctgccgctgctcctgctcccactcccagacttcccatcgccccactggccttggcggcccagatgccctttcatcttgaggtctctcgccacctgctggagctgcagcgagtgcagttgctgctgctgaaggtggggattggagctggagctgctgaagctggtgcgtcgcagcacggattg

SEQ ID NO: 73293 - DNA, 603 bp, Zea mays
  Clone ID: LIB3078-012-Q1-K1-H6.F2
gaaacactgaaatgccaaccatttttacccttaaactagcaaaagagatacaaacaacatccaacagacaaacatctgccaccatccgagtttctgaactgaagtgcgttgcaggtgagctgagcctataaagatcgccgagttaaccataaaactcaagctgaactgggcctatagatagacaactgagttaacgataattacacctgcacagcaacatcccccaaaacaagggatcaccattcctgctcaccacatacaccaaaactcccgtgccacggtgccagtaggctcagctgccgctgctcctgctcccactcccagacttcccatcgccccactggccttggccgcccagatgccctttcatcttgaggtctctcgccacctgctggagctgcagcgagtgcagttgctgctgctgaggctgggagtggagctggagctgctgcagctggtgcgtcgccagcacggattgcatcgcttggctgctgtggaacatctgctggttgcctccgaccaggcgtggcatggccccaaagttcagcatcatccctccaccaccattgcccacctgtcctgttgccaccttcagccgctgga

SEQ ID NO: 73294 - DNA, 587 bp, Zea mays
  Clone ID: LIB3078-012-Q1-K1-H6.R1
ggaagatgcaatatattggcgaactcgagctcaaggtgcaaacctgcaaacagaagccacaacattgtcagctcagctagcattgctgcagagagacaccactgggctaacaaccgagaatagtgagctgaagattcgcctgcagaccatggaacaacaagtccacttacaagatgctttgaatgacaccctgaaaacagaggtccagcggctgaaggtggcaacaggacaggtgggcaatggtggtggagggatgatgctgaactttggggccatgccacgcctggtcggaggcaaccagcagatgttccacagcagccaagcgatgcaatccgtgctggcgacgcaccagctgcagcagctccagctccactcccagcctcagcagcagcaacttgactcgctgcagctccagcaggtggcgagagacctcaagatgaaagggcatctgggcggccaaggccagtggggcgatgggaagtcttgggatgggagcaggagcagcggacttagccttactggcaccgtggcacgggagttttggtgtattttgttaacaggaatggtgatccctgtttttgggggat

SEQ ID NO: 73295 - DNA, 617 bp, Zea mays
  unsure at all n locations
  Clone ID: LIB3078-012-Q1-K1-H6.R2
ggaagatgcaatatattggcgaactcgagctcaaggtgcaaaccctgcaaacagaagccacaacattgtcagctcagctagcattgctgcagagagacaccactgggctaacaaccgagaatagtgagctgaagattcgcctgcagaccatggaacaacaagtccacttacaagatgctttgaatgacaccctgaaaacagaggtccagcggctgaaggtggcaacaggacaggtgggcaatggtggtggagggatgatgctgaactttggggccatgccacgcctggtcggaggcaaccagcagatgttccacagcagccaagcgatgcaatccgtgctggcgacgcaccagctgnagcagctccagctccactcccagcctcagcagcagcaactgcactcgctgcagctccagcaggtggcgagagacctcaagatgaaagggcatctgggcggccaaggccagtggggcgatgggaagtctggaagtgngagcagnagcagcggcagctgagcctactggcaccgtggcacgggagttttgntgtatgtggtgagcaggaatggtnatcccttgtttgggggatgttgctgtgcangtgtattatcgttactc

SEQ ID NO: 73296 - DNA, 460 bp, Zea mays
  Clone ID: LIB3078-013-H9-F1A
acgaggcgtgtatcactaccagctaacaacaatacactccctaagggtagtatcgcaagccttctagggtctccaacgactgacactccctatccatccgcctggactaagtagtcctagtgttaggtaagcgggccctagcgttataaagcagtgctattccatctacatccacaggaataggtagaggaggtgcgggcatcaactcagggcttgggtcaatctcgataggcagcatcttcagaggattaacattagcctcagaatcttcaacctttgcacatgccgagtcaagcagctattcataacgtgcaagacactcagatggtgttcgacctagaatacggggaatcgtcctacagtgagtaagcatgactttatcaaaatgaagtaacttcacagcatcctcgcatgcccactcggtcgacttgacggacagatcgagtcactcataccagcg

SEQ ID NO: 73297 - DNA, 567 bp, Zea mays
  Clone ID: LIB3078-013-H9-F1B
actaatctgaagttgcatgtgttcaaaaactggaaattggcaaaggattacatccagtttgtagcagggtaacaaacacaaacactcaacattcacccccctggaaaaagaagtctaattcttggggatgttcttgccgacgatcttggccggcgttatgcgaacgaggttcccgggcttacctagcacgggacccttgatcatgagcacccggaggttgttgtcgatcttgacgatcttgagcttcctgatattggtcttggttcctcccatcctcccgggcatcttcttccccttgtacacgcggcccggcgtcgtcccggctccgatggaacccagctgccggtggctcttggaaccgtgcgtcatcagcccgcgattaaagttgtgcctcttcatagcaccttggaacccctagccgatggacttgccggagacgtcgatgaggtcgtcctccttgaagatgacggcgaagtcgaagggctggacgggcacgaaggcgtcgacggcggtgaggcggaactcctacaggtagcgcacggcgtggcgccggccttatccatgtgg

SEQ ID NO: 73298 - DNA, 470 bp, Zea mays
  Clone ID: LIB3078-013-H9-F2A
acgtggcgggagtcaataccagctgacaacaagactatgctttggggtggcgaagcaagccgagtagcttgtccaagacggacactcatcgcctaccgttgggcacaaagacccctagaggtagatgacggggccctagcctaacaaagcaggtctttgtcagactgaagccatatgaacaggatcaggacgcgcggtctttgactaaaggcatgggtcaatgtcgccaggccctatcttgctaggatcatgattagcctaagaatgttcacactttgcacatacggtgataagcaggtactcataacgttcaagacactgagatggtgttcgacctacaataggtgcaattgttgcacactgacgtcgcatgagcctaacaagagtgaagaatctctaatactgctccgtacgccacgccgtcttattgatcgacgaatcgagccagtcataccaactggcctagcact

SEQ ID NO: 73299 - DNA, 316 bp, Zea mays
  Clone ID: LIB3078-013-H9-R2A
gtcgcgtgtaagaacacggaggacgagatcctcatggcggacgcaatgaagtacgggatgaaccattgggcgcgcatgtcgtcgctgctactccgcaagtactgcaagcactgcaaggccccctggtattagtggctcgatccgttcatcaagaataccgagtggacaaggcaggaggatgagaaattacttcatatcgctaaactcatgcctactcagtggaggacaatagcacctattgtaggtcgaacaccatcatagtgtcttgaacgacatgaaaagctgtttgacccctcatgtgcaaaggatgaaaatt

SEQ ID NO: 73300 - DNA, 261 bp, Zea mays
  Clone ID: LIB3078-014-Q1-K1-C5
gcgccacggacgggcggcagcggctgcagccgccgcttccggagggctacttcggcaacgtgatcttcacggcgacgccgctggccaacgccggcacggtgacggccggggtggcagagggcgcgtccgtgatccaggccgcgttggaccggatggacgacgggtactgccggtcagcgctggactacctggagctgcagccggacctgtcggcgctggtccgcggggcgcacacgttccggtgccccaacctggggctca

SEQ ID NO: 73301 - DNA, 371 bp, Zea mays
  unsure at all n locations
  Clone ID: LIB3078-014-Q1-K1-D9
ggcgtgtgtgagggacgagctgctgcggcaggagctgctcaaggagattgagcagatgggtgtgggcctcagggagctggaggaagcgagcaaggatgagcagctcacagagtgatcacgcgggcgaatgggctactcatcagctctatatctgaacttcgttagcaaataagttcagacttctctttactggcatgctcaagtctgtatatggccaaaaccgaaatacgattgatcaactgcgctactgcagtgcaatagcaggatacgtatagttgtcttttcaagggaaacacgaagggagtgcagtgcacccccggccatactgcatgttattaataaaagagagttatttacagaanagaagaaca

SEQ ID NO: 73302 - DNA, 176 bp, Zea mays
  Clone ID: LIB3078-014-Q1-K1-E1.F2
gcagagcgtcttaattattttttttgttggaaaaaaaaggcaacacagttttttttaaggtattattaattgatatggatctgaggcagcacacggggacacacctagcgtactttatgacaaaaaacagggccgaagctggttatgaaaactagtggctcttacatggtatgtta

SEQ ID NO: 73303 - DNA, 274 bp, Zea mays
  unsure at all n locations
  Clone ID: LIB3078-014-Q1-K1-E1.R2
cccacgcgtccgtttatggaggcataaatgggcggtgcatacaattagacagattccgctggcacaagtgttcgctgttaagctatacattgaactagctcaggctcagcgtatagagctctagacctgagggtaatggacaggagaacaagagtggggtaaatgcactagcagagagtcaggatctgtagatggaggcgagagatactccggtgtactccgtgcatggntctaaaaaatcgggcagaaactggatcgtccacaccgttcatat

SEQ ID NO: 73304 - DNA, 306 bp, Zea mays
  Clone ID: LIB3078-014-Q1-K1-E10.F1
atgaactggacatggcgaagtactttattcatatttttgcacgacaatggcactgcaaatgcagttgctccttgctcagctaggtaatgcagttgatgaactcgacggctgtggctaccgcgccggcgttgatggcgtccttgacgaccttgcctctgtcgctgttgctggcgccggagatcagggcgccggacaaggcgcccgaatcatcgcgttcttccagtcactgcggccacggaccctttccacgccgtataccatggcgacatatactcgagcaacagtgccccaatatgcgccctcctt

SEQ ID NO: 73305 - DNA, 567 bp, Zea mays
  Clone ID: LIB3078-014-Q1-K1-E10.F2
atgaactggacatggcgaagtactttattcatatttttgcacgacaatggcactgcaaatgcagttgctccttgctcagctaggtaatgcagttgatgaactcgacggctgtggctaccgcgccggcggtgatggcgtccttgacgaccttgcctctgtcgctgttgctggcgccggagatcagggcgccggacaaggcgcccccgatcatcgcgttcttccagtcactgcggccacggaccctttccacgccgtacaccatgcccacataaactccagcaacagtgccccaatatgcgccctccttgcacatcttcctcagggcatgctcaaccttgtgcttcgaaacatcccccctgtggaggcactcgaaggtctcctcggcagccaccttgcaggcgccgacggcgccgatcttgaggaagccgtcgacggtgcggttgaggaaggggtttcccatgtcgatgacgacgtcgatcttgggcgacctgaaggaccccgagaagccgctgcggggcatcctcgacctactttcctggcagtggcaggtcagctgtgtctgtgtga

SEQ ID NO: 73306 - DNA, 462 bp, Zea mays
  unsure at all n locations
  Clone ID: LIB3078-014-Q1-K1-E10.R2
cggacgcgtgggcgcccaatctccacttctttatcttctccgaggtgagagagcccaggcgatccaattccaccctcgttctcaggcactgtcacacagacacagctgacctgccactgccaggaaagtaggtcgaggatgccccgcagcggcttctcggggtccttcaggtcgcccaagatcgacgtcgtcatcgacatgggaaaccccttcctcaaccgcaccgtcgacggcttcctcaagatcggcgccgtcggcgcctgcaaggtggctgccgaggagaccttcgagtgcctccacaggggggatgtttcgaagcacaagggtgagcatgccctgaggaagatgtgcaaggagggcgcatattggggcactggtgctggagtttatgtgggcatggtgtgcggcgtggaaagggtccgtggccgcagtgactggaanaacgcgatgatcgggggcgcc

SEQ ID NO: 73307 - DNA, 584 bp, Zea mays
  Clone ID: LIB3078-014-Q1-K1-E8.F1
gacataaggttgctctgtcagagagccacaaaaaaatttctgggttctgaactaatggtacaacacctgtaggttcaggtaccatttatttatcgaaacacttcccagagccagaggcaagcaaccgcatccttatgtttaaaaataaactagtatcagttaacccaaaataaatgaatttcaaagatctttgatgactctagttaaagcatggtgggcctaggatacaactaattctggggaaatttggctccaggttgtaatactatcccctagcctacttgccttgaattgtcttgcaaacagatcttcaccagattgacaggaactagtgagcatgtgcgtgtgtgtgcgtgtgtttgtatatttttcaccatgccattctgcaagaaatgaggatgtactgattccagtactacctgcttgcgtaacctagatctccttgcagactccctgttagattgtttccgccttctcctcttcaattcacgttcatccagttgagtaacgctatcacgtcgggcaagcgccaaccaggattcgctttcccctgcactggagaacagccaaggcaggagaagtat

SEQ ID NO: 73308 - DNA, 576 bp, Zea mays
  Clone ID: LIB3078-014-Q1-K1-E8.F2
gacataaggttgctctgtcagagagccacaaaaaaatttctgggttctgaactaatggtacaacacctgtaggttcaggtaccatttatttatcgaaacacttcccagagccagaggccaagcaaccgcatccttatgtttaaaaataaactagtatcagttaacccaaaataaatgaatttcaaagatctttgatgactctagttaaagcttggtgggcctaggatacaactaattctggggaaatttggctccaggttgtaatactatcccctagcctacttgccttgaattgtcttgcaaacagatcttcaccagattgacaggaactagtgagcatgtgcgtgtgtgtgcgtgtgtttgtatatttttcaccatgccattctgcaagaaatgaggatgtactgattccagtactacctgcttgcgtaacctagatctccttgcagactccctgttagattgtttccgcctctccctcttcaattcacgttcatccagttgagtaacgctatcacgtcgggcaagcgccaacccaggattcgcttccccctgcactgcaggaacagccaaggc

SEQ ID NO: 73309 - DNA, 163 bp, Zea mays
  Clone ID: LIB3078-014-Q1-K1-E8.R1
cccacgcgtctgctcacgcgtccggtaaaggcaaggggaagggctggtgcgcgtcgctggagaagggcagctctgcgggcgccctcaggtggaggatgactccaagagcagtgacagcggcacaatggagtcgtcagtgacgagagatgttgccactgaccat

SEQ ID NO: 73310 - DNA, 627 bp, Zea mays
  unsure at all n locations
  Clone ID: LIB3078-014-Q1-K1-E8.R2
cccacgcgtccgcccacgcgtccgggaaaggcaaggggaagggcgggggcgcgtcgcctgagaagggcagctctggggcgccctccggtgaggacgactccaggagcagtgacagcggcagcgatgagtcgtcagagacgagagatgatgacactgaccataagggttcatctgcgcccaagaaaaggaaatctggtaacacgtcggctgaaggtgaaccgtctcaagctgctgttgtgcgctatgctacggttgagtcgccatatcccgcaaagggaaggtctgcctcaaagcttccagtgtctgcacctggcagggcagcgcttcctagtgccaccccgaatctgaacattgggatggacatttggaatacttctcctgccttggctgttcctgcagtgcagggggaagcgaatcctgggttggcgcttgcccgacgtgatagcgttactcaactggatgaacgtgaattgaagagggagaggcggaaacaatctaacagggagtctgcaaggagatctaggttacgcaagcaggtagtactggaatcagtacatcctcatttcttgcagaatggcatggngaanaatatacaaacacacgcacacacacgcacatgctcactag

SEQ ID NO: 73311 - DNA, 391 bp, Zea mays
  Clone ID: LIB3078-014-Q1-K1-F12
ccccaactctatcaatacagctcagatggtcaagatacaggccaaaatttcctgaagcgaagaggtacacaaaagataccacacggtctcacttctgcatatcggtttacatgcttcggcactgacaaacgaatgtggtgcagtacatatgggaactagtagaagagacccgaagttggccatgcgcccaagttacaaccccagctccgagaggagattgcgccaccttggcgtctcctcgtcgaatatgtaggtcagctttgttaccaagactccactgccaccaattgatctcagttgttggatagatttgtaaagcaacttctgtggaacaaccacattaatggcatagtattccacatcaacttttccatcacgtctgcgatagaca

SEQ ID NO: 73312 - DNA, 310 bp, Zea mays
  Clone ID: LIB3078-015-Q1-K1-A3
gatcggatcaccttcttgcattgggtcctctgtctctcttcctactttacactcccggtatcgcatcatctcttttctactgcatgcaatggtctcttttgcttacaacaattctcctgctgatgtatccagcatggcatcatacatctacaattacgtacgtagtgcaacgactgccgattcgttgcgtgacgaacatatatgcgaatgcaagctgcgactaccatacatgcataatgagtgataaatatatatacaaaactgactaagcgccgaccatactctaataactggtccaaaacattataac

SEQ ID NO: 73313 - DNA, 148 bp, Zea mays
  Clone ID: LIB3078-015-Q1-K1-F12
cagactcagcagcctcgatcgcgccgccgtccggcaggtgcctgcaggtggtgactttgtaacgtgtgtgcgtgcgtacgtgtacattgcatccatcttggttccaatggacatatagctcctgttgctcctctaaaaaaaaaaataa

SEQ ID NO: 73314 - DNA, 245 bp, Zea mays
  Clone ID: LIB3078-015-Q1-K1-F7
cccacgcgtccggctagttaatgctaaagattttgccatcgtttattgtaacctttgatgcggattgtattgtctaaattttctttagtcttatagcttgttagattggatcatatgcattgaaaccaatatataagaattgctttaaaaaaaacaaagaaaaagctatacattcttattaatgaaatctacaaataccatcgatgatattaaaaaaagatacatgaaaaacagataacacaatc

SEQ ID NO: 73315 - DNA, 429 bp, Zea mays
  Clone ID: LIB3078-016-H3-F2A
ctccatcctcaggaattgattcaaactgatcaagccaaagccaccaagtgatacacttatataccattctaacatactagtagtggtacaaatacatgcttgtgcaccatcagcaagctgagatcagatcagctgaccagaagcaacaatgcagcagcagctgccatgtcagccaacaaaatcatgcaccaaatggccgccaatctccttgccgaaatgccggtcctggttcccgaaagagcccatcatgtaggggtcgctgacctcctccaacccaaaacggtgagcgaggttgggagggacggacgccgggagtggctcggctatgcagactctgttgttctggtggaggccgagggtgagggagaccccaccgttccccgcgccaccaatgccgttcatcggcccggcctgctggtggtgctgtga

SEQ ID NO: 73316 - DNA, 449 bp, Zea mays
  Clone ID: LIB3078-016-H3-R2A
aacacttcctgcacccatatcctactgatggagacaagcaaatgcttgctaaacaaacgggtttaacacggaaccaggtatccaactggtttataaatgcaagggttcgtctttggaaaccaatggtggaagagatccacaaccttgagatgaggcaggtgcacaaacaccctgttctcgacaagggccagcacgtgctgcatcaccaaacccagcattcgttcgagagcagtggaaagccttctgacccttccgactctcagcttggccaaagcagcagcatcacgaggaaccacaacatccctgcgtcccagggatttgccgatgagctctccgagatgtcccattctattcagcaggggcaggtaaccttcgcatacaatgggatgtcggcgccacaccacagcctcgcttcgtcacagcaccaccagcaggccgggccgatgagc

SEQ ID NO: 73317 - DNA, 172 bp, Zea mays
  Clone ID: LIB3078-016-Q1-K1-A1.F1
agataatgattggacattggtattacagaactgtgcattgttggcccagaattagtttggaaccaaaatatgcagtgaccttgctttaataattaattacacctggttatgatgtcgcggttatttcaatttattaatcaatctcatgttgtcaactatgcatgatctatcg

SEQ ID NO: 73318 - DNA, 571 bp, Zea mays
  Clone ID: LIB3078-016-Q1-K1-A1.F2
agataatgattggtcattggtattacagaactgtgcattgttggcccagaattagtttggaaccaaaatatgcagtgaccttgctttaataattaattacacctggttatgatgtcgcggttatttcaatttattaatcaatctcatgttgtcaacaatgcatgatctatcgtgacaaaccaagttcctgccaggggcagcagaaaaatggccacccctaaaacgtaagttacatcacaaaccatatcaaatatgtacaacgcctatataaaattcgaaaaagaaaagtagcaaactgaaacaatcagagctgctttctcctgaacctttggtgactcctccatgaccacgaaagcaagaaaatcacgagtgcagtcccgaccgagctccaaaagatgatcagccaggtaggcatcgggtcatgaaacagcccatgcccaaacttcatgcagataagcagctccactatgcatatagctagagagagccaacagaaggctccaaccttcttcaccggtttcctgtcttgcaggtaggagttgtactcgcggatggttgggatggcgatcag

SEQ ID NO: 73319 - DNA, 566 bp, Zea mays
  unsure at all n locations
  Clone ID: LIB3078-016-Q1-K1-A1.R2
gcagattgccgcttgagacattgtttgatgaatttgttgttgcccatatccttgggtggtggggcaaagctgtaatgatacgaaatcaacttctactttgggtcttgtcgattggctttgagctaatggagctaacgttcagacatatgctgccaaactttaatgagtgctggtgggatagcattatcttggacatattgatctgcaattggtttggtatttgggcaggaatgcacacagtccgtcactttgatggcaaaacttatgaatgggttggactgagccgccaacgaagtatcatgggtaaggtgaaaagatcgttgagccagttcactcctgctcaatgggacaaggatcagtggcatcctttcatggggccactgcggtttatccaagtgctgttcctctgcgttgtcttcatgaccgtggagcttaacacattcttccttaagttttgcctttggatccctccaaggaaccccttggtcgtgtacagattgatcctctggtggctgatcgccatnccaaccatccgggagtacaactnctacctgcaagacaggaaa

SEQ ID NO: 73320 - DNA, 56 bp, Zea mays
  Clone ID: LIB3078-016-Q1-K1-A11
aaaaaaaaaaaaaaaaaattaaaaaaaaaaaaaaaaaaaaaaaaaaaaaggaaaaa

SEQ ID NO: 73321 - DNA, 328 bp, Zea mays
  Clone ID: LIB3078-016-Q1-K1-B8
ggcgactagggcggcaagcaccagctcatcaccgccaccgtctccgacggggggctctgcgatctgcaaggcgcaggccggcgacaagcggaggttcaagggcgccaggaagggcgtcgagaaggccgacgccttcttcatcgtcgcgtgaccgacgtatactattgtttctttgatgcttttcatcagggatgcacatgcacgcaccgagtgtacgtagagagctaggcatggcctggctcgccatgcttgttgtgtgattctttgattgtacatgagaggacccgtttctgctgacatccaagttgtttgagaaaaacttacatac

SEQ ID NO: 73322 - DNA, 420 bp, Zea mays
  Clone ID: LIB3078-016-Q1-K1-H10.F1
ggaaaacatgcatatggagaaaagatagtacagtactacacataccaactagtcactcactactatatactaggagtgacggcacatatatcactcactccataacataggtcaaattaaacggcggagacaccagcagaacaagaacaacaatacacaaacacaagtatatatatagtgatgactagctataatagagcatgcgtgcgttttagataaccacaaggaccagcaaacatggcctcttcactgtccatccatctcgcccgatctagcggtggttgctcctggtctcgtcgctgtagagccagtcgtagagggtgggggagttgggctgcggccggtcgaagaggttggcgcccatgcccttggtggccaggttgctcccccgggtggaagacgctgcgccacacgttgccg

SEQ ID NO: 73323 - DNA, 572 bp, Zea mays
  Clone ID: LIB3078-016-Q1-K1-H10.F2
ggcaaaacatgcatatggagaaaagatagtacagtactacacataccaactagtcactcactactatatactaggagtgacggcacatatatcactcactccataacataggtcaaattaaacggcggagacaccagcagaacaagaacaacaatacacaaacacaagtatatatatagtgatgactagctataatagagcatgcgtgcgttttagataaccacaaggaccagcaaacatggcctcttcactgtccatccatctcgcccgatctagcggtggttgctcctggtctcgtcgctgtagagccagtcgtagacggtgggggagttgggctgcggccggtcgaagaggttggcgcccatgcccttggtggccaggttgctccccgggtggaagacgctgcgccacacgttgccggcgccgcgcggcgtcgtcgacgacgacgacgacgacggcgtcaccggcgtcgtcggggtcgacggcatcgactgcgcccgcttgtagctgccgccgtccgcgtctttgttgatgaccagcgggcgggcggtggtggccttgcggagcttctc

SEQ ID NO: 73324 - DNA, 567 bp, Zea mays
  unsure at all n locations
  Clone ID: LIB3078-016-Q1-K1-H10.R2
cccacgcgtccgcccacgcgtccgcccatgcgtccgcccacgcgtccgggttgctctagatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgatgccgtcgaccccgacgacgccggtgacgccgtcgtcgtcgtcgtcgtcgacgacgccgcgcggcgccggcaacgtgtggcgcagcgtcttccacccggggagcaacctggccaccaagggcatgggcgccaacctcttcgaccggccgnagcccaactcccccaccgtntacgactggctctacagcgacgagaccaggagcaaccaccgntagatcgggcgagatggatggacagtgaagaggccatgtttgctggtccttgtggntatctaaaacgcacggatgctctattatagctagtcatcactata

SEQ ID NO: 73325 - DNA, 548 bp, Zea mays
  Clone ID: LIB3078-016-Q1-K1-H3.F1
ctccatcctcaggaattgattcaaactgatcaagccaaagccaccaagtgatacacttatataccattctaacatactagtagtggtacaaatacatgcttgtgcaccatcagcaagctgagatcagatcagctgaccagaagcaacaatgcagcagcagctgccatgtcagccaacaaaatcatgcaccaaatggccgccaatctccttgccgaaatgccggtcctggttcccgaaagagcccatcatgtaggggtcgctgacctcctccaacccaaaacggtgagcgaggttgggagggacggacgccgggagtggctcggctatgcagactctgttgttctggtggaggccgagggtgagggagacgccaccgttccccgcgccaccaatgccgctcatcggcccggcctgctggtggtgctgtgacgaagcgaggctgtggtgtggcgccgacatcccattgtatgcgaagttacctgcccctgctgaatagaatgggacatctcggagactcatcggcaaatccctgggacgcaggatgttgt

SEQ ID NO: 73326 - DNA, 179 bp, Zea mays
  Clone ID: LIB3078-016-Q1-K1-H3.F2
ctccatcctcaggaattgattcaaactgatcaagccaaagccaccaagtgatacacttatataccattctaacatactagtaggggtacaaatacatgcttgtgcaccatcagcaagctgagatcagatcagctgaccagaagcaacaatgcagcagcagctgccatgtcagccaacaa

SEQ ID NO: 73327 - DNA, 119 bp, Zea mays
  unsure at all n locations
  Clone ID: LIB3078-016-Q1-K1-H3.R1
aacacttcctgcacccatatcctactgatggagacnagcaaatgcttgctaaacaaacgggtttaacacggaactaggtatccatctggtttataaatgctagggttcgtctttggaaa

SEQ ID NO: 73328 - DNA, 664 bp, Zea mays
  Clone ID: LIB3078-016-Q1-K1-H3.R2
aacacttcctgcacccatatcctactgatggagacaagcaaatgcttgctaaacaaacgggtttaacacggaaccaggtatccaactggtttataaatgcaagggttcgtctttggaaaccaatggtggaagagatccacaaccttgagatgaggcaggtgcacaaacaccctgttctcgacaagggccagcacgtgctgcatcaccaaacccagcattcgttcgagagcagtggaaagccttctgacccttccgactctcagcttggccaaagcagcagcatcacgaggaaccacaacatccctgcgtcccagggatttgccgatgagctctccgagatgtcccattctattcagcaggggcaggtaaccttcgcatacaatgggatgtcggcgccacaccacagcctcgcttcgtcacagcaccaccagcaggccgggccgatgagcggcattggtggcgcggggaacggtggcgtctccctcaccctcggcctccaccagaacaacagagtctgcatagccgagccactcccggcgtccgtccctcccaacctcgctcaccgttttgggttggaggaggtcagcgacccctacatgatgggctctttcgggaaccaggaccggcatttcggcaaggagattggcggccatttggtgcatga

SEQ ID NO: 73329 - DNA, 337 bp, Zea mays
  Clone ID: LIB3078-016-Q1-K1-H8
cggacgcgtgggtggtgaggttggtgccgccgctcatagtctcggagaaggagctggagcatgccgctgatgtcataagggactgtctaccggcgctcgatgtcgctgctgctgcctaatgtatatggtggtgcaatagtttcggatatgaaacctgattccaaattttggaatccaataatttcatgtcgtgccaatgctgttgcgttcattgaaacaaactctgtcttttttggaatcgaataattattacatgtcagaccgatgctagctgttccgagagcaaagtggctttattatacaaaatggtctgaagagcgataaggtgaccaaccga

SEQ ID NO: 73330 - DNA, 422 bp, Zea mays
  Clone ID: LIB3078-017-H5-F2A
atggtcaataaatagcatccatcaatgattacttgagaatttgaaacagatccaatatttcgggattgcatagtagcataacaaatacaattgatctgtattatccacgtccatgcaaccggtctaaattttggttgcaatttacctaccaaatcacaacacgacggctaactaaatgcatgtcagcatgagcctttctacagaaaatctaccttgctaattggaagtcactatcaaagtcagtcaagagacacaagaaatggatgtattgcctttcaatacatgagttttgactgctgaacgagtgtgatgtttccatatactctcccatctaccgtgcttcctcttcctcttcattgttctctatttgggatgctagcttcacaatatcttcaacaaggattttttccttctgtgtcttt

SEQ ID NO: 73331 - DNA, 356 bp, Zea mays
  Clone ID: LIB3078-017-H5-R3A
tgaagaggaagaggaagcacggtagatgggagagtatatggaaacatcacactcgttcagcagtcaaaactcatgtattgaaaggcaatacatccatttcttgtgtctcttgactgactttgatagtgacttccaattagcaaggtagattttctgtagaaaggctcatgctgacatgcatttagttagccgtcgtgttgtgatttggtaggtaaattgcaaccaaaatttagaccggttgcatggacgtggataatacagatcaattgtatttgttatgctactatgcaatcccgaaatattggatctgtttcaaattctcaagtaatcattgatggatgctatttattgaccat

SEQ ID NO: 73332 - DNA, 484 bp, Zea mays
  Clone ID: LIB3078-017-H7-F1A
cgccactaatctacgttatgttatattaaaagatccctactatagtcacgttccatgctgtctgtcatacaacaaaaagagtttttttttttcatccctagtgactagaccaaaataccaccacatcatcagagtagctacatcagttcggagctgtgattcttgacgtacctagcaacccacgtaactttgctagaaagctgaggcagcgcatagaatgccctcgcaagcggaggattctcgcacaggtaagcatagtagtgctcaagatgtgcctcctcgaaccctgggatgctcttcagctcttcgtacaaccccttcggaacaggaaggtcgggttgttcggaaagcctttttatagccgaagcaagctcgccgaggctccgactcattatcacaaccaagtcatcgtcagtgtataccctctgcttcttcgacggtggtggctgcttagtatctgaagactcttctgcgccattgttgc

SEQ ID NO: 73333 - DNA, 462 bp, Zea mays
  Clone ID: LIB3078-017-H7-R1A
ctggcaacagttcggcaaccgctgctgcatatgttcaaggatcaaatgagccacttggtgttgaagtgactgaaacagatagtgcaccagctgtgactgaaacaggcaatgcaccaactgtgactggaacagacaacaatgcaccgaaacccacgtgtagtgtgccaagtgaacaattcggtggtgacgacggaacgcactcatcaggcaacaatggcgcagaagagtcttcagatactaagcagccaccaccgtcgaagaagcagagggtatacactgacgatgacttggttgtgataatgagtcggagcctcggcgagcttgcttcggctataaaaaggctttccgaacaacccgaccttcctgttccgaagaggttgtacgaagagctgaagagcatcccagggttcgaggaggcacatcttgagcactactatgcttacctgtgcgagaatcctccgc

SEQ ID NO: 73334 - DNA, 431 bp, Zea mays
  unsure at all n locations
  Clone ID: LIB3078-017-Q1-K1-A2
nccacgcgtnncggcacgcgtcccgccacgcgtncgcagctacccaactgttagaatggacgacacggaagccgacaagagcacggacaccaacgggcccaatttcgactgccctctcttctctttctgcaacctcggcggtgctttcttcggctctggctttggcttcaaatccaacgctgctgtgccgcctggcatcgacgtccagctctgcgaggaatcacccggtccggcagctaggttgcagccagtcgtggtcgatgactccttgacgatctacacaggcagagtgagtacatctgacgagtttggtgtcaaagactctgatttggtccctggaaaatatgaacgtgggttgaaactgtgggaaggctcattagacttggtgaaagccctgaattctgatatcaacgaagagtaatttcatctgg

SEQ ID NO: 73335 - DNA, 433 bp, Zea mays
  Clone ID: LIB3078-017-Q1-K1-A2.F1
aacagaaaccagaggtaaaagcgattttttttagtctacaagagcaaagcagtgctccaaaagagaaagatcagctttttgaaacagtcacaggtagattaacagaaccaggaagtcctataagacctccctctcacccaatatggagtccagtacatgtttccagttctcccgacaatcgcaggggcagtgctaatctatttgaatgagaatttccaaacctccctaacattggatgatccatcagcaacatcattgagccgctcaggatgcatggcaccgtctttttcaaccaagcgcagaaactgccttgtgccaccacctactccaaagtaatgcttcttccctgccatgtaaaccacacccccagggtagcgcaagacttgctggatgagccggtagagatttgggaaacaagataccgcgtaaacag

SEQ ID NO: 73336 - DNA, 591 bp, Zea mays
  Clone ID: LIB3078-017-Q1-K1-A2.F2
aacagaaaccagaggtaaaagcgattttttttagtctacaagagcaaagcagtgctccaaaagagaaagatcagctttttgaaacagtcacaggtagattaacagaaccaggaagtcctataagacctccctctcacccaatatggagtccagtacatgtttccagttctcccgacaatcgcaggggcagtgctaatctatttgaatgagaatttccaaacctccctaacattggatgatccatcagcaacatcattgagccgctcaggatgcatggcaccgtctttttcaaccaagcgcagaaactgccttgtgccaccacctactccaaagtaatgcttcttccctgccatgtaaaccacacccccagggtagcgcaagcacttcttgatgagcctgtagagatttggaagacaagataccgcgtaaacagtctcagccatcaggatgatatcataaccattacacattttaccttctgtatcaccactggctgttttgtcttgctcagcatccccgcaaagtagtagcttatccatttcactccaatcaccagcaaagaaaccaacaatcggacatgtacatgttcct

SEQ ID NO: 73337 - DNA, 162 bp, Zea mays
  Clone ID: LIB3078-017-Q1-K1-A2.R1
ctcacgcgtccgctcaagcgtccgcccacgcgtccgcagctccccaactgttgagaatggacgacacggaagccgccaacaacacggccaccaccggccccacttgtgcctctcctctgcttctccttctccaacctcggcggtgcctccttcggctccggc

SEQ ID NO: 73338 - DNA, 521 bp, Zea mays
  unsure at all n locations
  Clone ID: LIB3078-017-Q1-K1-A2.R2
cccacgcgtncgcccacgcgtccgcccacgcgtgcgcagctccccaactgttagaatggacgacacggaagccgccaagaacacggccaccaccggccccactttcgcctcccctctcttctctttctccaacctcggcggtgcttccttcggctctggctttggcttcaaatccagcgctcctctgccgcctgccatcgaggtccagctctgcgaggaatcacccgttccggcagctaggttggagccagtcgtggtcgatgactccttgacgatctacaagggcagagtgagtacatctgacgtgtttggtgtcaaagactctgatttggtccctggaaaatatgaaggtgggttgaagctgtgggaaggttcattagacttggtgaaagccctgaattctgatatcaaagaagataaatttcatctggaaggcaaacgcgtattggagcttggatgtggacatggcctccctggcatttttgcgggtctcaagggtgctgacctgattcatttccaag

SEQ ID NO: 73339 - DNA, 181 bp, Zea mays
  unsure at all n locations
  Clone ID: LIB3078-017-Q1-K1-B2.F2
ctggggactttctgtaacaaagatgggtttataatatcctgagacaagtgtggtaattccgtaattgccactcatgacatcagatgggcacggacagaacgttccaaanatccctatctttatgcatagtgtgttgccactcaacaacacctaangaccccataacttgaatgacgattcc

SEQ ID NO: 73340 - DNA, 510 bp, Zea mays
  unsure at all n locations
  Clone ID: LIB3078-017-Q1-K1-B2.R2
cggacgcgtgggggggaagggagggtttgcaaggaaccttcaaccacatgagattgttgaacaggtgttggccatcgaggagacgttcaaacacagggtgacaaatgttgtgttcatggggatgggtgagcccatgatgaacctcaagtcagttctagaagcacaccaatgcttcaataaggaactaaaaattgggcaaaggatgatgacaatatctacagttggtgttccaaatacaataaaaatgctagcatctcacaagcttcagtcaacgctggcagtcagtctgcatgccccaaatcagaagctgngggagacgattgttcctagcgccaagtcttaccccttgggagcactaatggatgactgcaagagttacttccttgaaactgggcgcagggtatccttcgagtacactctgctagctgggattaacgatgaanaggagcatgccgaagagctagcagaactacttcgtatgtgtggaggtggttaccatgtgaacctgat

SEQ ID NO: 73341 - DNA, 397 bp, Zea mays
  unsure at all n locations
  Clone ID: LIB3078-017-Q1-K1-C8
caggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctctgacctcgacgaggacgaggagtccggtggcctctcgctctagatccaccctctcctgttaatgatctgaatgtaaacatggtggcggtcatcggtgtaaatttagacatggctatttgcatctaagatccatcctctcctgttaataatgtttggagactacgtacgcctgaagcaatgcaatagcaactttgcgagaaaaaaanaaaa

SEQ ID NO: 73342 - DNA, 444 bp, Zea mays
  unsure at all n locations
  Clone ID: LIB3078-017-Q1-K1-G2
cccacgcgtccgtgctcatgggcgccgtcgaggggtaccgcatcgccggtggcccggtcngggaggtggtcgacccgctggaccccggcggcagcttcgacccgctcgggctcgccgacgacccggaggcgttcgcggagctcaaggtcaaggagatcaagaacggccgcctcgccatgttctccatgttcggcttcttcgtgcaggccatcgtcaccggcaagggtcccgttgagaacctcgccgaccacctcgctgaccctgtcaacaacaacgcctgggcctacgctaccaacttcgtccccggcaagtgagcgagggcatatacatacttgtatgcgtgtaccggagacatacgtattcgtatatgtactgcangagatgtaccagtatttgtgaagaaaggagcaatggctcagagattgtaccagtagtgtacgtatt

SEQ ID NO: 73343 - DNA, 485 bp, Zea mays
  Clone ID: LIB3078-018-F10-F1A
gccatgagagatcttgtttaagagcaggaggtgtacaaaatccaatttcaataggctcaaacacactttaacacgttgcctaaacagggcagtgggtaagacataaaaaaaatacactaaactcttgtgttgaatcgtccgaagtcctcaatggaacctcaaatcaaaggaaaagcttagggcgattgaccaggcaacagcttcgagtgacaacgcctcactgcatctcgaagcgtttggcaatcagcacgctcatgtcgaggaacctctgggcgcagttggtcaggcaggtcgattccccggagctgaacttgctcccgggagcgctggtgatgcatttgtcccagcacgcgctcgttagcttgccgaccatctcgttcatcatcgccttctgctgctctttctgaatgaatcgctgcatctcggggttgtccatggagcctccctctgcttctctgtctccccctaaaaccctagctcggttt

SEQ ID NO: 73344 - DNA, 460 bp, Zea mays
  Clone ID: LIB3078-018-F10-R1A
cccacgcgtccgcccacgcgtccgcccacgcgtccgcccacgcgtccggcaatcaaaaaccgagctagggttttagggggagacagagaagcagagggaggctccatggacaaccccgagatgcagcgattcattcagaaagagcagcagaaggcgatgatgaacgagatggtcggcaagctaacgagcgcgtgctgggacaaatgcatcaccagcgctcccgggagcaagttcagctccggggaatcgacctgcctgaccaactgcgcccagaggttcctcgacatgagcgtgctgattgccaaacgcttcgagatgcagtgaggcgttgtcactcgaagctgttgcctggtcaatcgccctaagcttttcctttgatttgaggttccattgaggacttcggacgattcaacacaagagtttagtgtattttttttatgtcttacccactgccctgttt

SEQ ID NO: 73345 - DNA, 483 bp, Zea mays
  Clone ID: LIB3078-018-F12-F1A
agttatcaaaggtctcgtatgtattttctccgttttgagctaaatttcccctggttaggctcagaaataaccttgggattcagctaacaaaccagtttatatttgatacagacaagactacaagagtagccgctacttaataacataagctttacattacgagggtttaatttccgggcgggaagtcaccgtcgtcgctcgttgtacaggcagggcctagtcgtacacaggaaacagcaaccagcagctgagctgagctcaaggggagattgatctggggatgatgatgtcgccgatgttgttgtgccacgggtcggcgaggtgggaggcgaggttctccagcgggccggtgccggggtacgccgactgctggacgcagaagccgacgaaggccagcatggcgaggcggccgttcttgatctccttgagcttgtactcctcgaacttggcggggtccttggagaagccgagcgggtcgaaggc

SEQ ID NO: 73346 - DNA, 484 bp, Zea mays
  Clone ID: LIB3078-018-F12-R1A
agcagatccgagtagggcgagccagtcacccggcagaggcaggccacagtacctgagacgccccggtgccgtgaggcacgctgccgaccatcctggtgatcgaattcgtggccatcgccttcgccgagcaccagcgcaccatggagaaggaccccgagaagaagaagtaccccggcggcgccttcgacccgctcggcttctccaaggaccccgccaagttcgaggagtacaagctcaaggagatcaagaacggccgcctcgccatgctggccttcgtcggcttctgcgtccagcagtcggcgtaccccggcaccggcccgctggagaacctcgcctcccacctcgccgacccgtggcacaacaacatcggcgacatcatcatccccagatcaatctccccttgagctcagctcagctgctggttgctgtttcctgtgtacgactaggccctgcctgtacaacgagcgacgacggtgacttcccg

SEQ ID NO: 73347 - DNA, 392 bp, Zea mays
  Clone ID: LIB3078-018-G10-R1A
cagaactgtggaaatttccttacggaccgtccgtcgaccaaggtgcaagcagctccaggtggcgactcttcactcggttatctttttagtggcagcaaagatggcaagtgatgtacacctgctgttagtgttcgccatgatcatgggagaaggtttctgcttaacaaaggaaaaagggaaaagaatcttgtattcccatgagtaaatatcaaactgctcatggtatctatgttgttgggattgcttgtatgtgtgtacatgttcgtgtgtgtcgtgtgttgatccacagctactggtagcaagagcttctatccctgctgatggaattgtgcgcaatgccaatgttgacattatcgtgggtgatgctattatgttgtggtgtattattggat

SEQ ID NO: 73348 - DNA, 377 bp, Zea mays
  unsure at all n locations
  Clone ID: LIB3078-018-G4-R1A
gactcctatagggaagtggtacgctgaggcacggtcggaattccgggtcgctaatgtgtcagggacggtggtgcatacagngtcggcgtgctccgngcaccgcgtgggtctcgaacggtaccaccacgtgtgctctatggtagcaatgttgagcggcttgctgctggacaaggcanatttgcaaacagctgtttgaattacactgggctgtatttgcttgggaactctctatttgggtggaactgcattgcaccatggtctcctcatcncactcgtactgctattcgacaangctacaatcttgagggtagctttgaggctttcaccaggcaatgtgggtgatgcggcgatctggccgaggangaggagaggcgtga

SEQ ID NO: 73349 - DNA, 421 bp, Zea mays
  Clone ID: LIB3078-018-Q1-K1-H1
aagcaagcaagcagcgagtacatacatactaggcagccaggcagccatggcgcccaccggatgatggcctcggcggccagcggcgtcgctccgttccaggggctcaagtccaccgccagcctccccgtcgcccgccgctcctccagaagcctcggcaacgtcagcaacggcggaaggatccggtgcatgcaagtgtggccggcctacggcaacaagaagttcgagacgctgtcgtacctgccgccgctgtcgacggacgacctgctgaagcaggtggactacctgctgcgcaacggctggataccctgcctcgagttcagcaaggtccgcttcgtgtaccgcgagaactccacctccccgtgctactacgactgccgctactggaccatgtggaagctgcccatgttcggctgcaacgacg

SEQ ID NO: 73350 - DNA, 297 bp, Zea mays
  unsure at all n locations
  Clone ID: LIB3078-018-Q1-K1-H10.F1
aaccagcaggaaacaaaaaccaccactagttgcacaaacatgggttcatcttgagtgtacaacgccaactcatcatctcgacttgcctatgcaatgcaacgtgaaacaaaagacacacatgcatctcgcagcatcaatcaatccacgtacgtacaccctctccgatccgaaagacaatgaagttgcatagcatagccgttgagcttagttgccggggacgaattnggtggcgtaggccatgcgttgttgttgactgggtcagcgatgtggtcagcgaggttctcgcggacgcgtggg

SEQ ID NO: 73351 - DNA, 295 bp, Zea mays
  Clone ID: LIB3078-018-Q1-K1-H10.F2
aaccagcaggaaacaaaaaccaccactattgcacaaacatggttcatcttagtgtacaacgccaactcatcatctcgacttgcctatgcaatgcaacgtgaaacaaaagacacacatgcatctcgcagcatcaatcaatccacgtacgtacaccctctccgatccgaaagacaatgaagttgcatagcatagccgttgagcttagttgccggggacgaagttggtggcgtaggcccatgcgttgttgttgactgggtcagcgatgtggtcagcgaggttctcgcggacgcgtggg

SEQ ID NO: 73352 - DNA, 295 bp, Zea mays
  unsure at all n locations
  Clone ID: LIB3078-018-Q1-K1-H10.R2
cccacgcgtccgcgagaacctcgctgaccacatcgctgacccagtcaacaacaacgcatgggcctacgccaccaacttcgtncccggcaactaagctcaacggctatgctatgcaacttcattgtctttcggatcggagagggtgtacgtacgtggattgattgatgctgcgagatgcatgtgtgtcttttgtttcacgttgcattgcataagcaagtcgagatgatgagttggcgttgtacactaagatgaaccatgtttgtgcaatagtggtgggttttggttcctgctggtt

SEQ ID NO: 73353 - DNA, 396 bp, Zea mays
  Clone ID: LIB3078-018-Q1-K1-H11
gacggaatgaccgatccgctcaaagcgtggatgaatggacaggggagcagaaggttcaggacagtgacataccagatgacatcgagccagaagagattaggccgatgggaaactatgcagtttctataacttggcctgatggatttagtcagatagcaccttatgaccaattggaaatgctggagcggttggtggaggctccgagtccagcagcagcgtctgcagtggcctcgtcatgatacagcagaaagaatgttcagttagcaaggggcaagaaggccgacttttagctcccagaaaatttatagctctgctacaaattttgaaagaattttacagtactgtagaaccatgctcattgaattttaaaaaaaggcagcagctttcgttcctctt

SEQ ID NO: 73354 - DNA, 625 bp, Zea mays
  unsure at all n locations
  Clone ID: LIB3078-018-Q1-K1-H4.F1
ctacttgtaccaaagatngggtaaagcatattcaatcctcgtttcactcccgtggttccatttcaagtatatatacacacacacaaaaataacaaacaaacataatcaacagaagcgatgcggtatttgtttggcaactgcagcatccacaaaaacaaatctccatcgatgatgacgttttttccccccatcacagagaccactccgtgtttgcctctgatgacgttaaagcttcggtcgtggcgaaggacttcatcgtggtagagtctgcgttgcttggcctccggtcgaggtacgggtcacgatcacggctggcttggtgatcctgtccacggagattcccttctctcctatcagcatcaggacgacgctggccatgttcggacgcagcttcatcgcgtcttgggcgcatagtaggccaaccttcaagaaacggcatgcctcctcgacgttcaggtcctcccctgcttcggcgtctatgaccttctctagctttccctgcacgtatatgcccatgtcttctcaagcagaaactggtctccctgaggcaatctactgttgtagttacatctaccagcaacaatttccagtagcaaaacgccgaaactatagatatccgatttct

SEQ ID NO: 73355 - DNA, 558 bp, Zea mays
  Clone ID: LIB3078-018-Q1-K1-H4.F2
ctacttgtaccaaagatgggtaaagcatattcaatcctcgtttcactcccgtggttccatttcaagtatatatacacacacacaaaaataacaaacaaacataatcaacagaagcgatgcggtatttgtttggcaactgcagcatccacaaaaacaaatctccatcgatgatgacgttttttccccccatcacagagaccactccgtgtttgcctctgatgacgttaaagcttcggtcgtggcgaaggacttcatcgtggtagagtctgcgttgcttggcctccggtcgaggtacgggtcaccgatcacggctggcttggtgatcctgtccacggagattcccttctctcctatcagcatcaggacgacgctggccatgttcggacgcagcttcatcgcgtcttgggcgcatagtaggccaaccttcaagaaacggcatgcctcctcgacgttcaggtcctcccctgcttcggcgtctatgaccttctctagctttccctgcacgtagtatgcccatgtcttctcaagcagaaactggtctccctgaggcaatctact

SEQ ID NO: 73356 - DNA, 434 bp, Zea mays
  Clone ID: LIB3078-018-Q1-K1-H4.R1
ctcatgtgagcactagggttgcaggaacaatgaggatacctggctcctgaatacgctgtgagggggcaagtgacgaagaaatcggatatctatagtttcggcgttttgctactggaaattgttgctggtagatgtaactacaacagtagattgcctcagggagaccagtttctgcttgagaagacatgggcatactacgtgcagggaaagctagagaaggtcatagacgccgaagccaggggaggacctgaacgtcgaggaggcatgccgtttcttgaaggttggcctactatgcgcccaagacgcgatgaagctgcgtccgaacatggccagcgtcctcctgatgctgataggagagaagggaatctccgtggacaggatcaccaagccagccgtgatgcgggacccgtacctcgaccggaggccaagcaacg

SEQ ID NO: 73357 - DNA, 592 bp, Zea mays
  unsure at all n locations
  Clone ID: LIB3078-018-Q1-K1-H4.R2
ctcatgtgagcactagggttgcaggaacaataggatacctggctcctgaatccgctgtgagggggcaagtgacgaagaaatcggatatctatagtttcggcgttttgctactggaaattgttgctggtagatgtaactacaacagtagattgcctcagggagaccagtttctgcttgagaagacatgggcatactacgtgcagggaaagctagagaaggtcatagacgccgaagcaggggaggacctgaacgtcgaggaggcatgccgtttcttgaaggttggcctactatgcgcccaagacgcgatgaagctgcgtccgaacatggccagcgtcgtcctgatgctgataggagagaagggaatctncgtggacaggatcaccaagccagccgtgatcggtgacccgtacctcgaccggaggccaagcaacgcagactctaccacgatgaagtccttcgccacgaccgaagctttaacgtcatcagaggcaaacacggagtggtctctgtgatgggnggaaaaaacgtcatcatcgatggagatttgtntttgtggatgctgcagttgccaaacaaataccgcatcgcttct

SEQ ID NO: 73358 - DNA, 328 bp, Zea mays
  Clone ID: LIB3078-019-Q1-K1-A8
tacttttcacgtttgcgcgcactgagttctctttggcttgctaggccacgagagtaacatgacccccgttggggtcactcgatgaactgatctgtgaatgtgggactgctggctgcaaactcgcaaagcatttgcagatgactggaggatcagtcctctctgtacaagttgtattaacatcttctggtctcatattgtgctccagtgttgtacaatttagggaaaagcttggattaacttgtaagttatcatgaatttgttattggcatattgtacaattgtattagcaataaaaatagaagtacataagtgctggaagcctggaagg

SEQ ID NO: 73359 - DNA, 377 bp, Zea mays
  unsure at all n locations
  Clone ID: LIB3078-019-Q1-K1-B9
cgctcggtctcgccgacgaccctgaggccttcgcggagctcaaggtgaacgatctcaaggacgggcgtctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgagggggtggaggcgccaccgtccaccggccaccgctgcggatatctaggtgttcggatgcacgtgagcgcgcactggttccagtttgtaccatgatgtanattacttaccgtaccagggttcaatcggcacggaagaattgctgtgttcaacaaacattcaacaaa

SEQ ID NO: 73360 - DNA, 249 bp, Zea mays
  Clone ID: LIB3078-019-Q1-K1-F11.R2
cccacgcgtgcgcaaagctgttgcggacgacaaggcgaaaaaactaaatcaaggatgcgaggctgagaggagattctttctcggactctgacagtgactatgacagctatgttgatcggaaacaccgggagaggaaggatcgtttaaggaacaagaagcataagcattctgactgtggtggtgccaggagacccaagcataggtccagatagggctcagactcaagggatgagagcaaccgtgaatatg

SEQ ID NO: 73361 - DNA, 482 bp, Zea mays
  Clone ID: LIB3078-019-Q1-K1-F4.F1
cactgaatacttccagctgtcatgatgcttactatttcccattgtacatgagcctaaggtttcgacattatattagaatgtttaaccgtcatttctgaccaaggcgttttggaaggcccagtttcagaatcttcgatgattctgagtttgccactagcagtggctttcaacatcgtatcctatactttatatctgagatcacagcatttcttgacgtgcctgcgcgtcaggtattgccatgatgtttcagctggtgaccacaaacgggctgcggaccatgtgctttccgtctgaccatgttatggagccgaaagggcccttggccgccgcgcgtcgtcgtcgttccgctacggagaagctccctggaagccagcttcttgacgctctggtgactcgagttactgggcgtgacttcacgtcaggccgggcgcgcgctgacggcacgtttagaggccgctcttggcccacgttgtgacggtgcg

SEQ ID NO: 73362 - DNA, 556 bp, Zea mays
  Clone ID: LIB3078-019-Q1-K1-F4.F2
ccactgaatacttccagctgtcatgatgcttactatttcccattgtacatgagcctaaggtttcgacattatattagaatgtttaaccgtcatttctgaccaaggcgttttggaaggcccagtttcagaatcttcgatgattctgagtttgccactagcagtggctttcaacatcgtatcctatactttatatctgagatcacagcatttcttgacgtgcctgcgcgtcaggtattgccatgatgtttcagctggtgaccacaaacgggctgcggaccatgtgctttccgtctgaccatgttatggagcccgaaagggcgcccttggccgccgccgcgtcgtcgtcgttcccgctacgggagaagctcacctggaaggccagcttcttgacgcctctggtgaactcgagcttactgggcgtgaccttcacgtccaggccgggcggcgcgctgacggcgaccgtgtaggaggccgcctcttgcgcccccacgttggtgacggtgcgggtcacggtccggcttcggcccgccgcagccgatttattgccgaggagccc

SEQ ID NO: 73363 - DNA, 233 bp, Zea mays
  unsure at all n locations
  Clone ID: LIB3078-019-Q1-K1-F4.R1
gggagctacgggcgaggcgcgctggcccccgggctggtgtacgacgccaggggaggacgactacctccgcttgctctgcacctgacggctccaatgcgtccactgctgangcgagtcgcctccaccctccccagcaggtttcagctgcgcgcctaacgtaagcaaggacctcatctccgacatcgactacgcgtcgatcnccgtgacggggctcctcggcaataaatcggctg

SEQ ID NO: 73364 - DNA, 588 bp, Zea mays
  unsure at all n locations
  Clone ID: LIB3078-019-Q1-K1-F4.R2
cggacgcgtgggccggcgggcgcgctggaccccgggctggtgtacgacgccggggaggacgactacctccgcttcctctgcaactacggctacaacgcgtccactgtgaggctcgtcgcctccaccctccccagcgggttcagctgcgcggccaacgttagcaaggacctcatctccgacctcaactacccgtcgatcgccgtgacggggctcctcggcaataaatcggctgcggcgggccgaagccggaccgtgacccgcaccgtcaccaacgtgggggcgcaagaggcggcctcctacacggtcgccgtcagcgcgccgcccggcctggacgtgaaggtcacgcccagtaagctcgagttcaccagaggcgtcaagaagctggccttccaggtgagcttctcccgtagcgggaacgacgacgacgcggcggcggccaagggcgccctttcgggctccataacatggtcagacggaaagcacatggtccgcagcccgtttgtggtcaccagctgaaacatcatggcaatacctgacgcgcaggcacgttaagaaatgctgtgatctnagatataaagtataggatac

SEQ ID NO: 73365 - DNA, 378 bp, Zea mays
  Clone ID: LIB3078-019-Q1-K1-G8
ctgcctgcagcgcgtcagcagcagagacagtcgtcttcagctattaaccagcggcggcgggtccaaggcatgggctggcaagttcaagcccaccctcgacaaggtggagttcctctacgacggccaggggttcatgtcgatgcgcctgagcaggacggaggcccgcctcgcgttcttcgacgtcgctggcagcgtcctgcactgctggaccatgcatgcccaaaaattaacgacgacgacgactgctgctgcagctaggcactaaagctttgctgggtacgatgagttgatgatgcaattaattatttggttttgtcgtcttttcgtgcgtgagagggaagcaatcataattaattgctgctgcttcaaaaaatataa

SEQ ID NO: 73366 - DNA, 514 bp, Zea mays
  Clone ID: LIB3078-019-Q1-K1-H11-F2A
cccacgcgtccggacccacgcgtccgatcgctcggttcctcaaggccggcaagtacgccgagcgcgtgggcgccggcgcccctgtctacctcgccgctgtcctcgagtacctcgccgctgaagtcctggagcttgctgggaacgcagcgagggataacaagaagacccgcatcgtgccgcgtcacatccagctcgccgtgcgcaacgacgaggagctgaccaagctgtttggtggtgccaccatcgcgagcggcggcgttatgcccaacatccaccaacacctccttcccaagaaggctggctcgtccaaggcttccaccgtcgatgacgatgacaactgaagctgcccactggagaagaggcattcgctaccggcttgtttcctaggtttagcacgcagttagtcagcatgtctttgagagctcgatgtgtttgggaatgacaatagctcctatcttggttccctaagatcgttgattcagatgtgaatactgctaagggttttgggctatgc

SEQ ID NO: 73367 - DNA, 417 bp, Zea mays
  unsure at all n locations
  Clone ID: LIB3078-019-Q1-K1-H11-R2A
ggtcaagctttaacgtccttccatttcttttcaaacgatcaaatcaactggcgtacgtgccagagttgcatagcccaaaaaccttagccggattcacatctgaatcaaccatcttaggggaccaagaaaggagctgttgtcattcccaaacacatcgagctctcaaagacatgctgactaactgcgtgctaaacctaggaaacaagaccgtagcgaatgcctcttctccagtgggcagcttcagttgtcatcgtcatcgacggtggaagccttggacgagccagccttcttggggaggaggtgctggtggatgttgggcataacgccgccgctcgcgatggtggcgccaccaagcagcttggtgaggtcctcntcnttgcgcacggcgagctggatgtgacgcggcacgatgcgggt

SEQ ID NO: 73368 - DNA, 546 bp, Zea mays
  Clone ID: LIB3078-020-Q1-K1-A4.F1
ggcaataatgctcccttagaccatgttcggttctagtccaatccatatgaattgaggaagtttcaatccatagtaaattaaaatctctctcaatccatatcaatcccctccaatcatccgaacaagccttaagagatttacactacaaagctacatacaccttgatgtccttcctatcaacctgctctcctgttgctgtatggatatatctacggaaaaccaaaactaagcagcagcttcctctgtttttgccacggagatctggttctggatgtgctgtgggacgacgtcaaacttggcgagctgcatcgtgtaggacgctcgccccttggtcatgccccggaggtgctgacgtattggaaatctcagcaagtggcacaaaagaatcaaccaccttgagtccaccaggcttatccccgaagctgttgacctgtcctcttctagagttcaaatcaccaataacatcacccagatgctcttcaggagttatcacttcaactttcattataggctctagaagctttggacagctttcctcattccctc

SEQ ID NO: 73369 - DNA, 616 bp, Zea mays
  Clone ID: LIB3078-020-Q1-K1-A4.F2
ggcaaataatgctcccttagaccatgttcggttctagtccaatccatatgaattgaggaagtttcaatccatagtaaattaaaatctctctcaatccatatcaatcccctccaatcatccgaacaagccttaagagatttacactacaaagctacatacaccttgatgtccttcctatcaacctgctctcctgttgctgtatggatatatctacggaaaaccaaaactaagcagcagcttcctctgtttttgccacggagatctggttctggatgtgctgtgggacgacgtcaaacttggcgagctgcatcgtgtaggacgctcgccccttggtcatgccccggagggtgctgacgtattggaacatctcagcaagtggcacaaaagaatcaaccaccttgagtccaccaggcttatccccgaagctgttgacctgtcctcttctagagttcaaatcaccaataacatcacccagatgctcttcaggagttatcacttcaactttcattataggctctagaagccttggaccagctttcctcattccctcacggaatgctcctctggctgcaatttggaatgctaagacacttgaatcgacatcgtgatatgagcc

SEQ ID NO: 73370 - DNA, 318 bp, Zea mays
  unsure at all n locations
  Clone ID: LIB3078-020-Q1-K1-A4.R1
cccacgcgtccgcagtgacccagacaagcctgtagtgcttgaacgtatggaatgtcctgatccagtcattaaggttgctattgaacccaagaccaaagctgatgctgacaaaatggctactgggttaatcaagcttgctcaagnaganccgtcattccacttctctagagacgagganaccaaccagactgttattagaaggaatgggagaactgcatcctggtatcattgaagacagnccaaagaggganttcaaggttgaagcaaacgtgcggagctccacaagtcaactancgtganaggatttccaaagttgcg

SEQ ID NO: 73371 - DNA, 660 bp, Zea mays
  Clone ID: LIB3078-020-Q1-K1-A4.R2
cccacgcgtccgctgtgacccagacaagcctgtagtgcttgaacgtatggaatttcctgatcctgtcattaaggttgctattgaacccaagaccaaagctgatgccgacaaaatggctactgggttaatcaagcttgctcaagaagacccgtcattccacttctctagagacgaggaaaccaaccagactgttattgaaggaatgggagaactgcatcttgatatcattgtagacagactaaagagggagttcaaggttgaagcaaacgttggagctccacaagtcaactaccgtgaaagtatttccaaagttgcggaaatacaatatgtccacaaaaagcaatctggtggatctgggcagtttgcagacattattgtgcgttttgaacctttggaagctggaagtgggtatgagttcaagagtgaaatcaagggaggggcagtgcccaaagaatatgtaccaggggtgatgaaaggattggaagaaagcttacccaatggtgtcctagccggttacccagttgtggacttccgggctgtgctggttgatggctcatatcacgatgtcgattcaagtgtcttagcattccaaattgcagccagaggagcattccgtgagggaatgaggaaagctggtccaaggcttctagagcctataat

SEQ ID NO: 73372 - DNA, 340 bp, Zea mays
  Clone ID: LIB3078-020-Q1-K1-A8
cgatcttgtgtccatcgacactctaattgaggaccaccttacgcaagagcccatcaatgagtacgtccagagttgcgacattgtggctttcaacaagatctagagttcagtttctgagtttgggcaacggcagcggctcagctcgtcaagtttgtgctgggatgccagtttatcccttctagtctattacagaaacgttgttcggagctgagtctattataaacatcttggtctgagtttattgttgagtggtgccagtttttttcaatatacatttatcttaaaaacagcggtactgatgttattttgtctaaagttaatgagtttgcaaaataaaaac

SEQ ID NO: 73373 - DNA, 329 bp, Zea mays
  unsure at all n locations
  Clone ID: LIB3078-020-Q1-K1-B5
gatcgactagctagcgcaagccatcgacacagtcaagtcagactgacaaagaaagcaggtgatgcaactagctagtgtagacgatgaatgaatgagtccccggccggccttttgtgggacagcaaggctgctagatacgtacgtacgtactcatcaacaattaatgatggatgatggcaatggcaaatatacagtcaatgattcatatatgcatgcatggactgctatgctagctagcagccctttgtaaatatagtgtttaaggaaatgattcatatattcagcccttaaggactaaaaaaaaaanaatacatnaaaaatgaactaaa

SEQ ID NO: 73374 - DNA, 392 bp, Zea mays
  Clone ID: LIB3078-020-Q1-K1-D6
cccacgcgtccgattgcgctgacgaaattgaaggattccggtggccacaagaagcggagagatgtgggagatgacgatgaagaggttgaagatcattcttctcattctagaagaccgaaatccttgaagagatcaaacagacgatgaaggctctggagcatgtctggactgcctcgtttcgtgcaagtcctttgtggttcagcgcagatccaccctgtggtggtttggagtgatgctttgcctatttatactatggccagttaagacgttcacttgacaccattccttgcgttgaaagcaagtctgccccaattttgtcaaataaatgcacttgaccccgaacatgtagacgtaggtgttgtccttattgagcaagtgccacagctaatact

SEQ ID NO: 73375 - DNA, 392 bp, Zea mays
  Clone ID: LIB3078-020-Q1-K1-E1
tcgcctgcgcaagctgagggacatggaggtcaacagaaatggaagcactaggcttgggaccaagaacgaaagcttcttcaggaagggagttgctggggactggagcaaccatatgacgccggagatggcgcatagcctatacaaggtcgttgaggatgcattgcaagagactggattcaccttttcgagcacaacatgatgagccactgcgctcatatagtagttgtgaactgcagaatgtcaagatcaatgtcgtttatcggtgttgctggctggagatcatgggatcccggagatcataccagccatggtgagcattcttctttggtgatgaacgggaaattgatttgtgactattcatttgtataacatttttacaaaaataagaaaat

SEQ ID NO: 73376 - DNA, 293 bp, Zea mays
  Clone ID: LIB3078-020-Q1-K1-F6
cgaagccgaagcgaagagaaaggtcgaggcgggaggaccgcgatcccgtccgcggtcgtgcacggcccacatccgccgtagcgtgggcgtgcgcagctggccagcctattacgtgtacgtgcgggaggagctgtcagtagcgtgcggaccaccacgcagatgctgccgtctggcgaccgatctctgattcattgatgctttcgtgaaatgctcccgccagcgaacttctcctgtacgcgtgcatcaatgcttcttctactactatgccttttgtttatttttaaggagacaaa

SEQ ID NO: 73377 - DNA, 490 bp, Zea mays
  Clone ID: LIB3078-022-D12-F1A
gtggggaagtgagatcaacaggacctcttgttatggagcctaccacaactcacatagcagatacatcaaggtctacaggtaggacggaaacagagaacaagacgatcaatggagtgattaggttggcactaatcatccacccctatcagaagatcacacaatcccgagataggccccctccttccctatctcagactggtgtgagaaacatgtacgatttggactggaatcgttggatggtgactgtgcaaggtgtggggtggggaagcctgtgtgtgtatgtacatcgttgatttggtgttgcagggttcctagccatgtagcaatgtggatgcgggcgaagaagatagggtcatcagcagcagagcagcctcctccacttccattaggagcctccgtttctgcaccacgtgaaagttgctgctcccgctgctactgctgttgctagagctgtcttttactccagtcttcgcctcgccattattttgtt

SEQ ID NO: 73378 - DNA, 450 bp, Zea mays
  Clone ID: LIB3078-022-D12-F2A
gtggggaagtgagatcaacaggacctcttgttatggagcctaccacaactcacatagcagatacatcaaggtctacaggtaggacggaaacagagaacaagacgatcaatggagtgattaggttggcactaatcatccacccctatcagaagatcacacaatcccgagataggccccctccttccctatctcagactggtgtgagaaacatgtacgatttggactggaatcgttggatggtgactgtgcaaggtgtggggtggggaagcctgtgtgtgtatgtacatcgttgatttggtgttgcagggttcctagccatgtagcaatgtggatgcgggcgaagaagatagggtcatcagcagcagagcagcctcctccacttgcattaggagcctccgtttctgcaccacgtgaaagttgctgctcccgctgctactgctgctgctagag

SEQ ID NO: 73379 - DNA, 413 bp, Zea mays
  Clone ID: LIB3078-022-D12-R2A
cccacgcgtccgccagaccacgcacgccggcagagaaaaaccagaattctccaagcaatcctatcgccaacccggccacggatcggggctgccgtctgtttccgccggcgctggcgccgacgccgatgggctccgccgatcgcagtaagctgcagatcgacgggatcgtggtgacggagaaaggcgccaggagctgcgtcgaatgccgcgccaccaccacgcccatgtggcgcagtggcccgaccgggcccaggtcactttgcaacgcttgcgggattcggtaccgaaagaagaggaggcaagagcttggcctagagcacaacaagcagcagcaacaacaacaaaataatggcgaggcgaagactggagtaaaagacagctctagcaacagcagtagcagcgggagcagcaac

SEQ ID NO: 73380 - DNA, 488 bp, Zea mays
  Clone ID: LIB3078-022-Q1-K1-A11
cccacgcgtgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtctgcgtcaccggaccttctgccgatcaagaagggacctcatgagccgacgcagccgggcccgcgcggcaagatctaagctcagcttctccatttgcatg

SEQ ID NO: 73381 - DNA, 303 bp, Zea mays
  Clone ID: LIB3078-022-Q1-K1-E8
cggacgcgtgggaagagcctcaaggagctcaccggcaagctcttcagcaccatcggcgggcttgaccatgccgcgaagatcaagagcacccctgaggccgagaaatacttcgcagcaaccaaagatgctcttggcgatgttctcgccaagctaggctagacgcaatggctaataatggccatgtaatttcggacttgtgtttgttcatatggacccggcaaggcaatgtaccattttctgttgatattgtatcaggaagcacttaactacaatgctatcttgagtccttgacaaagtacaaaa

SEQ ID NO: 73382 - DNA, 331 bp, Zea mays
  Clone ID: LIB3078-022-Q1-K1-F3
gcggtgactgtaagccgctggagtacaagctctcggcctggcacctcataagctgcgggtgcatgtgccaaggccgcgacttcacccgcagaaacggcaccggcggagagtccatctacggctagaagttacccgacgagaagctcgtgcgcaagcacaccgtccccggtgagctatccatggtcaacgccgggcccaacagcaacggctctcagttcttcatctgcaccgtcgcgaccacttggctcgactgtaagcacgtcgtcttcggtcaggtacgctagggcatggacgtcgacaaggccatctagacagtgggcactcgcaacgg

SEQ ID NO: 73383 - DNA, 297 bp, Zea mays
  Clone ID: LIB3078-023-E2-F2A
ctcgaacttatatgttaaaaaaagaaagctgaaatctagagtttaatccattgacgtcgcaacacaacacaacagtccaaccgcctagcgctgcaaggcgaaaattcacagtagcaaaaggagagagcacagggcatctcattgcctagagcacctcgactctcatgcagcacctctccgctgctccgtctcgccatgggcgaagtggcaccggtcaccaaaagtacaggcacccttcaagaagttctcgcacagcttcgtcttgtagttgctgctcttgccccctggaccaccacc

SEQ ID NO: 73384 - DNA, 419 bp, Zea mays
  Clone ID: LIB3078-023-E2-R2A
tcgtagcgaatcggaccggggggctagggttccggtgcgcctctgcaatcggacgcgaggctaggctgggcatggagggaaccgctgcggcccggaagaggtcccggccggaaaacggcgaaacggggcttgcccgccgccggggaaggcggtttccaaaaagaacaccgggaggtcaatttttcaaaacctggttcttaattcaaagccaaaattccgaaaagcccttttgccacacaaaagttttttttcaagtaacgaatttggggtgcccccgtttttgggcggaggggaattgtcattttttctgccacttttggcccctgggtggttaccccggcaagttgcaaaaaatgcctgaatctaagtagcttctgctgtatttgcgccatcaagaactcatgtggatcatgccgctc

SEQ ID NO: 73385 - DNA, 354 bp, Zea mays
  Clone ID: LIB3078-023-Q1-K1-A8
cccacgcgtccgcctcttcggctgaccgtagtaccggccggcgcgcgaccgagctagctggctccggcgcacacaaccacacacctgtttaattctgtactggatgcgtgtgtaatttgatggttcacaataatgagtccctctccggaccttggtagctgcttgcttgtggtgagtgagagtgtgagactgaaggagaagaagtggtgggcgttgggctacgtcgagagaggcgtgttcctgtactcgcttccgtttctctgcatgcgtgtataattgtgttcaataataagtgagagcggtgtgatgtgtggctccaaaaaaagaaacgcaaacttcttttgtgatgacaaa

SEQ ID NO: 73386 - DNA, 501 bp, Zea mays
  Clone ID: LIB3078-023-Q1-K1-C11.F1
caggctcaacgaaccaacagcagcagtaatcagaagcggtgaacaatatcgagtccagtgatgctagtacactactcaggttacattttgatcaggatgcattctcaattgcttcaatgcacccaacacgcttgccttttgggacatcgctgacataagcgcctcatgggctgctttgttgttcttcagaagtgatgcagcaaacaggactgcccatctggtaaggttttgttgctgatctttgcttagttgcggcttagtcctgtttatgaacctctgaagggtgaaaaggtctgctgattgacttacaactttgtcatatcctagaccttcagcagccagtcctgccattgaaactacagctaacctgtctagttcctttccatcaagctgcccactgtatataagcttttgtaattgccatcaatcaaattaacatgctcctttccgatgtccaaagaatatcaagggtagggaggcaatcaaataggcgactaggaa

SEQ ID NO: 73387 - DNA, 508 bp, Zea mays
  Clone ID: LIB3078-023-Q1-K1-C11.F2
caggctcaacgaaccaacagcagcagtaatcagaagcggtgaaacaatatcgagtccagtgatgctagtacactactcaggttacattttgatcaggatgcattctcaattgcttcaatgcaccccaacacgcttgccttttgggacatcgctgacataagcgcctcatgggctgctttgttgttcttcagaagtgatgcagcaaacaggactgcccatctggtaaggttttgttgctgatctttgcttagttgcggcttagttctgtttatgaacctctgaagggtgaaaaggtctgctgattgacctacaactttgtcatattctagaccttcagcagccagtcctgccattgaaactacagctaacctgtctagttcctttccatcaagctgcccactgtatattagcttttgtaattgctcatctatcaaattaacatgctcctttccgatgtccaaagaatatccaaggatagggaggccaatcaaataggcgactaggaaat

SEQ ID NO: 73388 - DNA, 330 bp, Zea mays
  unsure at all n locations
  Clone ID: LIB3078-023-Q1-K1-C11.R1
tcgctcgctccagctcttctgcagcagcaatcggagcgttctctacagtctttcctgactaccaggagaggattgctaggcatgaagctgctcatttcctagtcgcctatatgattggcctccctatccttggatattctttggacatcggaaaggagcatggtaatttgatagatgagcattccacaagctaatatacngtgggcagcttgatggaacggaactagacaggttagcagtagtgtcaatggcaggactgggcantcgaaggtctacaacatgtcacagatgaaggtcaatcagcacaccttttcacacttcagaggttca

SEQ ID NO: 73389 - DNA, 600 bp, Zea mays
  unsure at all n locations
  Clone ID: LIB3078-023-Q1-K1-C11.R2
cgtcgctccaggtcttctgcaagcagcaatcggagcgttctctacagtctttcctgactaccaggagaggattgctaggcatgaagctgctcatttcctagtcgcctatttgattggcctccctatccttggatattctttggacatcggaaaggagcatgttaatttgatagatgagcaattacaaaagctaatatacagtgggcagcttgatggaaaggaactagacaggttagctgtagtttcaatggcaggactggctgctgaaggtctagaatatgacaaagttgtaggtcaatcagcagaccttttcacccttcagaggttcataaacagaactaagccgcaactaagcaaagatcagcaacaaaaccttaccagatgggcagtcctgtttgctgcatcacttctgaagaacaacaaagcagcccatgaggcgcttatgtcagcgatgtcccaaaaggcaagcgtgttggggtgcattgaagcaattgagaatgcatcctgatcaaaatgtaacctgagtagtgtactagcatcactggactcgatattgttncaccgcttctgattactgctgctgttggttcgtngagcctg

SEQ ID NO: 73390 - DNA, 365 bp, Zea mays
  Clone ID: LIB3078-023-Q1-K1-C7.F1
gaagaccgaatggaacacgttcttcagaaaacttataagcatgaggtacaaagcatgcaattagataggtgggaaaaaaatagaggaataacacgtgcaatgcccgtgacaatttcggacctcctcgtcacgttacaagcagacaggtcactttcagatgtagatgtaaaccatcaagtttaattattgggaagaaaacgtttacagaatgctcgctagcccctccttggcaggaacaggcctgttgccaggaaatgcattccgagacactcggcacgagccttgaagctgtatggctcgtgcattgaccgctccgagagcgccttccggtttgagttggatgttccccatcattaacccatggc

SEQ ID NO: 73391 - DNA, 431 bp, Zea mays
  Clone ID: LIB3078-023-Q1-K1-C7.F2
ggaagaccgaatggaacacgttcttcaaaaaacttataagcatggggtacaaagcatgcaattagataggggggaaaaaaatagaggaataacacgtgcaatgcccgggacaatttcggacctccttgtcacgttacaagcagacaggtcactttcagatgtagatgtaaaccatcaagtttaattattgggaagaaaacgtttacagaatgctcgctagcccctccttggcaggaacaggcctgttgccaggaaatgcattccgagacacatcgacaagagccttgaagctgtatggctcgggcattgacagctccgagagcaccttcctgttgagtgggatgttctccttcattaacccatgcatgaaattgccgtagttcaccccatggaggcgtgtaccagcattgatgcgctcaatccaaagagac

SEQ ID NO: 73392 - DNA, 287 bp, Zea mays
  Clone ID: LIB3078-023-Q1-K1-C7.R1
tttcactgctccagcgaaggcacagccgccaccgttgtcttgatctcccatcttgcatcttctatcgtagcgccggcgctccatacttccgctccctccctgtagtcgcgctcggcacgcggtgtgacggcgggcagtggcggcactcaggagcgaggctctcagcgacggcatcaggggggggcgcctcccgcttctctccagtcgcctctcgccctcgccgccggttctccgcacaccaagccggtgaccctccattatagggtgtgagactagcaaaactcgaa

SEQ ID NO: 73393 - DNA, 413 bp, Zea mays
  unsure at all n locations
  Clone ID: LIB3078-023-Q1-K1-C7.R2
tttcactgttccagcgaaggcacagccgccaccgtttcttgatctcccatcttcatcttcttcgtagcgccggcgctccatcttccgctccctcccttagtcgcgctcggcacgcgggtgacggcggcagtggcggcactcaggatcgggctctcagcgacggcatcagcggtttcccctgccgcttctctccagtcgcctcgcgccctcgcctccggtccttcggacaccagccggtgaccctccatatagggtgtgagactaccaaaactcgnaaatgaacaagggaaagatttttaagctagccaagggattcagaggaagggcgaaaaattgcataaggatagcaagagagagggtngaggaggcgctgcantattcatatagggatcgacgcaacaaggagagagact

SEQ ID NO: 73394 - DNA, 530 bp, Zea mays
  Clone ID: LIB3078-023-Q1-K1-E1.F2
ggaacaatgcctgaagactgaagtttttgcgaaaatttaaacagtttcgggttacatacaccacacgatcatgcaattatgctcacaagcaagaactcctgtctctatatatgaaggtacaaactcgcaggacacacgctggatgagatgcaggctgacgagtcagcatctatgatccagactggctttcgcgttacggtcatcgcacagggaccttgatccagccattggcgaaggcgatggcgaggatgacgaagggggtggacatgccgaagatgatgatgtagggcaggggtgtcatcatggggttctcgccctccctctcccccgcggtctgccagtactgttctggctcctcttccttggtgatgaacttccgcttgcctgcaggcttcagctctccgtctccgagcttcgctgttaccctggcgcgcttgctgacgatgacgcgactgcagaacaaacctgcgccagcggcgcctttcctcgacgatggctgctgcgctgtgatggcagtgcggctgccggcg

SEQ ID NO: 73395 - DNA, 535 bp, Zea mays
  unsure at all n locations
  Clone ID: LIB3078-023-Q1-K1-E1.R1
tcgccttatccacccgtcctgttcctgaacaccgtgacacacagacacaggtactagtactaccatatcatgtgacgtgcatgcggctgtgatgcacaccaacccagccatggccaaggcagctcctcctctcctcgccgccggcagccgcactgccatcacagcgcacagccatcgtcgaggaaaggcgccgctggcannggtttgttctgcagtcgcgtcatcgtcagcaagcgcgccagggtaacagcgacgtcggagacggagagctgaagcctgcaggcaagcggaagttcatcaccaaggaagaggagccagaacagtactggcagaccgcgggggagagggagggcgaaaccccatgatgacacccctgccctacatcatcaatcttcggcatgtccaccccctttcgtcatcctcggcatcgccttcgccaatggctggatcaaggttcctgtgcgataccgtaacgcgaaaccagtctggttcataatgctgactcgtaacctgcatctcatccaacgtgtgtcct

SEQ ID NO: 73396 - DNA, 605 bp, Zea mays
  Clone ID: LIB3078-023-Q1-K1-E1.R2
tcgccttatccacccgtcctgttcctgaacaccgtgacacacagacacaggtactagtactaccatatcatgtgacgtgcatgcggctgtgatgcacaccaacccagccatggccaaggcagctcctcctctcctcgccgccggcagccgcactgccatcacagcgcagcagccatcgtcgaggaaaggcgccgctggcgcaggtttgttctgcagtcgcgtcatcgtcagcaagcgcgccagggtaacagcgaagctcggagacggagagctgaagcctgcaggcaagcggaagttcatcaccaaggaagaggagccagaacagtactggcagaccgcgggggagagggagggcgagaaccccatgatgacacccctgccctacatcatcatcttcggcatgtccacccccttcgtcatcctcgccatcgccttcgccaatggctggatcaaggtccctgtgcgatgaccgtaacgcgaaagccagtctggatcatagatgctgactcgtcagcctgcatctcatccagcgtgtgtcctgcgagtttgtaccttcatatatagagacaggagttcttgcttgtgagcataattgcatgatcgtg

SEQ ID NO: 73397 - DNA, 433 bp, Zea mays
  Clone ID: LIB3078-023-Q1-K1-F11
gacgcgcgcgcgtgcggtgtcgaccgccacctggccggcgggcggaggcacgtcgtgccggggcaggagcgcggctggaagaacgtcttcaaggtgcggcccagcgcggtaaccaggatcctcgtgcgcttcaagccgctcacagacgccgcgtcgccggaggagagccgcttccccttcgacgtcaccactggtccgggttacgtgtaccattgccacattttggaccacgaggacaacgagatgatgaggccgatgaagattgtgcgttgaacggtttccaggaagaaaaacatatattctatgaatgattccgtatcgcaaaagaaacgacatgtttactgtgtctttcccattaatgatttaagcaggaagaacttttagatgattgaacttttcagttaatatagcatttgtcgagtaaaaaaaataa

SEQ ID NO: 73398 - DNA, 499 bp, Zea mays
  Clone ID: LIB3078-024-Q1-K1-B12.F1
agtacgatcgaacttgtcctcgttacttgataaaaccatttacacaaaaccatatcttacagagaccaagaaccaaaatcgagaaatatcacggaacaaaaaaagcagaatccttcttgcgagccgcagttattcccactaacggctgcccctgcccctgccaatcatgtcgttgtagcgcttgagcgactcctgccgctgagccgcatctccatgttgaacttgtggatgaacgcctccacgcggcggttcagctcgtcctgccccagcgacggctcccgccgcaccagcgcaggggagctaggcctgctccttccggcgccaccgtcgttgaaagtctcggccttccgcatcgcccccgccggtgccacggccgctggatcgacctccccgctgctgccaccgccggacgggcggcgccgggaacgggtgtcccaggtgtcggacttcttgaggcgtcgagctagcgtcggcccccggtcctccgcggacgcgtggg

SEQ ID NO: 73399 - DNA, 424 bp, Zea mays
  Clone ID: LIB3078-024-Q1-K1-B12.F2
agtacgatcgaacttgtcctcgttacttgataaaaccatttacacaaaaccatatcttacagagaccaagaaccaaaatcgagaaatatcacggaacaaaaaaagcagaatccttcttgcgagccgcagttattcccactaacggctgcccctgcccctgccaatcatgtcgttgtagcgcttgagcgactcctgccgctgcagccgcatctccatgttgaacttgtggatgaacgcctccacgcggcggttcagctcgtcctgccccagcgacggctcccgccgcaccagcgcagcgggagcaggcctgctccttccggcgccaccgtcgttgaaagtctcggccttccgcatcgcccccgccggtgccacggccgctggatcgacctccccgctgctgccaccgccggacgggcggcgcccg

SEQ ID NO: 73400 - DNA, 536 bp, Zea mays
  Clone ID: LIB3078-024-Q1-K1-B12.R1
cccacgcgtccgggagggccgggggcgacgctagctcgacgcctcaagaagtccgacacctgggacaccgtccgggcgccgccgtccggcggtggcagcagcggggaggtcgattcagcggccgtggcaccggcgggggcgatagcggaaggccgagactttcaacgacggtggcgccggaaggagcaggccttgctcccgctgcgctggtgcggcgggagctcgcttggggcaggacgagctgaaccgccgcgtggaagcgttcatccacaagttcaacatggagatgcggctgcagcggcaggagtcgctcaagcgctacaacgacatgattggaaggggcaggggcaaccttattgggaataattgcggctcgcaagaaggattctgcttttttttgttccgtgatatttcccgattttggttcttggtctctgttaaatatggttttgtgtaaatgggtttatcaagtaacgaggacaagttcgatccgtactaaaaaaataaaaaaaaaaaaaaggcggccgctcctaaag

SEQ ID NO: 73401 - DNA, 520 bp, Zea mays
  unsure at all n locations
  Clone ID: LIB3078-024-Q1-K1-B12.R2
cccacgcgtccgcggagggccgggggccgacgctagctcgacgcctcaagaagtccgacacctgggacacccgtcccgggcgccgcccgtccggcggtggcagcagcggggaggtcgatccagcggccgtggcaccggcgggggcgatgcggaaggccgagactttcaacgacggtggcgccggaaggagcaggcctgctcccgctgcgctggtgcggcgggagccgtcgctggggcaggacgagctgaaccgccgcgtggaggcgttcatccacaagttcaacatggagatgcggctgcagcggcaggagtcgctcaagcgctacaacgacatgattggcaggggcaggggcagccgttagtgggaataactgcggctcgcaagaaggattctgctttttttgttccgtgatatttctcgattttggttcttggtctctgtaagatatggtnttgtgtaaatggttttatcaagtaacgaggaccaagttcgatcgtacttaaaanaaaaaaaaanaan

SEQ ID NO: 73402 - DNA, 645 bp, Zea mays
  Clone ID: LIB3078-024-Q1-K1-E8.F1
gccggcaatctaaactcacgcttatactcaatcactttaaccacgcaatcgttgtgaaggaaaaattacagcacagcttgtctctggtacactcgctacagatccttgttcttcagtgttggtacttgctcagaacttagttgaaaaagacagaaaagttaaaaaaaaagacttccatcttttcacagcgcaatatagcacaaacttccctacacacccaatgacccaacccgctccacgagctcaggcttcagtcactgcggtgaagggatgcgctactgcccagggccttcgcccttctcagggacaggtaggccagcacccggtacccgatgaccatggcgacgagagctgccacctcggtgccaccgctgtccatgtgcctcgtggtggtcaggatgtccggcacggggtcgtactgcaccttcagcaggagcctgtacgtgtggtagttgaaggacaggtagcgcaccaggagatgaatggtggacgctctttacaaagaagctcctgctagcatgaatgtcatgactgtaactgaagctagagttgtcgccttcttgatgtccaacagagtagctccaattgccaatccgagtccctgagcagcaattatgctgagaaagacggtcaacatgctgagaa

SEQ ID NO: 73403 - DNA, 617 bp, Zea mays
  Clone ID: LIB3078-024-Q1-K1-E8.F2
gccggcaatctaaactcacgcttatactcaatcactttaaccacgcaatcgttgtgaaggaaaaattacagcacagcttgtctctggtacactcgctacagatccttgttcttcagtgttggtacttgctcagaacttagttgaaaaagacagaaaagttaaaaaaaaagacttccatcttttcacagcgcaatatagcacaaacttccctacacacccaatgacccaacccgctccacgagctcaggcttcagtcactgcggtgaagggatgcgctagctgcccagggccttcgcccttctcagggacaggtaggccagcacccggtacccgatgaccatggcgacgagagctgccacctcggtgccaccgctgtccatgtgcctcgtggtggtcaggatgtccggcacggggtcgtactgcaccttcagcaggagcctgtacgtgtggtagttgaaggacaggtagcgcagccaggagatgaatggtggaacgctctttacaaagaagcctcctgctagcatgaatgtcatgactgtaactgaagctagagttgtcgccttcttgatgtccaacagagtagctccaattgccaatccgagtccctgagcagcaat

SEQ ID NO: 73404 - DNA, 464 bp, Zea mays
  Clone ID: LIB3078-024-Q1-K1-E8.R1
cccacgcgtccgatcacccaggtcatagctacatcggttatcttaggtttactgtggtggcactctgatcccagcacactaaaaggtctagaggatcaggctggcctgctgtttttcatcgctgtgttttggggcttctttccagtgtttactgcaatctttacattccctcaagagagggcaatgctgaacaaagagcgcgcagtcgatgatgtacaagctcagtgcatacttcttggccaggacgacgagtgatctaccacttgaccttttcctcccaatcatattcatggtgatcgtgtactttcatggcaggcctcaaagcaactgccacacatttcttttctcagcatgttgaccgtctttctcagcatattgctgctcagggactcggattggcaattggactactcctgttggcatcaagaaggggacactctagcttcagtttacgtcatgacatt

SEQ ID NO: 73405 - DNA, 611 bp, Zea mays
  unsure at all n locations
  Clone ID: LIB3078-024-Q1-K1-E8.R2
cccacgcgtccgatcacccaggtcatagctacatcggttatcttaggtttactgtggtggcactctgatcccagcacactaaaaggtctagaggatcaggctggcctgctgtttttcatcgctgtgttttggggcttctttccagtgtttactgcaatctttacattccctcaagagagggcaatgctgaacaaagagcgcgcagtcgatatgtacaagctcagtgcatacttcttggccaggacgacgagtgatctaccacttgaccttttcctcccaatcatattcatggtgatcgtgtacttcatggcaggcctcaaagcaactgccacacatttctttctcagcatgttgaccgtctttctcagcataattgctgctcagggactcggattggcaattggagctactctgttggacatcaagaaggcgacaactctagcttcagttacagtcatgacattcatgctagcaggaggcttctttgtaaagagcgttccaccattcatctcctggctgcgctacctgtccttcaactancacacgtacaggctcctgctgaaggtgcagtacgaccccgtgccggacatcctgaccaccacgaggcacat

SEQ ID NO: 73406 - DNA, 270 bp, Zea mays
  unsure at all n locations
  Clone ID: LIB3078-024-Q1-K1-F1
gcgatcccgttcaagagtaggtcttaaaggagccgatgctgctgcttcgagatgctgccggtcttgaaaggatggattcgtggctgtttcaaatgatcccctactatgttacgtggagttccattcctctttcaaagttcggagctgcttttatccgaacccagacttgtaattcatctgtaccaattgtgtaatatgccgcgcctctgttatgtgcaattcanaattatgagacagcgagtcaagctttaagagttcanaananaaaaa

SEQ ID NO: 73407 - DNA, 445 bp, Zea mays
  unsure at all n locations
  Clone ID: LIB3078-025-Q1-K1-E11.F1
tcgcgttctagatcgcgagcgccgcccttttttttttttttttttttatcaccatcagtaccatttcatcttggtttaaactatacatacagtcgcagctgacacaacccaaggcatgcctattatatacacacccttggctttgcttggctgctgttattctgtaagcacgctagctagcttctccagctctccgggctctaacacgtagatgtaaaccatctgctacacatacgtacatagcgtggtggacagaaatggatggatcagggtcttcaggcgtgcgcactnnccttggagacgccgtcctggtacggcgcctcgcagaactcgccgccaaggtcatcgcacgcctcgcccgggaacaccgtctttggctcgtcgtaggacaggtagtccctgtccaccccgatgacccacgcgtccgcggaggcancntcggnnn

SEQ ID NO: 73408 - DNA, 412 bp, Zea mays
  Clone ID: LIB3078-025-Q1-K1-E11.F2
tcgcgttctagatcgcgagcgccgcccttttttttttttttttttttatcaccatcagtaccatttcatcttggtttaaactatacatacagtcgcagctgacacaacccaaggcatgcctattatatacacacccttggctttgcttggctgctgttattctgtaagcacgctagctagcttctccagctctccgggctctaacacgtagatgtaaaccatctgctacacatacgtacatagcgtggtggacagaaatggatggatcagggtcttcaggcgtgcgccagctccttggagacgccgtcctggtacggcgcctcgcagaactcgccgccaaggtcatcgcacgcctcgcccgggaacaccgtctttggctcgtcgtaggacaggtagtccctgtcaaccccga

SEQ ID NO: 73409 - DNA, 442 bp, Zea mays
  unsure at all n locations
  Clone ID: LIB3078-025-Q1-K1-E11.R1
ggcagcggtgtgtgattgtgacgagggactacctgntctacgacgagccaaagacggtgttcccgggcgaggcgtgcgatgacctttggcggcgagttctgcgaggcgccgtaccaggacggcgtctccaaggagctggcgcacgcttgaagaccctgcttcatccatttctgtccaccacgctatgtacgtatgtgtagcagatggtttacatctacgtgttagagcccggagagctggagaagctagctagcgtgcttacagaagaacagcagccaagcaaagccaaagggttgtggaaataattaagcatgcctttgggtttgtgtcaactgcgactgtatgtatagtttaaacccaagatgaaatggtactgaatggtgataaaaaaaaaaaaaaaaaaaaaggcggcgctcgcgattttagaacgcgaggggccgct

SEQ ID NO: 73410 - DNA, 418 bp, Zea mays
  Clone ID: LIB3078-025-Q1-K1-E11.R2
tcggggtggacagggactacctgtcctacgacgagccaaagacggtgttcccgggcgaggcgtgcgatgaccttggcggcgagttctgcgaggcgccgtaccaggacggcgtctccaaggagctggcgcacgcctgaagaccctgatccatccatttctgtccaccacgctatgtacgtatgtgtagcagatggtttacatctacgtgttagagcccggagagctggagaagctagctagcgtgcttacagaataacagcagccaagcaaagccaagggtgtgtatataataggcatgccttgggttgtgtcagctgcgactgtatgtatagtttaaaccaagatgaaatggtactgatggtgataaaaaaaaaaaaaaaaaaaaggggcggcgcttcgcgatctttagaacgcgagc

SEQ ID NO: 73411 - DNA, 646 bp, Zea mays
  Clone ID: LIB3078-025-Q1-K1-F11.F1
attaagtatatgttcctaaaaaacagaagtatatttatgacggtaaggagcatttgaacatcaaaattgaattgttcacctttgtattccctatataacacatatcatccacccttgctgctgctccgatgatgcgatacgtgcatagagcttcttggagcaatcatacaaagccacgtttgacgtcaaaatttcactatgttttctttgctttattatcttagaaacttgggggtaccgggcccgtagtcttgttgtgttgaggctgattcttggtggaaaggacgcctgctacactcgaatacctgaaattgaagcaggcattgggggaattaagtgcctaggagcgcattgggggtcttattcgaataggtttgccttcttttgcctcaacaatcaccacatcagaggtgagaaaggacttagcaactacagcagcatgctcaatgcaacacctcacaacctttgttgcgtccagtattccagcagccatcaagtcctcatagcagttcttggcagcattgtaaccataatttgcatcatcattcagtaacacctttttaatgacaagtcgccattcacccctgcattttttgctattagtgaggtagggtaactcaggcttgtttgaagatgtcagcaccaa

SEQ ID NO: 73412 - DNA, 564 bp, Zea mays
  Clone ID: LIB3078-025-Q1-K1-F11.F2
attaaagtatatgttcctaaaaaaacagaagtatatttatgacggtaaggagcatttgaacatcaaaattgaattgttcacctttgtattccctatataacacatatcatccacccttgctgctgctccgatgatgcgatagcgtgcatagagcttcttggagcaatcatacaaagccacgtttgacgtcaaaatttcactatgttttctttgctttattatcttagaaacttgggggtaccgggcccgtagtcttgttgtgttgaggctgattcttggtggaaaggacgcctgctacactcgaatacctgaaattgaagcaggcattgggggaattaagtgcctaggaggcattgggggtcttattcgaataggtttgccttcttttgcctcaacaatcaccacatcagaggtgagaaaggacttagcaactacagcagcatgctcaatgcaacacctcacaacctttgttgcgtccagtattccagcagccatcaagtcctcatagcagttcttggcagcattgtaaccataatttgcatcatcattcagtaacaccttttt

SEQ ID NO: 73413 - DNA, 581 bp, Zea mays
  Clone ID: LIB3078-025-Q1-K1-F11.R1
tgagaattgaaaatggaagaggcaccgagaacagtctggaggttctggaaggaatgcaatttgaacgcggttacctctctccttactttgttaccgatcgtggtaacatgacggtggagttcactgactgtcagatactattggttgacaagaaaattacggatgctagtgagattataaggatactggacagtgctgtcaaagaaaactatccgttgttaataatcgccgaggatgtggaagaacaggcaatggctgatttgataaaaaacaagctgaaagggacaatttaaggttgcagccgttaaggccttctctttttggggaacaaaagactcaatgcttggatgacattgcaatcatgacaggaggtacactagtgagggatgacatggggcatattactggaaaggcaaggaaagaggttcttggttccgcttctaaggtggtaatcacgaaagattcaacactaattgttactgacggaagcaatcgtcgagcagtttgaggaagggttgctatgattaaaggccaatttagatttctaaggaagttacacaagagatattgggtgagaggta

SEQ ID NO: 73414 - DNA, 600 bp, Zea mays
  Clone ID: LIB3078-025-Q1-K1-F11.R2
tgagaattgaaaatggaagaggcaccgagaacagtctggaggttctggaaggaatgcaatttgaacgcggttacctctctccttactttgttaccgatcgtggtaacatgacggtggagttcactgactgtcagatactattggttgacaagaaaattacggatgctagtgagattataaggatactggacagtgctgtcaaagaaaactatccgttgttaataatcgccgaggatgtggaagaacaggcaatggctgatttgataaaaaacaagctgaaagggacaattaaggttgcagccgttaaggccttctcttttggggaacaaaagactcaatgcttggatgacattgcaatcatgacaggaggtacactagtgagggatgacatggggcatatactggaaaaggcaggaaaagaggttcttggttccgcttctaaggtggtaatcacgaaagattcaacactaattgttactgacggaagcaatcgtcgagcagttgaggaaagggttgctatgataaaaggccaaattgagaattctaaggaaagttacaacaagaagatattgggtgagaggatagcaaggttatgtggtg

SEQ ID NO: 73415 - DNA, 531 bp, Zea mays
  Clone ID: LIB3078-026-Q1-K1-A11.F1
aaaaagtgccttaagaagcgaaattcatatttacatggaattcacagatttacactaccagagtgtagggcaacaagaggccagtggtgtttgacggcccatcataaaagtagtttcacaaacatgagatgtcccatgatccaccacagatagggttcctattttcgtctatgtcgatgaccagcagatgatctggattcgaaccattcggcccctctttgtacagtgttggcagatatgcatggtatgccggtaggtagcgtgatacaaaatccataacctcctcatcagacattccaggctttccatctgctctcatagcgacctctgcctgcagtctccactggtaaacgctaccgggttctcttattttaataacaatccatgactggatgaacctgtcccaagcatcagagtatgcttcaaggttcttgttaaccacctccagctgtggattcacttctttcacaacttcatttggaagaggtttaaatccatgcatccatccttgcgaacagaacaactctaagg

SEQ ID NO: 73416 - DNA, 155 bp, Zea mays
  Clone ID: LIB3078-026-Q1-K1-A11.F2
aaaaagtgccttaagaagcgaaattcatatttacatggaattcacagatttacactaccagagtgtagggcaacaagaggccagtggtgtttgacggcccatcataaaagtagtttcacaaacatgagatgtcccatgatccaccacagataggg

SEQ ID NO: 73417 - DNA, 121 bp, Zea mays
  unsure at all n locations
  Clone ID: LIB3078-026-Q1-K1-A11.R1
acgagcttagttgtcggagccgagaaaggcccggatatatcacttctaacatgcccgtcttgctctggtgcgaggacnaggtcatggtgcacagagctaggtacaacgacggcgatgacat

SEQ ID NO: 73418 - DNA, 569 bp, Zea mays
  unsure at all n locations
  Clone ID: LIB3078-026-Q1-K1-A11.R2
acgagctttagctgtcggacgccgagagggcgcggatataccacttctacatccccgtcttcctctggtgcgaggacgaggtcatggtgcacagagccaggtacaacgacggcgatgacatcccgccattggtgatcggggtcagcgctccccaaggaagtgggaagacgactcttgtgtgcgcacttgattatctttttcgggttgctggtaggaattctgccacattgtctatagacgacttctatctgacagcaaaagaacagaatgaattgagggacagaaatcctgcaaatgctcttttagagttccgcgggaatgctggaagccacgatctccaactctcagtggaaacactcgagtcactgatcaagctaacgaaggaaggtatgaagatgaaggttccacggtatgacaagtctgcgtttgggggaaggggtgaccgggctgatccttctgtatggccagaggttgaagggcncttanaggttgttctgttcgaaggatggatgcttggatttaaacctcttccanatgaagttgtgaaagaagtggatccacagctggag

SEQ ID NO: 73419 - DNA, 238 bp, Zea mays
  Clone ID: LIB3078-026-Q1-K1-C5
cggacgcgtccggtgggcttcaacctcgtcgacgtcctcgcctggggctcgctcggccacatcgtcgcctactacatcctcgccacctccagcaacggatacgaccccaacttcttctgagcggccggctgcgggcatgttcttgagcctgcctgtattctactccgtgtgtgttgagccatatatctgatgctcaaggattggttaatttgaacaagtggtgcaactgcgcgtgtac

SEQ ID NO: 73420 - DNA, 419 bp, Zea mays
  Clone ID: LIB3078-026-Q1-K1-D8
gttctagatcgcgatctagaactagggaagctcgagccaggatttatcagcatgcgtacgagtattgagtcgcgtttgatgctggtgagccgatttataatttttgtaagtttatctgatgattggattaactagaattattagtcgtaataatcctcgtatttagcgcacgcgcgttgtggtagtgttaaaaataagtgaagtacgatgggtttagtaatacgaaaggtagattaatttacgaatatctaatcgaggtggcgacgtacaggatagatttagtatttcatatcgctatctgatgaattgtatcattgacaattgcactaaatacataacatatagaaatgttcgattatttgtggacatgtgaaatatgtgaggagtgaaataaaatttaaattgacatagagatagcc

SEQ ID NO: 73421 - DNA, 429 bp, Zea mays
  Clone ID: LIB3078-027-Q1-K1-G5.F1
ggccccaaaaaataggttcattgaatgacatcagattccgattacatacagggcaaaccaatgggaacagctatggccgactactccaggctcaaatcagcaaaactgcagcttgctaacaagacatttcacagctgcataagagccctatgcgttaacaggaacgacaggctacctaacctaactctatagcatttacagggtaaacgggacacctatacataggatgggctaccaggtcagttaccagggctatctacaaactttgaaccaagcctctcaccctgcactttgcgcataaccaaagaaccatggatcatgccttctctcctttcccttcagcacaagaagcattgccgtttgtcagatctgcaacaagcaaccgaacttaggtacttgcatgcagcaagattgattgaagttgtccag

SEQ ID NO: 73422 - DNA, 592 bp, Zea mays
  Clone ID: LIB3078-027-Q1-K1-G5.F2
ggcacccaaaaaataggttcattgaatgacatcagattccgattacatacagggcaaaccaatgggaacaggtatggccgactactccacgctcaaatcagcaaaactgcagcttgctaacaagacatttcacagctgcataagagccctatgcgttaacaggaacgacaggctacctaacctaactttatagcatttacagggtaaacgggacacctatacataggatgggctaccaggtcagttaccacgggtatctacaaacattgaaccaagcctttcaccctgcactttgggcagctaccaaagaaccatggatcatgccttctttcctttcccttcagcacaagaagcattgccgtttgtcagatctgcaacaagcaaccgaacttaggtacttgcatgcagcaagattgattgaagttgtccaggaggcaattcctatacccattatctagttcccgagaacccacagctggatcctgcgtgcacgggtgcccagcagacgcagctaccatcaaacacatgggatctcaatcttgaactaaacagcctctagtctgattgatgcttttgaaaaaactgacaaaac

SEQ ID NO: 73423 - DNA, 299 bp, Zea mays
  Clone ID: LIB3078-027-Q1-K1-H11.F1
ccaaaaaaaaaaatgaactaattttccttaggaaaccttggaagaataagttcccaaactagccctaatcaaattgaaaatagaaaatggaacttcgcaaaaaaaagcaacatgaaattgatctccaggggaactcatgctctcgtgcccctagctaaatggatgaattgaactgccaataaataaattgtcgaactgtatgtacagtaccgtcaaaaagtagtaagtttaagtacacctgggcggtacgttcacaaacagtcaacaggtgcaagtaaccaaccaggccgtccaaaggg

SEQ ID NO: 73424 - DNA, 584 bp, Zea mays
  Clone ID: LIB3078-027-Q1-K1-H11.F2
cccaaaaaaaaaaatgaactaattttccttaggaaaccttggaagaataagttcccaaactagccctaatcaaattgaaaatagaaaatggaacttcgcaaaaaaaagcaacatgaaattgatctccaggggaactcatgctctcgtgcccctagctaaatggatgaattgaactgccaataaataaattgtcgaactgtatgtacagtaccgtcaaaaagcagtaagtataagtaaacctgggcggtacgttctcaaacagtcaacagggcaaagtaaccaatcaggccgtccaacgggagcaaaatcagttccatcagcatcaccattattaataaagcacactttaaccaatgagttccacacatctccacagccacgattcaagcacaccataacggatcaggtccccatcagcgtagccacgattgaagcgcgccataatttcggttgatgaatagtggaatccatcatactgcagttttacacacgtccgccaattgctatggttcaaacatgctaacagacttacaagaaaccaagttccctattgacaaaacctgataaatacaaatgaaaaatgc

SEQ ID NO: 73425 - DNA, 522 bp, Zea mays
  unsure at all n locations
  Clone ID: LIB3078-027-Q1-K1-H11.R2
cccatgcgtccgcccacgcgtccgcccatgcgtccggttggtccgctacgcacgccggatttttgcatcgagcacggagatctacaacaaaaacatggagctacgacgcgattcccaaggtacaatcgtaattatgttcaaacaatttttaagtcgtcctgcgctccttctattacgagcaacgttttatattctgtgcttgcataataaatcgaagaaatcctgacaccaatcgaactgaagatcctgaaacgcacgttaataccgttgacgtccgcttcacccagctcgattttcagtcttgtaataataattgagaactccaatgaactgagagttactaatcgctccatgagtctgaagcgtgcaaaaatttaggtcgcagctacacaaatttacacgctgttctatattctatattctatatnatatttaggtcgcagctacccgtgaatctcctattttgaaanggtcactgcttttttatttcattctatatnctatattatattttngtaatat

SEQ ID NO: 73426 - DNA, 140 bp, Zea mays
  unsure at all n locations
  Clone ID: LIB3078-028-Q1-K1-D7.R2
gcccatttgttcttgctagtggacgcattgtggtcgcagatagtagcgtttcaaacaagantgtgttcttcttggtgctggaagtcctgtctggatctgatgctcacacctgatgaagtggcattggttagggacatgcg

SEQ ID NO: 73427 - DNA, 452 bp, Zea mays
  Clone ID: LIB3078-029-Q1-K1-B4.F2
aggaggtataatcgtcatatatgaatgctcatactatgtacacaaaccaaatattctctacatgatcgctactgttcagtgactattgaattagggctgcactctatggattacattgtattacgatgcatattcctacattacgttactacgctttgcagaatgccactagtctgaccgagcagatctgaatagctcctcccatttctctgggtcagttccgggcccttcacccttaactgagttaatctcatatatttgtccttcagtggattcaatatctaaagcttggatacaagcttctgctaccacaagtctgctaacttcccccacaagcttgtcacctttgcctatgactactgctcgtcgctctccagctgtagctttaagaagtgtattaagatcatacgaagtgtagggcccgtctgtcaatcttccagccctaataatcg

SEQ ID NO: 73428 - DNA, 469 bp, Zea mays
  unsure at all n locations
  Clone ID: LIB3078-029-Q1-K1-B4.R2
cgattattagggctggaagattgacagacgggccctacacttcgtatgatcttaatacacttcttaaagctacagctggagagcgacgagcagtagtcataggcaaaggtgacaagcttgtgggggaagttagcagacttgtggtagcagaagcttgtatccaagctttagatattgaatccactgaaggacaaatatatgagattaactcagttaagggtgaagggcccggaactgacccagagaaatgggaggagctattcagatctgctcggtcagactagtggcattctgcaaagcgtagtaacgtaatgtaggaatatgcatcgtaatacaatgtaatccatagagtgcagccctaattcaatagtcactgaacagtagcgatcatgtaaagaatatttggtttgtgtacatagtatgagcattcatatatgacgattatacctcctaaaaaaaaaaaanaaat

SEQ ID NO: 73429 - DNA, 420 bp, Zea mays
  Clone ID: LIB3078-029-Q1-K1-C11.F2
ttacaagcagttcagcctgacggcgacgactgctggtccaaggaagcaaacgatgcgagcggcgccggcgcatcggcggcctgagacagtctacgatgcatgcacgtgcacgagagaaactaaacggcggcgagcggggagagagcgctggatgctagctgcgctgcgctgcgcacccctgggtcggtcggcttcggcttttagtagtcggtggaggggagctgctcgtgggtgtgggagatgaagagcagctcgtagatgacgccggcgaggccgccgccgatgagggggccgacccagtacacccactggtagccccactcccagctgacgagggcggggccgaaggacacggcggggttcatggacgcgccgtcgaaggcgccgcccaccaggatgttggccccccggacgcgtggg

SEQ ID NO: 73430 - DNA, 322 bp, Zea mays
  unsure at all n locations
  Clone ID: LIB3078-029-Q1-K1-C11.R2
cccacgcgttcggggggccatcatcctggtgggcggcgccttcgacggcgcgtccatgaaccccgccgtgtccttgggccccgccctcgtcagctgggagtggggctaccagtgggtgcactgggtcggccccctcatgggcggcggcctcggcggcgtgatctacgagctggtgtggatgtgccacacccaggagcagntgcccttcaccgactactaaaagccgaagccgaccgacccaggggtgcgcagcgcagcgcatctagcatccagcgctgtctgcccgctcgccgccgtttagtttctctcgtgcacgtgcatg

SEQ ID NO: 73431 - DNA, 286 bp, Zea mays
  unsure at all n locations
  Clone ID: LIB3078-029-Q1-K1-E12
gtcgattcctattcgtcgtgtcttcaaggctggtgctcactgctgcgccgttgtggtgaccgaaacaagaactctgtgtattcctgtaccgagctgtgcatgttttttttttctttccatcgtggagaatttaagttattatccgtttgctgcaaggtttgccgtctcattttatgcgttgggatgttggcaagaaagggcagatgtcatgtgagaatttaagttaagtgaaatcgattcagggttttcttggtttcagtttcaannnnnnaaannnanannnnnn

SEQ ID NO: 73432 - DNA, 393 bp, Zea mays
  unsure at all n locations
  Clone ID: LIB3078-029-Q1-K1-E7.F1
acaaatgtaatgttgtattttcccttttgtttaccatcatatgngggctttcacatacgtacgttgaggttttagaagtcgtgcttaattataagcctatatatctactagcagttcttgtactaataatacatgtgcttccacaatgaatcgtgaaaagcacaaaacaaaacccatcgggacagatgatatacactgatgaaacaatctctacaccctttatagcctccgcttcaactaatgtacatataccagtacgtcacattccttagccctcagtcgattaagaacgcatcacacgaactgtcttcgagtctcggcctttcagctcggaacacatgacctgatggaccgtcgactcaaccgacaggtctggatgatggttttgtgcat

SEQ ID NO: 73433 - DNA, 514 bp, Zea mays
  Clone ID: LIB3078-029-Q1-K1-E7.F2
acaaatgtaatgttgtattttccttttgtttaccatcatatggggctttcacatacgtacgttgaggttttagaagtcgtgcttaattataagcctatatatctactagcagttcttgtactaataatacatgtgcttccacaatgaatcgtgaaaagcacaaaacaaaacccatcgggacagatgatatacactgatgaaacaatctctacaccctttatagcctccgcttcaactaatgtacatataccagtacgtcacattccttagccctcagtcgattaagaacgcatcacacgaactgtcttcgagtctcggcctttcagctcggaccacatgacctgatggaccgtcgactcaacccgacagggtctggatgatgggtgttgtgccatgggtcggacaggtgctgcagcaggttgtcgaagggccccttgccggtgacgttgtgctggatcaggaaggccaggaacgccagcatggccagcctcccgttggcgagctccttctcctt

SEQ ID NO: 73434 - DNA, 59 bp, Zea mays
  Clone ID: LIB3078-029-Q1-K1-E7.R1
cactatagggaaactggtagctgcacgttcggtcggaattccgggtcgatcatgcgtcg

SEQ ID NO: 73435 - DNA, 572 bp, Zea mays
  unsure at all n locations
  Clone ID: LIB3078-029-Q1-K1-E7.R2
cggacgcgtgggccggcagcgtcttcaacccgctcaacttcgcgcccacgctcgaggccaaggagaaggagctcgccaacgggaggctggccatgctggcgttcctggccttcctgatccagcacaacgtcaccggcaaggggcccttcgacaacctgctgcagcacctgtccgacccatggcacaacaccatcatccagaccctgtcgggttgagtcgacggtccatcaggtcatgtggtccgagctgaaaggccgagactcgaagacagttcgtgtgatgcgttcttaatcgactgagggctaaggaatgtgacgtactggtatatgtacattagttgaagcggaggctataaagggtgtagagattgtttcatcagngtatatcatctgtcccgatgggttttgttttgtgcttttcacgattcattgtggaagcacatgtattattagtacaagaactgctagtagatatataggcttataattaagcacgacttctaaaacctcaacgtacgtatgtgaaagccccatatgatgggaaacanaagggaaatacaacattacatttgt

SEQ ID NO: 73436 - DNA, 268 bp, Zea mays
  Clone ID: LIB3078-029-Q1-K1-H11.F2
atataaagtatggtggacccatttggacaacaggtccattttgactgacgctcacagataggagctcacttaattgttggtgacaacgaaaagaagaaactacagagcaggaccagtgctagatatagcatctaaagatatataccaagacaagtaccgcacatctaggcatacatctagacatgacttttcgcgcgtatgtcttaaccatgcaagcgttcaacagttcttatagagaggtataatatgagcatacatactacatatg

SEQ ID NO: 73437 - DNA, 177 bp, Zea mays
  Clone ID: LIB3078-029-Q1-K1-H11.R2
cgcacgctttcgaacagacgtgaccgagcgggtgggccgataggcattagcgtccggttgaagtggtactggccgtggttgacggccttcaataactgccgtgccagatcaagttggatgacatactcgacatccttgtggcgccgagtgtcaagggagaggcagacatatcatatg

SEQ ID NO: 73438 - DNA, 366 bp, Zea mays
  unsure at all n locations
  Clone ID: LIB3078-030-Q1-K1-B12
gcacccacgcgtncggccatctctcccagctgctgcagaacgtacgtaacaagcttaaccaaggcgcttggagctggtctcaggaggagaaggatcactgcctggaggagacggacaagtcattcgcctactcacgaagcctgctccggcacatattcacctgatttaacactgttggctgatccagtttcaaacgctgtacatacataaccttttgactgctaaaactttattactggtgaggcggatctccctaccccagatacgttttacctgcaaccaagttgccaagtgacgaataaacctacctgcatcgctggtgtagggtaaacgctgaacgatgcctctgactgtgaaaaatttaaa

SEQ ID NO: 73439 - DNA, 318 bp, Zea mays
  Clone ID: LIB3078-030-Q1-K1-B6
cccacgcgtccgcgacggcagcctgctgcccacggcggtgggcgtcaaccccaggatcagcatccagtctatcgccttctgcctctccaagggcatcgccgagaccatggcccaggggcagggcaagggacagtagcctatgattgagacgcgcctggcgatggtttaattcatgcgtgcaacactgcaacatgtgtgcgttcttgttaatcgagtgtggtgaaagcgtcgaaaaatgtgtttgtgcattgcgtttgtgcaaatggtacgcgaatcacaatacatcctgtttcctgccccggtcaaaaaaaaaaatat

SEQ ID NO: 73440 - DNA, 347 bp, Zea mays
  unsure at all n locations
  Clone ID: LIB3078-031-D12-F1A
ccttgttggacatgaaattggtacccacattgattctccacacacttcatgaatgcgtttgctcatgggggcgatgcctgcatatacatgatngatggactgggaagctacttgcaaatcncttcgttggagcggcctcggtctcgtcatgtcgctgaacatgctgaaggccttgccgatgcgcggattctacttcagcttctccagcgtcttcgccacgtcncncaacgcttcacagcacttgagcgcgttgcngacatcctctagccgcagnaggtaatnctcctcgctnacccggaacgatttttgctccctgtacttcnacatcacattcatggccagcacat

SEQ ID NO: 73441 - DNA, 266 bp, Zea mays
  unsure at all n locations
  Clone ID: LIB3078-032-F3-F1A
aaaaatcctgnatctcnanaatgttaactccattattgtctaggtttccactatatggtctccttattaaccttgggattcctcagccttaccaatatctctatcttccggncngnnattcatggatgaccactgcttcattacatgtgctttgctttacctgngaattttatccaatcataaagttcacttcttcaatcatttttcatacgtaaccttatcatacacttagngcatcaggcagcgactttgcagntctcagaatt

SEQ ID NO: 73442 - DNA, 144 bp, Zea mays
  unsure at all n locations
  Clone ID: LIB3078-032-G3-F1A
cgaaaccggcatttgggtacctccttctcaacttntgtaacaaaacatgancggtacatggcacacatactgtattcgtagtctatatatatgtatatggtacatggacacttggaacgacagctcttggtgcggcnttggggt

SEQ ID NO: 73443 - DNA, 459 bp, Zea mays
  unsure at all n locations
  Clone ID: LIB3078-032-G3-R1A
ctcatccacgaccgtgggcaaggtgctgctgcaccaagcttcggggagcccctcagtgggctgtcgtcggtgacaccttccccgtcggctgcgcagacgaggggtgcaacgccacttcaagtacttcaaggagaaccccgactaccacaacccgaagctcaacaccaagttgggggtctactcggagggctgcggcctcaacaaggtgctcatgtcatggggccacgacgactacatgtacctggtggccaaggagaacaagtgcacccttccttccgcggggctgttcatcatcagatagcactcgttctaccccctgcacaagcatgggacctacacacacctgatggacgatgaggacaaggagaacctcgantggctgcatgtgttcaacaagtatgacctgtacagcaagagcaacagcaggatcgacgtggaggaggtgaaccctactacatg

SEQ ID NO: 73444 - DNA, 460 bp, Zea mays
  Clone ID: LIB3078-032-Q1-K1-G9-F2A
ccacaaaaatgtgaaatggttcaaaaaaacaactgagttgcacaacttcttcaagttaattccatgcatcattactcgtattagggttacattttgaattgaagaatcgtatttttcatcatcataaccgcggatggaacaatgacattctcgattcttaacagactcaggaggcaatggtagctaataaagtgactacagcaaggcacgtgtctactacaggtgatgaggaaatgtgcgaatctgaacatgcattctgaaacatcaatcacagcgccttcttcttggcgtccttggccagccccttcttgcggatcttaatgcacatgcccaggcgcacgctgtcaataagggactcggaaagaatggagatcaagacccacacgacagagtgtggccagtatggtgtgcacctaggctcgtatccaatgtgacgaacggcagcacgagcataggtgtc

SEQ ID NO: 73445 - DNA, 202 bp, Zea mays
  Clone ID: LIB3078-032-Q1-K1-G9-R2A
ttttattacttctttaaccctttttcttatttttctattgtcttttatggcaccacaccaaatgccctcccccaccttaattaactctcgtacccccgctctttccccactcgcatcaaaaaacagaaagcaaaagcttgggtgcaccccattaagcccccccacagaaaaggcagaacccccacaacgggcgtacagggaa

SEQ ID NO: 73446 - DNA, 387 bp, Zea mays
  Clone ID: LIB3078-033-Q1-K1-B4
cccacgcgtccgcccacgcgtccgcggactcgtgggcgtgcgcgtagtccagccctcgggggagtacactctggtcagcggggatcatcgtgactccatatattgtagaactataatccctgctagtaatccatttgtgctgtttatgtatcgaaggcagcaaagatgtgtgaagcggcaatgggatgcttgctgtaaggtaatatgtttggcttgctaggcatgctacacgctatttggatgtagcaacgttatcaccagctgtatacgctttttaatcgacaacatttgaataatatgtacataacattatgttgtgctctgttctctgtctgtttgatgtgcttatgggttttgatctgtagcttaaaaaacaaaaaagatcaa

SEQ ID NO: 73447 - DNA, 491 bp, Zea mays
  Clone ID: LIB3078-033-Q1-K1-D5.F1
cttcgtgtctacaaaaaaataatcttataataacagtaagaactgacaaaacccctggttactcagaatagtgggagctaggaatctaagaataaaagagaagagaaaaaagtgaagggctaaaagaaacatagtcatacagagagcaccacgaatgacagggagggcagcgtcaataataaacaaacatcacctcagccctaccaagggactcagaattacatcaaggccctggatctgtaactctgttaagcctctaagtatcaattccacaatttacatgaagcacaaaaagataaatcctagaggaatctcctaggcaaaatgccaaaagaatcatgtagaactcaagccgatgtgtaactggagaatagcttcagcaggttgttcaaagattctgggtaaaactttctagcaaaaagatagcagggtctttttgttccattccacatacatggggtctgtgtcacaacttttttatcatcacttgt

SEQ ID NO: 73448 - DNA, 578 bp, Zea mays
  Clone ID: LIB3078-033-Q1-K1-D5.F2
cttcgggtctacaaaaaaataatcttataataacagtaagaactgacaaaacccctgttactcagaatatgggagctaggaatctaagaataaaagagaagagaaaaaagtgaagggctaaaagaaacatagtcatacagagagcaccacgaatgacagggagggcagcgtcaataataaacaaacatcacctcagccctaccaagggactcagaattacatcaaggccctggatctgtaactctgttaagcctctaagtatcaattccacaatttacatgaagcacaaaaagataaatcctagaggaatctcctaggcaaaatgccaaaagaatcatgtagaactcaagccgatgtgtaactggagaatagcttcagcaggttgttcaaagattctgggtaaaactttctagcaaaaagatagcagggtctttttgttccattccacatacatggggtctgtgtcacaacttttttatcatcacttgtaatgtgaacattctcattgacagacgttatgttctttaagagttgatatgtaacatctgcagctctatatgaccttggatgccattttc

SEQ ID NO: 73449 - DNA, 264 bp, Zea mays
  unsure at all n locations
  Clone ID: LIB3078-033-Q1-K1-D5.R1
cccacgcgtccgcccacgcgtccggcaactgtattgcggatgagcattatttggcaaccctctacaatatggtggaccctgggggaatagctaactggtcagtgactcatgttgattgggtccgagggaaaatggcatccaaggtcatatacagctgcagatgttacatatcnactcttaaagancataacgtctgtcaatgagaatgttcacattactagtgatgataaaaagttgtgacacagaccacatgtatgtggaatg

SEQ ID NO: 73450 - DNA, 637 bp, Zea mays
  unsure at all n locations
  Clone ID: LIB3078-033-Q1-K1-D5.R2
cccacgcgtccgcccacgcgtccgcgcaactgtattgctgatgagcattatttgccaaccctcttcaatatggttgaccctggtggaatagctaactggtcagtgactcatgttgattggtccgagggaaaatggcatccaaggtcatatagagctgcagatgttacatatcaactcttaaagaacataacgtctgtcaatgagaatgttcacattacaagtgatgataaaaaagttgtgacacagaccccatgtatgtggaatggaacaaaaagaccctgctatctttttgctagaaagttttacccagaatctttgaacaacctgctgaagctattctccagttacacatcggcttgagttctacatgattcttttggcattttgcctaggagattcctctaggatttatctttttgtgcttcatgtaaattgtggaattgatacttagaggcttaacagagttacagatccagggccttgatgtaattctgagtcccttggtagggctgaggtgatgtttgtttattattgacgctgccctccctgtcattcgtggtgctctctgtatgactatgtntcttttagcccttcactttttnctcttctcttttattcttagatncctagctcccat

SEQ ID NO: 73451 - DNA, 336 bp, Zea mays
  Clone ID: LIB3078-033-Q1-K1-D6
cgcggcctcggcccgatccagatgattctcctgggaagcgtgacaaactacgtgctgtgaaacgcatcgtgcccggtgacagtcgtcaaggggaagtagtggcctgggcagcgtgccagtgatatgaatgaagatgctagcgtgcagtttgtgtgggttatagctaaacactatgttccgtcctgttgctgcatttcaataaagcatgtgtcttctagatttcacaaatctctctgaggctctgacctttgtcttattagctgtgaaactgtccgtacttcattcctgttcagatcgaattcgaggattggttcatacccctttaaaaaaaaatta

SEQ ID NO: 73452 - DNA, 511 bp, Zea mays
  Clone ID: LIB3078-033-Q1-K1-F7.F1
gacaccaatgaagtatagataatattgtaaaagatgaggtccgagtgtccgacaccaatgaagtatagataaagcaagactaaacaaccatctacgcgaatttggcgagctcctcggcgaacgccagcatgaggttctcgacgcagcgacgatgagccggatgccgcgcttgggcgcgcggtttgaggtagatcaccgacgcgacgatgttgacgtcgtcgttgagcgtgaagacgtaccccggttcgccgaagccgtagtccacctcgttgaacccgacgcggctccagtccgacaccgtcaccgtgccgtagtccagcggcacgttgtagtggtcgtccttggcgccgcgcgcatccagtccgtgaaccgcgtggtgagcgcctccttggcctcccgcatcacgccgaccacctccggaagcgacgcctcacggatcgccttgctggtccgggtgatgcccacggggtacacgcaattgccgtagtagccgtccaccgacggagcacgc

SEQ ID NO: 73453 - DNA, 512 bp, Zea mays
  Clone ID: LIB3078-033-Q1-K1-F7.F2
gacaccaatgaagtatagataatattgtaaaagatgaggtccgagtgtccgacaccaatgaagtatagataaagcaagactaaacaaccatctacgcgaatttggcgagctcctcggcgaacgccgcagcatgaggttcctcgacgcagcgaagcatgagccggatgccgcgcttgggcgcgggcggtttgaggtagatcaccgacgcgacgatgttgacgtcgtcgttgagcgtgaagacgtaccccggttcgccgaagccgtagtccacctcgttgaacccgacgcggctccagtccgacaccgtcaccgtgccgtagtccagcggcacgttgtagtggtcgtccttggcgccgccgcgcatccagtccgtgaaccgcgtggtgagcgcctccttggcctcccgcatcacgccgaccacctccggaagcgacgcctcacggatcgccttgctggtccgggtgatgcccacggggtacacgcaattgccgtagtagccgtccaccgacggc

SEQ ID NO: 73454 - DNA, 333 bp, Zea mays
  unsure at all n locations
  Clone ID: LIB3078-033-Q1-K1-F7.R1
gccggacagcatcgcgcgcatcaaggacgacttcaaggacgcgacggggcagacctgctccaccgtcgacgctgtcacggcggtggtgttcaagtgccgcgctctggcgatggcgctccccgacgacgccgaggtccggctcggcttcgccgcagcacgcggcacctccttcaagacggctgcctcggtggacgctactacggcaaatgcgtgtacaccgtgcgcatcacccggaccagcaaggcgatctgtgaggcgtcgattccggagttgntcngcgtgatgcgggaggccaaggaggcgctcaccacgcggttcacgtactggatgcgc

SEQ ID NO: 73455 - DNA, 626 bp, Zea mays
  unsure at all n locations
  Clone ID: LIB3078-033-Q1-K1-F7.R2
gccggagagcatcgcgcgcatcaaggacgacttcaaggacgcgacggggcagacctgctccaccttcgacgctgtcacggcggtggtgttcaagtgccgcgcgctggcgatggcgctccccgacgacgccgaggtccggctcggcttcgccgccagcacgcggcacctcctccacggcgtgctgccgtcggtggacggctactacggcaattgcgtgtaccccgtgggcatcacccggaccagcaaggcgatccgtgaggcgtcgcttccggaggtggtcggcgtgatgcgggaggccaaggaggcgctcaccacgcggttcacggactggatgcgcggcggcgccaaggacgaccactacaacgtgccgctggactacggcacggtgacggtgtcggactggagccgcgtcgggttcaacgaggtggactacggcttcggcgaaccggggtacgtcttcacgctcaacgacgacgtcaacatcgtcgcgtcggtgatctacctcaaaccgcccgcgcccaagcgcggcatccggctcatgcttcgctgcgtcgaggaacctcatgctgcggcgttcgccgaggagctcgccaattcgcgtagatgggtgtntagtcttgctttat

SEQ ID NO: 73456 - DNA, 266 bp, Zea mays
  Clone ID: LIB3078-033-Q1-K1-H3
tcgcgcttccaagcccaaggaggagttgaagagcctcaaggagctcaccggcaagggcttcggcaccatcgacgatcgtgaccatgccgcgaagatcaagagcaccccagaggccgagaaatacttcgcagcaaccaaagatgctcttggcgatgttctcgccaagctaggctagacgcaagggctaataatggccatgtaatttcggacttgcgtttgttcatatggacccggcaaggcaatgtaccattttctgttgatattgt

SEQ ID NO: 73457 - DNA, 370 bp, Zea mays
  Clone ID: LIB3078-034-Q1-K1-B6
agcccttacaatatcatgttgcatcaattgatcacgaaaattcctcattgcaagaacaaaaggtcgaccacggcggatagaagcacaaatttgtcgcaataccaacaccccatgtcagcaggaggaaataacagcacattttgggacctaactctatagcttgaacgaattggtaccatcctatttcctgcttggcacgctccagaaaagcatcaaaatttctggacctgttcttgttgattcacagatcaagctccagccacctattctgcatcgccggcaccaaaaccgtcgtcttcgacttcgtcaaccttttgaggtgccacactaccttcgacagctgttgggtcatcatctccaaacttttcag

SEQ ID NO: 73458 - DNA, 578 bp, Zea mays
  Clone ID: LIB3078-034-Q1-K1-B6.F1
cattgttaactcagtattatcaaattctcaaaaccaacataattggtagaatggccacagtatcttctaacgtttcatagcccaaatcaaagaaatgttatcagcacaacaaataactgggaacatcacgaatgaagaatcaatcttcccgtcctctggtggataccttcagtctgcactgctaccttcaagggccctctggtcatctttcagtacttgcctcctgtcattaggttctgctgagttattatgtctttcatggtggtgccgatggtgacgatgatggtggtggtgacggtgatgattcttgtgataccttttgccatttcttatcttctctggtccatcatcatctctatcatctgatgactcctccaaggattggctcctgagatgcttatggctgttggaatctggccgagcattctcgtcacttgatctcagacgcttcccatgtctcaacctgaccttgtccgagccatcatcagaagactgatggtggcgtctgcggggctgaaatggtcctaggcagatctccgtcatcctcaacactgttgtcttcagagtccgaaattgaa

SEQ ID NO: 73459 - DNA, 578 bp, Zea mays
  unsure at all n locations
  Clone ID: LIB3078-034-Q1-K1-B6.F2
cattgttaactcagtattatcaaattctcaaaaccaacataatntggtagaatggccacagtatcttctaacgtttcatagcccaaatcaaagaaatgttatcagcacaacaaataactgggaacatcacgaatgaagaatcaatctttccgtcctctggtggataccttcagtctgcactgctaccttcaagggccctctggtcatctttcagtacttgcctcctgtcattaggttctgctgagttattatgtctttcatggtggtgccgatggtgacgatgatggtggtggtgacggtgatgattcttgtgataccttttgccatttcttatcttctctggtccatcatcatctctatcatctgatgactcctccaaggattggctcctgagatgcttatggctgttggaatctggccgagcattctcgtcacttgatctcagacgcttcccatgtctcaacctgaccttgtccgagccatcatcagaagactgatggttggcgtctgcggggctgagaatggtccttgggcagatctccgctcatcctcatcacctgtgtcttcagagtctgaca

SEQ ID NO: 73460 - DNA, 262 bp, Zea mays
  unsure at all n locations
  Clone ID: LIB3078-034-Q1-K1-B6.R1
acgctgcagtacggtccggactgccgggtcgaccacgcgtgcgccacgcgtccgtaaagctgatgcagaagcgaaggcgaataaactacaatcaagaacgcataggaggagaggagattcttcctcggactctgacagtgactatgacagcgatgttgatcggaaacaccggaggaggaaggatcgtagnaggaacaagaagcatgcagccttctgactctgatgatgccaggagacgcaagcataggtccagatagggctc

SEQ ID NO: 73461 - DNA, 609 bp, Zea mays
  Clone ID: LIB3078-034-Q1-K1-B6.R2
cccacgcgtccgcaaagctgatgcagaagcgaaggcgaaaaaactaaaatcaagaaagcataggaggagaggagattcttcctcggactctgacagtgactatgacagcgatgttgatcggaaacaccggaggaggaaggatcgtagaaggaacaagaagcatgagcattctgactctgatgatgccaggagacgcaagcataggtccagaaagggctcagactcaagtgatgagagcaaccgtgaatatgaaagcgggtctgaagaagaacgtacaaagaagaagcgttcgcacagaagaaagcatcacagacactcttcaatgtcagactctgaagacaacagtgatgaggatgagcggagatctgccaaggaccattctcagccccgcagacgccaccatcagtcttctgatgatggctcggacaaggtcaggttgagacatgggaagcgtctgagatcaagtgacgagaatgctcggccagattccaacagccataagcatctcaggagccaatccttggaggagtcatcagatgatagagatgatgatggaccagagaagataagaaatggcaaaaggtatcacaagaatcatcaccgtcacca

SEQ ID NO: 73462 - DNA, 590 bp, Zea mays
  Clone ID: LIB3078-034-Q1-K1-E1-N1
gaaacgaactcacaacaagtatccatggttaagtatcgcctccggctcggatagaaacaaacatactactagttcacaatcgcccacaaacgacaaagccagaactgataacgacaacatttacagccatacgtgctggcccttattgacggcgacgactgatctgatctcctttaggcagacgcagacgcaggcgcaggcgcagcatgcttctcgatctgggccaggagctcgtccttcctggcacccacgatggtcgcgaccgtcttgccgttcttgacgaagtggaaggtcggcatcgcctcgacctcgtaggccgcggtgacttccttcacttcgtccacgtccaccttcaggaacacgacctgagtgaacttcttggcgtgttcgacaaacagtggggcgatggcgcggcatggaccgcaccaggcggcagtgaagtcaatgaccaccagcttgccggcttcctgggccttggtcatgtgggcgtcaaactcagccttgctgtggcacgcgatcacgactccctgctcggacgccattgatctcttcttcctcggtgtcggtgagatcgaaagcttttgttcgtt

SEQ ID NO: 73463 - DNA, 185 bp, Zea mays
  unsure at all n locations
  Clone ID: LIB3078-034-Q1-K1-E9.R2
gacccacgctccggccggtttgatcgggcgctcaacgacgagggaaggacacaacggggcagaccngctccaccttcgacgctgacacggcaggggtgttcaagtgccgggcgctgggaatggcgctccccgacgacgccgaggtccgggtgcgggtcgccaccagcacgcggaacctcctacac

SEQ ID NO: 73464 - DNA, 353 bp, Zea mays
  Clone ID: LIB3078-034-Q1-K1-F3
aattccggcggcgacccactcgtgcggcttctagtacatcaaaggcgttttgttttatcctgtgccttttgacatctatgggtaggttttaactgcaacaatgaagaataagagaaagaatatgctgaactattaccagtctgagattgacacaatatacaaaaagctggaggcgcataacagtgctgccagagctaagtgaatagatgtgccctattcgaccatcatctgaaaacaagggaaacgacaccgttgtaaatttcacattaatattgcgaagtaacaactcatggctatgagtaaggaataaaatgtatattgtgcctttgtctataaaaaaaaaaaaaaacaaa

SEQ ID NO: 73465 - DNA, 141 bp, Zea mays
  Clone ID: LIB3078-035-Q1-K1-D1
gatacggctgctagaagacgacagaagggtacggctgcgagaagacgacagaaggatacggctgcgagaagacgacagaaggggagaaagagatagctttgtcacccacttattataataaataatatgtatgtcggcgct

SEQ ID NO: 73466 - DNA, 335 bp, Zea mays
  Clone ID: LIB3078-035-Q1-K1-D2
cggacgcgtgggcaagtacggcgcgaacgtctacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataatttggatgctatatatat

SEQ ID NO: 73467 - DNA, 313 bp, Zea mays
  unsure at all n locations
  Clone ID: LIB3078-035-Q1-K1-D8
ntcaaacctacgcacactaggtttttcgtttaacaaaacacnacanacnccggggcaagtgtacaattttaaagtcccctccgccatacaaccaccccctaactaaaactcaccacattatttcatcatcacaaactccaccaccaactcctcctccacaatctaatcctccaacttcatctccacatcatctaataacaacaaattttaattattaattaatacaatatttcactgaaactaatcaacataagcccatcataccattcactaatgttcaatccacaaatttaataaccacttcctctaccaa

SEQ ID NO: 73468 - DNA, 449 bp, Zea mays
  Clone ID: LIB3078-035-Q1-K1-G3.F2
gtgtttttttttttaattgttaactcagtattatcaaattctcaaaaccaacataattggtagaatggccacagtatcttctaacgtttcatagcccaaatcaaagaaatgttatcagcacaacaaataactgggaacatcacgaatgaagaatgattctttccgtcctctggtggataccttcagtctgcactgctaccttcaagggccctctggtcatctttcagtacttgcctcctgtcattaggttctgctgagttattatgtctttcatggtggtgccgatggtgacgatgatggtggtggtgacggtgatgattcttgtgataccttttgccatttcttatcttctctggtccatcatcatctctatcatctgatgactcctccaaggattggcttctgataatgctttggctgttggaatctggccgagcatttctccttac

SEQ ID NO: 73469 - DNA, 512 bp, Zea mays
  Clone ID: LIB3078-035-Q1-K1-H11.F2
acgggaatggagctctccttagtctttgttctcatgtacagtcgaaggaacacacaagcgtgctcagccaggcctggcctagccaagctctctacgtagtgcgtgcatcccatcccatcgaagaaataaaattacatcatcatgcgacgctgaaggaggaggcggccttctcgactcccttcctggcgcccttgaaccacctcttgtcgccggcctgcgccttgcagatgtagagcttgccgtcggagacggtggccgcgatgagctggtgcttgccgccctcgtcgccgtccgccgtcctggtgagcacggacacggcgtagtactgcttgccgtcgatcacgggggtggagctctccaggacgttggcggtggccacggcgccggtctcgaacccgccctcggagtcggtcttgccgccgtaggcctgcctgccgagcaggtagtcgacctgggagaggaactcctcgggagagccgtagtcggcgatggtcttcttgcggacgcgtggg

SEQ ID NO: 73470 - DNA, 513 bp, Zea mays
  Clone ID: LIB3078-035-Q1-K1-H11.R2
cccacgcgtccgcaagaagaccatcgccgactacggctctcccgaggagttcctctcccaggtcgactacctgctcggcaggcaggcctacggcggcaagaccgactccgagggcgggttcgagaccggcgccgtggccaccgccaacgtcctggagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgcctcctccttcagcgtcgcatgatgatgtaattttatttcttcgatgggatgggatgcacgcactacgtagagagcttggctaggccaggcctggctgagcacgcttgtgtgttccttcgactgtacatgagaacaaagactaaggagagctccattccccgt

SEQ ID NO: 73471 - DNA, 326 bp, Zea mays
  Clone ID: LIB3078-036-Q1-K1-D12.F1
gatcaaattcatgttggcatggtgcactatacaaataccaattattctgcagttgcactacttgtccaaattaaccaaactttgatcggatacatgacaagcacacacgcacgcacacggctgtctgtagaatacatcctcgacgaccgctcagaagaagttggggtcgtatccgttgctggaggtggcgaggatgtagtaggcgacgatgtggccgagcgagccccaggcgaggacgtcgacgaggttgaagcccacgggggtcgttggacttgaacaagggcgcgaactccttggcgcgctcgtcgccggcgtcgaagtgcgtc

SEQ ID NO: 73472 - DNA, 534 bp, Zea mays
  unsure at all n locations
  Clone ID: LIB3078-036-Q1-K1-D12.F2
gatcaaattcatgttggcatggtgcactatacaaataccaattattctgcagttgcactacttgtccaaattaaccaaactttgatcggatacatgacaagcacacacgcacgcacacggntgtctgtagaatacatcctcgacgaccgctcagaagaagttggggtcgtatccgttgctggaggtggcgaggatgtagtaggcgacgatgtggccgagcgagccccaggcgaggacgtcgacgaggttgaagcccacggggtcgttggacttgagcagggccgcgaactccttggcgcgctcgtcgccggcgtcgaagtgcgtcttgccgttctgcgcgggcacctgcttcgccacgttctcccgctggaagttgaagaagacgaagcggcccaggaagagcgacacgcccgtgctcaggctgatcaccagcgccgagctcagctccgcgcgcgccgccacggaccgccgcgccggcgccggcgccgcgcggaacgacacgcgcgcccggccgggagacggcgccaggcggag

SEQ ID NO: 73473 - DNA, 550 bp, Zea mays
  unsure at all n locations
  Clone ID: LIB3078-036-Q1-K1-D12.R2
ctccgcctggcgccgtctcccggccgggcgcgcgtgtcgttccgcgcggcgccggcgccggcgcggcggtccgtggcggcgcgcgcggagctgagctcggcgctggtgatcagcctgagcacgggcgtgtcgctcttcctgggccgcttcgtcttcttcaacttccagcgggagaacgtggcgaagcaggtgcccgcgcagaacggcaagacgcacttcgacgccggcgacgagcgcgccaaggagttcgcggccctgctcaagtccaacgaccccgtgggcttcaacctcgtcgacgtcctcgcctggggctcgctcggccacatcgtcgcctactacatcctcgccacctccagcaacggatacgaccccaacttcttctgagcggtcgtcgaggatgtattctacagacagccgtgtgcgtgcgtgtgtgcttgtcatgtatccgatcaaagtttggttaatttggacaagtagtgcaactgcagaataattggtatttgtatagtgcaccatgccaacatgaatttgatcaanaaaaaaaanaaat

SEQ ID NO: 73474 - DNA, 334 bp, Zea mays
  Clone ID: LIB3078-036-Q1-K1-D7
tagggctagtcccccttccttccatccattcatggcatgcgtcagcaccttccagagctgccccattgccagaagagcaaagatcaacaccaggtccaggggcagcagcagtagcgtggcgaaggggtcaccaccaccagccttccagttccagtgcagggcgtcgactttcgcggcggacaccatgcctcggctcgagctgtactagaacccctaggcgatcatcttggttgcttttctctttaacattttttttttttactactacgatttttttctctttacttcttattttcattaaactttcttttttattttgttctatttttttttt

SEQ ID NO: 73475 - DNA, 370 bp, Zea mays
  Clone ID: LIB3078-036-Q1-K1-G5.F1
gtcgaggtagaacagtagtaacatcaatgtattcgacacacacaaaaacatggatccaactaactccagtaggaccagtacaggcaaaaatgataatgcatctgattttcttctaatacaaatcccaccgccagatatactccattaactcgaagcactagaagagaccaagagggtctaatatcttatggtgacgcttaggcttaggaggtgttggcttgggccttgttgaggatcacaccctcgtacttgacctggaaccacttcatggcgtcttccttagtgaccctgtgctggatcccaacacgggacttgcacctgcggcgacgggcgacacggtacccagcacgctcaaggacgacgtagaagt

SEQ ID NO: 73476 - DNA, 370 bp, Zea mays; identical to SEQ ID NO: 73475
  Clone ID: LIB3078-036-Q1-K1-G5.F2

SEQ ID NO: 73477 - DNA, 181 bp, Zea mays
  Clone ID: LIB3078-036-Q1-K1-G5.R1
acttctacgtcgtcttgagcgtgctgggtacgtgtcgccgtcgccgcagtgcaagtcccgtgttgggatcagcacagggtcactaaggaagacgccatgaagtggttccaggtcaagtacgagggtgtgatccgcaacaaggcccaagccaaccacctcctaagccgaagcgtgcaccata

SEQ ID NO: 73478 - DNA, 370 bp, Zea mays; identical to SEQ ID NO: 70724
  Clone ID: LIB3078-036-Q1-K1-G5.R2

SEQ ID NO: 73479 - DNA, 369 bp, Zea mays
  Clone ID: LIB3078-037-Q1-K1-A6
acggccatgcatccgcccacgcgtccgctcgcgcgtctgcggactcgtgggctccaagtggtgcaagaaggaagagagggcgcatgatgatggaagatgaggatccattgatatgcactgtcactgaatcttttaagactctttcatgatgcaatcaagcagtcatcaccatcatccacagtccgataatcctaccgaacctatggactatgatgaaacagattcctgttgttgaaagagaacatatagctgactactatgtctacttgtgcgagaatacatcccttgcttatgccttcctagagatggaactagatgatcaaatggtatgggtgtctaggtacatcaagactcatctctgctgattga

SEQ ID NO: 73480 - DNA, 262 bp, Zea mays
  Clone ID: LIB3078-037-Q1-K1-B8
gaggtacaaccggtgaaggggggtgaggaagcagcaacaatggtaagagttctactactgagtgggggaaaaacaacttgcggctgggttagtgaagcttagtagctaccactattcaagagttaaagggagttcgtatgacagttcctctggagatgttatcttcaaagtcttatatcactgctacttgtgagctgtgttaaaacctatatatataagtcacgtttgacgtgactgcattaaagatagtacaaaaagaaaa

SEQ ID NO: 73481 - DNA, 636 bp, Zea mays
  Clone ID: LIB3078-037-Q1-K1-G4.F1
gttagactgcagtaagttcggttgtatcggtgtccagcaaatagaaaccgaagccgagccgatcttttcggttcgtaagaaaggaaaaccgacaccgaatcgaaaaaccgaaaaaaccttgattccagttcggctcggttttcggttgaaatgtgcctacccctagtgggtcccccccccccaagggatcagagatatcaacaccaccgaaaacaccaagtttgggcaaatcatcgtgtctcttagtcggcatccatctcctcaagagcagcctgggcagcagctttggcatgctccaacagttcatttggaaccttctgatgctggtggttcgattcatcgcagatccagctcaactccaactcgaaagctttatccttcgcttcgtcatgcactccataaattatctttgcaacttcaacaatgccttcccggcacgtaagctctgaaagtttcaacttttctatctcagtttttgcagcctgtctccccttccctaatgcagcaccaaagtatttataagaaactcctgagggttctatcatgtagagctgtgggccatccctatcataacctccaagaataacaccgcagccaaaagggcctgagcaccagtacagcgtgcaaagatgaaca

SEQ ID NO: 73482 - DNA, 589 bp, Zea mays
  Clone ID: LIB3078-037-Q1-K1-G4.F2
gttagactgcagtaagttcggttgtatcggtgtccagcaaatagaaaccgaagccgagccgatcttttcggttcgtaagaaaggaaaaccgacaccgaatcgaaaaaccgaaaaaaccttgattccagttcggctcggttttcggttgaaatgtgcctacccctagtgggtccccccccccccaagggatcagagatatcaacaccaccgaaaacaccaagtttgggcaaatcatcgtgtctcttagtcggcatccatctcctcaagagcagcctgggcagcagctttggcatgctccaacagttcatttggaaccttctgatgctggtggttcgattcatcgcagatccagctcaactccaactcgaaagctttatccttcgcttcgtcatgcactccataaattatctttgcaacttcaacaatgccttcccggcacgtaagctctgaaagtttcaacttttctatctcagtttttgcagcctgtctccccttccctaatgcagcaccaaagtatttataagaaactcctgagggttctatcatgtagagctgtggcccatccctatcataacctccaagaataaca

SEQ ID NO: 73483 - DNA, 568 bp, Zea mays
  unsure at all n locations
  Clone ID: LIB3078-037-Q1-K1-G4.R1
cccacgcgtccggcgaggccgccgacgcccgacggcagggtgcccaggccttcttcggtcccatcgcgaggccatagttgcatcattcgcctgagacgactgcccaccgccnaggactgatctcctcactaggcgcgtnagaggtgaagagaataacttgacaatgagcagcataggcacaggttacgatctgtctgtcaccaccttctccccagatggtcgtgtcttccaggtcgaatatgctaccaaggccgtcgacaacagcgggactgttgttgggatcaagtgcaaagatggcattgtcctgggtgttgagaagctggtaacctcaaagatgatgctggaagggtcaaaccggaggatccattcagtgcaccggcactctgggcttggttgttgctggtttagcagcagatggcaggcaaattgtttcaaggacgaatcagaagctgccagttatgaaaaggtctatggagaacccattcctgttaagaattggctgatcgtgtggcagttatgttcatctttgcagctgtactggtggctcagccttttggctgccgggtta

SEQ ID NO: 73484 - DNA, 617 bp, Zea mays
  unsure at all n locations
  Clone ID: LIB3078-037-Q1-K1-G4.R2
cccacgcgtccggcgaggccgccgacgcccgacggcagggtgcccaggccttcttcggtcccatcgcgaggccatagttgcatcattcgcctgagacgactgcccaccgccaggactgatctcctcactaggcgcgtagaggtgaagagaataacttgacaatgagcagcataggcacaggttacgatctgtctgtcaccaccttctccccagatggtcgtgtcttccaggtcgaatatgctaccaaggccgtcgacaacagcgggactgttgttgggatcaagtgcaaagatggcattgtcctgggtgttgagaagctggtaacctcaaagatgatgctggaagggtcaaaccggaggatccattcagtgcaccggcactctggcttggttgttgctggtttagcagcagatggcaggcaaattgtttcaaggacgaagtcagaagctgccagttatgaaaaggtctatggagaacccattcctgttaaggaattggctgatcgtgtgncaagttatgttcatctttgcacgctgtactggtggctcaggccttttggctgcngtgntattcttggaggttatgatagggatgggccacagctctacatgatagaa

SEQ ID NO: 73485 - DNA, 383 bp, Zea mays
  unsure at all n locations
  Clone ID: LIB3078-038-Q1-K1-A1
cggcgccaagctgttcggcatggaccaggttcagggcggcagcccctacggcgccggcacgttcgccgccgacggctcgaggtggccgagcgaggtggagctggagcacgccttccaccaggggaagtacttcgcaggcatcgccaagaagctcaagggttcagcctgatctacacatatacccttgtcggatatcataaaaaacacttattacagattcgtcttacccatcaatagatcggtctgttctctcgtggtgtctggatgttgtgtggctcagtggaactttcatgctacggtgactntgttgtaatctggagttggaatatncgtgtttcgcataaatttcgatgatttgctcaagtaaacggtttgtttggttc

SEQ ID NO: 73486 - DNA, 525 bp, Zea mays
  Clone ID: LIB3078-038-Q1-K1-A5.F1
aagatgtcaaggaacagtatcttctccatttcatttcatttcaatctcatccaatcagtcaaagctatacacagccattccctgctgccctgaacctctctcctgttcacttccactccaccacggcaaaaaaaatacaaaaaaattctcaaataaagactaccaccatgcttagcttccttccaatgtacaccaaactattttatagtttttataccccctgtaaaaaaactgcacgcatctccttcccttccaccacgcgccactcccctctgttcttcgcttgatcggggagggccctgcacacgaaacgctcgtcccctcactccccatcaccagtccaccaccaccaccaccaaattataaacagcccggacccgccatatattattctctagctagcttgcgttgctctcaccgttggcggcggagaagacgggcctgcttgtttgtgccctagccccaagctagcgtacgtacgagcccgggaagcactggccagaaggtggtgttcaccttgatcag

SEQ ID NO: 73487 - DNA, 274 bp, Zea mays
  unsure at all n locations
  Clone ID: LIB3078-038-Q1-K1-A5.R1
gtcgtcgccgtggcctggggctgctgctgctaacctnggccttggatgaacgagacggtgccggagaggtcgctgggttctggggctacctgctccagatcatctaccaggcaaatgcaggcgcggtgatgctcacggactgggtgttctgggtcatcatcttcccgttcctcaccgtgtaggactacagcctcaacttcctggtgatcgggatgcattcggtgaacgcatcttcctgctggggcaggcgcctggaatagcttgaggttcccgt

SEQ ID NO: 73488 - DNA, 618 bp, Zea mays
  Clone ID: LIB3078-038-Q1-K1-A5.R2
gtcgtcgttcgtggcctggggcctgctgctgctaagccggccttggatgaacgagacggtgccggagaggtcgctgggttctggggctacctgctccagatcatctaccaggcaaatgcaggcgcggtgatgctcacggactgcgtgttctggttcatcatcttcccgttcctcaccgagaaggactacagcctcaacttcctgttgatcgggatgcattcggtgaacgcagtcttcctgctgggcgaggccgccctgaatagcttgaggttcccgtggttccgggtcgcctacttcttcctctggaccgcgctctacgtcgtcttccagtggatcgtccacgcagctacgccgatgtggtggccttacccgttcctcgacctgacatcgaacctggcacctctgtggtacctcgcggtggcggcgctgcagctgccgtgctacgtggtgttctggctgctgatcaaggtgaagcaccacctgctggccaggtgcttcccggtctcgtacgtacgctagctaggggctagggcacaagcaggcaggcccgtcttctccgccgccaacggtgagagcaacgcaagctagctagagaataatatatggcgggtccgggct

SEQ ID NO: 73489 - DNA, 424 bp, Zea mays
  unsure at all n locations
  Clone ID: LIB3078-038-Q1-K1-B4.R2
cccacgctttcggcgaggccgccgacgcccgacggcagggagcccaggccttcttcggtcccatcgcgaggccataggtgcatcattcgcctgagacgactgcccaccgccaggactgatctcctcactaggcgcgtagaggtgaagagaataactcgacaatgatcatcataggcgcaggttacgatctggcngtcaccaccttctccccaaatggtcgtgtcttccaggtcgaatatgctaccaaggccgtcgacaacagcgggactgttggtgggatcaagtgcaaagatggcatttgtcctggctgttgagaagctgntaacctcaaagatgatgctggaagggtcaaaccgtatgatccattcattgcaccggcactctgactaggttgttgcttgtttaacagcagatggcaggcaaa

SEQ ID NO: 73490 - DNA, 217 bp, Zea mays
  Clone ID: LIB3078-038-Q1-K1-D7.F1
cgcatgcagcgtacgaattttggatcctagagcggcgccttttttttttttttttgaaccaataactgactagtcactagattagtctatgaagcaggtacagatagttgtgacacaagtggttagctaaagtctagcatcagaacagctagcagcattcggctttttctttgctaatgcactaaactaacggcatcgcgaaactaatatatcccct

SEQ ID NO: 73491 - DNA, 162 bp, Zea mays
  Clone ID: LIB3078-038-Q1-K1-D7.F2
gaaccaataactgactagtcactagattagtcaatgaagcaggtacagaaagttgtgacacaagtggttagcaaaagaaaagcaacagaacagctagcagcattcggctttttctttgctaatgcactaaactaacggcatcgcgaaactaatagatcccct

SEQ ID NO: 73492 - DNA, 165 bp, Zea mays
  Clone ID: LIB3078-038-Q1-K1-D7.R1
aggggatctattagtttcgcgatgccgttagtttagtgcattagcaaagaaaaagccgaatgctgctagctgttctgttgcttttcttttgctaaccacttgtgtcacaactttctgtacctgcttcagtgactaatctaggggctattcagttattggctctac

SEQ ID NO: 73493 - DNA, 162 bp, Zea mays
  unsure at all n locations
  Clone ID: LIB3078-038-Q1-K1-D7.R2
aggggatttatnagnnncgcgatgcgcggggtgnagngcattagcaaagaaaaagccgaatgctgctagctgttctgttgcttttcttttgctaaccacttgtgtcacaactttctgtacctgcttcattgactaatctagtgactagtcagttattggttc

SEQ ID NO: 73494 - DNA, 316 bp, Zea mays
  Clone ID: LIB3078-038-Q1-K1-F5
acgcagccggtttcgccaccagtccttactggtgatctgagaggtgacatggcctgtgtggatgacgttagaaagctcaaggtactggttaacgccgatactaatgatgatgcattgactgctccaaacactggggcacacggaattgcattatgcctgacagaacacatgtcctatgctatatactataggattaacgatatcatgcagattattatggctaccacgcttgatctgacgcatcaggcgctggaccgtctgttgccgcatcagatgtctgactataaatgcattttccgagctatggatggactta

SEQ ID NO: 73495 - DNA, 128 bp, Zea mays
  Clone ID: LIB3078-038-Q1-K1-H7
cttttgctggtctgctgagcttaatcatgcttttatacggcttgtacatgtggggagtcgtgattgatctgcaccgcgctaatacgttgtcttcgactgccctaataagtggcgcttatgaggactga

SEQ ID NO: 73496 - DNA, 540 bp, Zea mays
  Clone ID: LIB3078-039-Q1-K1-D7.F1
gtcacaaagcaatataaacaatataagcatttcatgagaaatggtagacagaaaatttatggcatacattgttatatagatccccttggtatacaaaattcctgtttactaacaaaattgagtgaccaaccataagcccaattggagtctaagcaactgatattaagatgattctatagaagtctgaccatattccaacaagctctcaaacaatggcgtttgctgcgtaagaatccctaggccaaagttcagcaaactccttgccgataggtccagtgatagcggaacctttcatctcacccttgggattcacaatcactccagcataatcttcgaggtacatgtagaccccgtccttgcggcgcaacggcttgcgctggcggacgatgacggcgggcataaccttcttcctgaggtcgggcttccccttcttgacggtggccatgaccatgtcgccaacgcaggcggacgggaggcgattgaggcggcccttgatgcccttgacggagatgatgtagaggttcttggcgccggtgttgt

SEQ ID NO: 73497 - DNA, 500 bp, Zea mays
  Clone ID: LIB3078-039-Q1-K1-D7.F2
gtcaccaaagcaatataaacaatataagcatttcatgagaaatggtagacagaaaatttatggcatacattgttatatagatccccttggtataccaaattctgtttactacaaaattgagtgaacaaacataagcccaattgcagtctagcaactgataataagatgatcatatagaagtctgaacatattccaacaagctctcaaacaatggcgtttgctgcgctagcaatcctaggccaaagatcagcacactccttgccgataggtccagtgatagcggaacctttcatctcacccttgggattcacaatcactccagcattatctttcgaagtacatgtagaccccgtccttgcggcgccacggcttgcgctggcggacgatgacggcgggcatcaccttcttcctgaggtcgggcttccccttcttgacggtggccatgaccatgtcgccaacgcaggcggacgggaggcgattgaggcggcccttgatgccct

SEQ ID NO: 73498 - DNA, 489 bp, Zea mays
  Clone ID: LIB3078-039-Q1-K1-D7.R1
gtcgaacgaggcaggggaggttcggcggggaacaagttccgcatgtcgctgggtctgccagtggccgcgacggtgaactgcgcggacaacaccggcgccaagaacctctacatcatctccgtcaagggcatcaagggccgcctcaatcgcctcccgtccgcctgcgttggcgacatggtcatggccaccgtcaagaaggggaagcccgacctcaggaagaaggtgatgcccgccgtcatcgtccgccagcgcaagccgtggcgccgcaaagacaggggtctacatgtactttcgagataatgctggagtgattgtgaatccaagggtgagatgaaaggttccgctatcactggacctatcggcaaggagtgtgctgatcttttacctaggattgctagcgccaaaacgccatttgccaaaaaccttgttgggataagttcagacttctataatatcatcatattaccattgctagactgcaatttggct

SEQ ID NO: 73499 - DNA, 646 bp, Zea mays
  unsure at all n locations
  Clone ID: LIB3078-039-Q1-K1-D7.R2
gtcgaagcgaggcaggggaggttcggcggggaacaagttccgcatgtcgctgggtctgccagtggccgcgacggtgaactgcgcggacaacaccggcgccaagaacctctacatcatctccgtcaagggcatcaagggccgcctcaatcgcctcccgtccgcctgcgttggcgacatggtcatggccaccgtcaagaaggggaagcccgacctcaggaagaaggtgatgcccgccgtcatcgtccgccagcgcaagccgtggcgccgcaaggacggggtctacatgtacttcgaagataatgctggagtgattgtgaatcccaagggtgagatgaaaggttccgctatcactggacctatcggcaaggagtgtgctgatctttggcctaggattgctagcgcagcaaacgccattgtttgagagcttgttggaatatgttcagacttctatatgatcatcttattatcagttgctagactgcaattgggcttatgtttgttactcaattttgtagtaaacagaatttggtatccnaggggatctatataacaatgtatgccataaattttctgtctaccatttctcatgaaatgcttatattgtttatattggccttggggacaaanaaaaaaaaaanaaaagggc

SEQ ID NO: 73500 - DNA, 412 bp, Zea mays
  Clone ID: LIB3078-039-Q1-K1-E2.F1
ggagaaataataattttacaaacaaggcgcttttaattatgttctactttaattttacagctcacacacatggacttgtactaaatattagcaaacaagtccattaggaacacacgatatgacacgacgtattgaggatttagtagacaataacttacaaacatcataggaggcatgcaagaaagtagagttagtaatagctaataagctccagcaatacctctttcctttaagatgttcctgaagcttcttcactgcatcctcgaggactctctctgaggcattacatatcttgttggcaagattaagaacactaaaatcatctgacacagttacccactttagtagatggaaatgctccttgacctcagggtccttgtagatgagctgagcgagggtggcggaccgtggg

SEQ ID NO: 73501 - DNA, 413 bp, Zea mays
  Clone ID: LIB3078-039-Q1-K1-E2.F2
ggagataataataattttacaaaaaggcgcttttaattatgttctactttaattttacagctcacacacatggacttggactaaatattagcaaacaagtccattaggaacccacgatatgacacgacgtattgaggatttagtagacaataacttacaaacatcataggaggcatgcaagaaaggagagttagtaatagctaataagctccagcaatacctctttcctttaagatgttcctgaagcttcttcactgcatcctcgaggactctctctgaggcattacatatcttgttggcaagattaagaacactaaaatcatctgacacagttacccactttagtagatggaaatgctccttgacctcagggtccttgtagatgagctgagcgagggtggcggacgcgtggg

SEQ ID NO: 73502 - DNA, 415 bp, Zea mays
  Clone ID: LIB3078-039-Q1-K1-E2.R1
cccacgcgtccgccaccctcgctcagctcatctacaaggaccctgaggtcaaggagcatttccatctactaaagtgggtaactgtgtcagatgattttagtgttcttaatcttgccaacaagatatgtaatgcctcagagagagtcctcgaggatgcagtgaagaagcttcaggaacatcttaaaggaaagaggtattgctggagcttattagctattactaactctactttcttgcatgcctcctatgatgtttgtaagttattgtctactaaatcctcaatacgtcgtgtcatatcgtgtgttcctaatggacttgtttgctaatatttagtacaagtccatgttgtgtgagctgtaaaattaaagtagaacataattaaaagcgccttgtttgtaaaattattattatctcc

SEQ ID NO: 73503 - DNA, 414 bp, Zea mays
  Clone ID: LIB3078-039-Q1-K1-E2.R2
cccacgcgtccgccaccctcgctcagctcatctacaaggaccctgaggtcaaggagcatttccatctactaaagtgggtaactgtgtcagatgattttagtgttcttaatcttgccaacaagatatgtaatgcctcagagagagtcctcgaggatgcagtgaagaagcttcaggaacatcttaaaggaaagaggtattgctggagcttattagctattactaactctactttcttgcatgcctcctatgatgtttgtaagttattgtctactaaatcctcaatacgtcgtgtcatatcgtgtgttcctaatggacttgtttgctaatatttagtacaagtccatgtgtgtgagctgtaaaattaaagtagaacataattaaaagcgccttgtttgtaaaattattattatctcc

SEQ ID NO: 73504 - DNA, 363 bp, Zea mays
  Clone ID: LIB3078-039-Q1-K1-F5
cccaggttcgaggccatgaagtcggccatcgccaccgcgtgagagaagactgccttcggctgcaggcttccttcgtggcgtcaagccttgaggcttgaacgaacaacgtacgtccatgtgcttatagtggcacagttatgtgtgtaactaccgatcgtggaacggcctaatgtatttcggttgcctcagatcgatctatatgtgcgtatacattatgtactgaaaagtgtgtagcgtctggttaatgtatgagcagtgtgtatgtgaccgggacccggtgtgtagttgctattactaccatatccggtgaatgatcaaaccttttggtgtattaaaactagatgttcatcccaaaaaaaagaa

SEQ ID NO: 73505 - DNA, 100 bp, Zea mays
  Clone ID: LIB3078-039-Q1-K1-F6
cccactgcgtccgcccacgcgtcctctttactcgtgggtgccagcagagcaccaccgggggggaccgatcaatggaggctggtggagcgtggtgcctgag

SEQ ID NO: 73506 - DNA, 239 bp, Zea mays
  Clone ID: LIB3078-040-Q1-K1-E9
acgcccacgcgtccgcgccgccgctgcagactccttcttttcgatcccttcacaaagcgccgccttgtccccattgaacatggctccgaagaaggataaggccccgcccccgtcgtcgaagcccgccaagtccggcggtggcaagcagaagaagaagaagtggagcaagggaaagctaaaggagaaggtgaacaacgcggtgctgttctaccaggctacctactacaagcttgctctct

SEQ ID NO: 73507 - DNA, 289 bp, Zea mays
  Clone ID: LIB3078-040-Q1-K1-G10
gtcgagcttacggtttatcgtggtctgtactttgggctctatgattccatcaagccagttgtccttactggcaagctccattacaatttctttgccagtttcgctctgggttggctgatcactaatggtgctggtcttgcatcttaccccattgataccgtccgcagaaggatgatgatgacatctggtgaggctgtcaagtacaagagctccttggatgcgttccagcagattcttaagaaggaagggcccaagtccctgttcaaggttgcttgtgctaacattcttc

SEQ ID NO: 73508 - DNA, 264 bp, Zea mays
  Clone ID: LIB3078-040-Q1-K1-G11
cccacgcgtccgtgcagactacgttcttggcggttgatagtttcccgctggcgattgttcgcctgtcagttcatgtacgtatgtatgtgtgtatgctactctgcggtggctaatgctttttctgatgcctctgtcgttgtgtgttcatcaccgtcgtgtgcgattgttctttgggttgtctttgcctcaataaaactgcttcattctccagtattctatagatgagtgctatgtactctgtacaacatagaacagagtacaaaa

SEQ ID NO: 73509 - DNA, 307 bp, Zea mays
  Clone ID: LIB3078-045-Q1-K1-B3
ccacgcgtccggacctaccagtttaaacactccaatgatgcaatctacaggaagaatcagagagacacttcaaaaatcaagacaaatagtaagcctattgtcgagcagtagtctattaactaaataaaatgctgtgtggagcatattataatcgcatattgccccaataatattgtgttgttaaacctgaggcttggtgattatctgatgagttgtaataatagccttggtcttcctgttgtatgtatgtatttgagctaaggaataaaaattgtggctttgtgggttaaaaaaaaaaaaaaataaa

SEQ ID NO: 73510 - DNA, 588 bp, Zea mays
  Clone ID: LIB3078-045-Q1-K1-C1.F1
aatggaaagaaaggcactgcatgattgtttcaacatgaacagaaggtaataatatcccttggtcacgattacagttcgttcgtgttaagtctgtactacggtactctggatgagctgttgagaaaatggtgtagcatccacaaccacaatcaagcagctggagatcacttcctcaggctttcgatgacgtatgagccatacaggtccatcgagtacttgattgcgttgatggcatctttcgctggcaggaactcattcactgcgacctccttgttttcgttctttttataatcttcaaaaaagcggcggatctcttgaaggcgatgcggtgggaggtccgtgatgtccgtgtagtgacggaattcagggtcatcagcacagactgctataatcttatcatctttctcgccctgatcgatcataggcatgagccaatagcacgagctcgcaggaaacacccagggacaacttgtttctgcatcagtatgaggacatccagggggtcgttatctcacagagtgtgcgttggatgaagccatagtatgtggggtaacaacagaggataagaacaggtccacttgatcagac

SEQ ID NO: 73511 - DNA, 587 bp, Zea mays
  Clone ID: LIB3078-045-Q1-K1-C1.F2
aatggaaagaaaggcactgctgattgtttcaacatgaacagaaggtaataatatcccttggtcacgattacaggtcgttcgtgttaagtctgtactacggtactctggatgagctgttgagaaaatggtgtagcatccacaaccacaatcaagcagctggagatcacttcctcaggctttcgatgacgtatgagccatacaggtccatcgagtacttgattgcgttgatggcatctttcgctggcaggaactcattcactgcgacctccttgttttcgttctttttataatcttcaaaaaagcggcggatctcttgaaggcgatgcggtgggaggtccgtgatgtccgtgtagtgacggaattcatggtcatcagcacagactgctataatcttatcatctttctcgccctgatcgatcataggcatgagcccaatagcacgagctcgcaggaaacacccagggacaacttgttcctgcatcagtatgaggacatccagaggggtcgttatcctcacagagtgtgcgtggaatgaagccatagttatttgggtaaacaacacaggaataaagaacacgggccacctt

SEQ ID NO: 73512 - DNA, 209 bp, Zea mays
  unsure at all n locations
  Clone ID: LIB3078-045-Q1-K1-C1.R1
cccacgcgtccgcccacgcgtccggatccggccttggcctggngcgcttggacagcagcagcagcagcattcgagctcgaggccgctccgccaccccgcaactcgccttgtcgcttcttcttctgtttcgccaccggggcagcgattccgcaatgggcgggacctgctgttctaaatgagcgtaaccctttcttcccatgtcccaagaa

SEQ ID NO: 73513 - DNA, 637 bp, Zea mays
  unsure at all n locations
  Clone ID: LIB3078-045-Q1-K1-C1.R2
cccacgcgtccgcccacgcgtccggatccggcctggacctggagcgctggacagcagcagcagcagcatcgagctcgaggccgctccgccaccccgcactcgcctgtcgcctcttctcgctttcgccaccggggcagcgatccgccatggctggacctgctgttctcaatgagcgtatcctttcttccatgtcccagaaacatgttgctgctcacccatggcatgatttggagataggaccaggggctcctgaattcttcaattgtgtggttgagattcctagaggcagcaaggttaagtacgagttggacaaggcatctggtctgatcaaggtggaccgtgttctttattcctctgttgtttacccacataactatggcttcattccacgcacactctgtgaggataacgaccccctggatgtcctcatactgatgcaggaacaagttgtccctgggtgtttcctgcgagctcgtgctattgggctcatgcctatgatcgatcagggcgagaaagatgataagattatagcagtctgtgctgatgaccctgaattccgtcactacacggacatcacggacctnccaccgcatcgccttcaagagatccgccgctnttttgaagattataaaaagaa

SEQ ID NO: 73514 - DNA, 518 bp, Zea mays
  Clone ID: LIB3078-045-Q1-K1-G2.F1
ataaaccctcaataatattgcttttggccttggcaaaatatcaagaagctaactaactcgatagcaaacatgttcagtaactgccgaattgtgttcacaaagaagcaaagccaaagtggcaatatcatacaaatatcacttaaaaattttagtaactactataatctaactgattcactttgcaattatactagacttccatctagctttgtccacgccatctagctttgtccacgtgctgcaggtactaacttgttgcgggtacaagatgagcttctagcttgcttcacatgtgtaattggccaaggaataacatagccaatagcatcaattagtgtacgaatctgattagatggtctaggtacctcctcatctataatattgccaagttcaatattttcaagggcttcaacaagaaccccacaatattttgggtcaagctttgctcctaatatttctctttggctaactgtagtcactaacttccctttggccacaaactctgccttggtttatca

SEQ ID NO: 73515 - DNA, 631 bp, Zea mays
  Clone ID: LIB3078-045-Q1-K1-G2.F2
ataaaccctcaataatattggcttttggccttggcaaaatatcaagaagctaactaactcgatagcaaacatgttcagtaactgccaattgtgttcacaaagaagcaaagccaaagtggcaatatcatacaaatatcacttaaaaattttagtaactactataatctaactgattcactttgcaattatactagacttccatctagctttgtccacgccatctagctttgtccacgtgctgcaggtactaacttgttgcgggtacaagatgagcttctagcttgcttcacatgtgtaattggccaaggaataacatagccaatagcatcaattagtgtacgaatctgattagatggtctaggtacctcctcatctataatattgccaagttcaatattttcaaggccttcaacaagaaccccacaatattttggtccaagctttgctcctaatatttctctttggctatctgtagtcactaacttccctttggccacaactctgcctttgtttatcagtgaaataaggtagacttgcttttgtcttgattctgatatgcccatgctggcagcttgaacccttcgagttctcatgttgtgcaatataggatcacttggcaaatctgtgacta

SEQ ID NO: 73516 - DNA, 592 bp, Zea mays
  Clone ID: LIB3078-045-Q1-K1-G2.R1
ggagccgaaggatcgcgtggatctcctgagtcgtcgcatcaggtccgatcccctacgattcgccggcggctcaacaaccagcaagctgccagagttccagatcggtcttggaacaattgttgtccagtctagtaatcttctttcacctcaggaaggacaacttgatggcaatgtagtcacagatttgccaagtgatcctatattgcacaacatgagaactcgaagggttcaagctgccagcacaggcatatcagaatcaagacaaaagcaagtctaccttatttcactgataacaaaggcagagttgtggccaaatggaagttagttactacagatagccaaagaaatatattatgagccaagcttggaccaaaattattgtggggttcttcgttgaaggccctggaaataattgaaacttggcaattattatagatgaggacgttcctaggaccatcttaatcatattcgttacactaatttgatgctattgggcaatgttattccttcgccaatttcacattgtaaacaagctaaaaactcatcttgttaccgcaacaagttagtacctgcagcacgttgacaagctaaa

SEQ ID NO: 73517 - DNA, 621 bp, Zea mays
  Clone ID: LIB3078-045-Q1-K1-G2.R2
cggacgcgtgggcggacgcgtgggttgcgagtcgtcgcatcaggtccgatcccctcgattcgccggcggcgccaccaaccagcaagctgccagagttccagatcggtcttggaacaattggtgtccagtctagtaatcttctttcacctcaagaggcacaacttgatggcaatgtagtcacagatttgccaagtgatcctatattgcacaacatgagaactcgaagggttcaagctgccagcatgggcatatcagaatcaagacaaaagcaagtgtaccttattttactgataaacaaaggcagagttgtggccaaagggaagttagtgactacagatagccaaagagaaatattaggagcaaagctcggaccaaaatattgtcggggttcttgttgtaggccttgaaaatattgaacttggcaatattatagatgaggaggtacctagaccatctaatcagattcgtacactaattgatgctattggctatgttattccttggtcaattacacatgtgaagcatgctagaagctcatcttgtacccgcaacaagttagtacctgcagcacgtggacaaagctagatggcgtggacaaagctagatggaagtctagtataa

SEQ ID NO: 73518 - DNA, 371 bp, Zea mays
  Clone ID: LIB3078-046-Q1-K1-C7.F1
ggcgccttttttttttttttaatactagaagtagagggcctggaagattaaaattcagggccaaaattaaccccagttattgataatccgggagggtggcacccaagaaacccctttgaaggtaatagaaaaagcaagttaaagcaagttgattgcctgggtacaaatctttgggtgaaacatttcttttcggtttaaagttgagatacagtagggttcggtttcaaaagcaagggaagtaacttgggggcaaacatccttaaaggggaagttttgctcttccccaatggcagattggaaagtcaaaacaagttccttccggttttggaacctttccttaatttgggcacaagagtctaataagttgggag

SEQ ID NO: 73519 - DNA, 464 bp, Zea mays
  Clone ID: LIB3078-046-Q1-K1-C7.F2
aatactagaaagtagagagacatgaaagcatagaaaatacagggtccagaatgtaaccacagataatgataagtcaggtaggtacgacacccagcaaccccttgcacgctatagcaaaagccagctcaagccaggtgaatgtctcggtagcaatcctttggtgatacacttcttttccgatttaagttgagatacagtagggttccgtctccaaagccaaggaagttacttggggccaacatccttcaacgcgcagatctgctcctcccccatcgcagactggacagtcacaacaagatccttcccgctttcgaacccttccttaatctgggccacaagagtctcatcagttgggagtctaagatcatccttagtgttgccatctgaagtaagaaggctcacaaatccatcctcagaaatatcaatcagctgatactcagcggacgcgtgggcggacgcgtggg

SEQ ID NO: 73520 - DNA, 464 bp, Zea mays
  Clone ID: LIB3078-046-Q1-K1-C7.R2
cccacgcgtccgcccacgcgtccgctgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtatt

SEQ ID NO: 73521 - DNA, 336 bp, Zea mays
  Clone ID: LIB3078-046-Q1-K1-C9.F1
attaattaattcaaacacatgagcacatcataaatagctttgatcgtcccattgagctatctatcctacactagacaaagattagcagcagcagttgcttatcaactgcgttgtccatcactccactccaagtattgcaggttgcagctgcttacagttgcaaatgcactccattccattccattccattctattctactacaatcagacgagtctctcttcctcttcctgtacaagtactccctggcatccatcacctttcaccaagtaccgtttcaagaagggcctcctcctcctccactagagctgtacggacgcgtgggcgagacgcgtggg

SEQ ID NO: 73522 - DNA, 335 bp, Zea mays
  Clone ID: LIB3078-046-Q1-K1-C9.F2
attaattaattcaaacacatgagcacatcataaatagctttgatcgtcccattgagctatctatcctacactagacaaagattagcagcagcagttgcttatcaactgcgttgtccatcactccactccaagtattgcaggttgcagctgcttacagttgcaaatgcactccattccattccattccattctattctactacaatcagacgagtctctcttcctcttcctgtacaagtactccctggcatccatcacctttcaccaagtaccgtttcaagaagggcctcctcctcctccactagagctgtacggacgcgtgggcggacgcgtggg

SEQ ID NO: 73523 - DNA, 117 bp, Zea mays
  unsure at all n locations
  Clone ID: LIB3078-046-Q1-K1-C9.R1
ccacgcgtccgcccacgcgtccgtacagctctagtggangacgaggaggcccttcttggaatcggtgattggtgaaaggtgatggatgctagggagtacttgtacaggaagaggaag

SEQ ID NO: 73524 - DNA, 335 bp, Zea mays
  Clone ID: LIB3078-046-Q1-K1-C9.R2
cccacgcgtccgcccacgcgtccgtacagctctagtggaggaggaggaggcccttcttgaaacggtacttggtgaaaggtgatggatgccagggagtacttgtacaggaagaggaagagagactcgtctgattgtagtagaatagaatggaatggaatggaatggagtgcatttgcaactgtaagcagctgcaacctgcaatacttggagtggagtgatggacaacgcagttgataagcaactgctgctgctaatctttgtctagtgtaggatagatagctcaatgggacgatcaaagctatttatgatgtgctcatgtgtttgaattaattaat

SEQ ID NO: 73525 - DNA, 491 bp, Zea mays
  unsure at all n locations
  Clone ID: LIB3078-046-Q1-K1-D2.F1
gcacttgctgaccatatcttttctttttgtactatacagcctgtcaacgcagagtgntgtctgttcatagataagganagcaaaatattaaccagcagtctggactctgctccatcggttctcatcgttgtcgatccggtgaatatagctgtaacggttttctctgatgtatgtcaccccagaccatataccacgaacaagaaggatgcttgcaaacaccatgcttccaaatgtgcagaccacctcgagaagacccttcaggatccataagaacgtcaggacaagcacgccattgaccgaaaacttcaccagctcggcggggacggaaggcggcacacggacctggcagcgcggcgcgcggncggtgaggccttcctgaatacggatgcaggaaccgggccagtaggtccaggctgcggtcctcgtcttcgtcctaatcttcatctgcgtcgtcttcgtcctcctcacttccgtcccggtaggacgcggcg

SEQ ID NO: 73526 - DNA, 592 bp, Zea mays
  Clone ID: LIB3078-046-Q1-K1-D2.F2
gcacttgctgaccatatcttttctttttgtactatacagcctgtcaacgcagagtgtgtctgttcatagataaggaaagcaaaatattaaccagcagtctggactctgctccatcggttctcatcgttgtcgatccggtgaatatagctgtaacggttttctctgatgtatgtcaccccagaccatataccacgaacaagaaggatgcttgcaaacaccatgcttccaaatgtgcagaccacctcgagaagacccttcaggatccataagaacgtcaggacaagcacgccattgaccgaaaacttcaccagctcggcggggacggaaggcggcagcacggacctggcagcgcggcgcgcgcggcgtgaggccttcctgaatacggagtgcaggaaccgggccagtaggtccaggctgcggtcctcgtcttcgtcctcatcttcatctgcgtcgtcttcgtcctcctcacttccgtcccggtaggacgcggcggcgcccgatagatcgccgacccaggggcgggcatctgggacgacaacgacggcgtcgggatgccgacgccgggcagcgcggaggcgtgtagcaggggagg

SEQ ID NO: 73527 - DNA, 634 bp, Zea mays
  Clone ID: LIB3078-046-Q1-K1-D2.R2
cggacgcgtgggcggacgcgtgggaacaaacctgcagatcccccatggcaggctccacctccctcgttccccttcccgtccccgcccctccatctcgccaccgcttccacacgtccacgtccgcatccccccgccacctgcgcccctcccctgctacacgcctccgcgctgcccggcgtcggcatcccgacgccgtcgttgtcgtcccagatgcccgcccctgggtcggcgatctatcgggcgccgccgcgtcctaccgggacggaagtgaggaggacgaagacgacgcagatgaagatgaggacgaagacgaggaccgcagcctggacctactggcccggttcctgcactccgtattcaggaaggcctcacgccgcgcgcgccgcgctgccaggtccgtgctggcgccttccgtccccgccgagctggtgaagttttcggtcaatggcgtgcttgtcctgacgttcttatggatcctgaagggtcttctcgaggtggtctgcacatttggaagcatggtgtttgcaagcatccttcttgttcgtggtatatggtctggggtgacatacatcagagaaaaccgttacagctatattcaccggatcgacaacgatgagaaccgatggagcagagt

SEQ ID NO: 73528 - DNA, 454 bp, Zea mays
  Clone ID: LIB3078-046-Q1-K1-D5.F2
aggaaagctttttatgatttcattttggcttttgtctggcaccgtccgaaggcattgaaacaaagattgcaagacctgttgttaaggccctcctccctcttacataagccgtcaagggaaatgatacagcaggtctaacaggcttcctcctgttgtgaaacaccaagccatgtcctgccacaagacagcaacacaacatgtccagccatgttattatctgtgaagccctgacatcctacaaatgagcggtctgttacatctcatgccagtgaataatcggaggaaaaaaatctctatgcttggaccacatacagatgaagaaacttccattacgcgagaccggcttacattcctggatcctgaacaagctgggcttcatatatatgcccctggagtaagacctatcatgggaggagactggcattacatgaacttgtcggatctgcacagcccc

SEQ ID NO: 73529 - DNA, 465 bp, Zea mays
  Clone ID: LIB3078-046-Q1-K1-D5.R2
cttacacatatgattggacgatacaggagaaaaggttaagtcgacgctggagacttattaccaaaatatcgaggccttgctatcaacatatgagaacattattgtcaaagtgcaaggagatgccacagaggatgctgtcttagctaagatcgacgagctgctgggttctatcctggagaaggaaaatgaaatggcttccagcacatgagcaagggaaaaatgattgggtgcagcgcagatcccacaagtccatgtaatgcatgtcacctttcatgataggaacttctccaggggaatatatctgaagcacatgacgacacgtacaaggaatgtaagccagtctgacgtaatggaaatctctccatgtggatgtgggcaaagcataggattctctttcctacaattattaactgtacgcgattggaagcgacagatcattcgtaggttgtgagggcttgagagatc

SEQ ID NO: 73530 - DNA, 599 bp, Zea mays
  Clone ID: LIB3078-046-Q1-K1-E10.F2
aatgcaatgaaatcgatccatactatacattacatggtacatacatacacagaaaagaaagaaaaaaaacagagaggaacaccccatctggttcacgcacgttacccagaagaaaccaccaacacagacagtagattgctgctacgctcttctttcgcctccaatctgcgaggcaaggcgtctgatccgctgcagccgtacgtccctaggagctcacccaccccacgcaatcgagaactgactcgttcgccggcagcatgcaaatcataggccgagcgcgccgagcggcgtcttgccctgcccggcctcgaagtagaaggcgagcatggcaagcatggcgatgcgggcgtgcttgatctcggccagcttgagccgctcgagcttgtcgacgtcggggatgtagacgccgtccttgacggtgccggcgaggccgagcgggtcgaagaacttgccgcccgggtagccctgctcgccggtgaagttagcgaagttctcggcagtgcgggaccagggcgtggcccactccacggcctgggagtccgggttgaagaagtccacccaccgcttcgactccacccaccccatcagcagcagctgcg

SEQ ID NO: 73531 - DNA, 599 bp, Zea mays
  Clone ID: LIB3078-046-Q1-K1-E10.R2
cgcagctgctgctgatggggtgggtggagtcgaagcggtgggtggacttcttcaacccggactcccaggccgtggagtgggccacgccctggtcccgcactgccgagaacttcgctaacttcaccggcgagcagggctacccgggcggcaagttcttcgacccgctcggcctcgccggcaccgtcaaggacggcgtctacatccccgacgtcgacaagctcgagcggctcaagctggccgagatcaagcacgcccgcatcgccatgcttgccatgctcgccttctacttcgaggccgggcagggcaagacgccgctcggcgcgctcggcctatgatttgcatgctgccggcgaacgagtcagttctcgattgcgtggggtgggtgagctcctagggacgtacggctgcagcggatcagacgccttgcctcgcagattggaggcgaaagaagagcgtagcagcaatctactgtctgtgttggtggtttcttctgggtaacgtgcgtgaaccagatggggtgttcctctctggtttttttcttccttttctgtgtatgtatgtaccatgtaatggatagtatggatcgatttcattgcatt

SEQ ID NO: 73532 - DNA, 231 bp, Zea mays
  Clone ID: LIB3078-046-Q1-K1-E5.F1
gaaggaaaaatctgtataaaatatggtccaattccattcaatgacataactaggcagtatccccctctccttatggctacatcccagccaacaaaagcatgccaccctcccaaccccccaaaaaaatcccccagcaacaattaattcgattattgcaacacaataattggaaagctaaggtaaaaaattgtaacagacttgtctctactaaaaccatctaccatggtgcga

SEQ ID NO: 73533 - DNA, 576 bp, Zea mays
  Clone ID: LIB3078-046-Q1-K1-E5.F2
gaaggtaaaaatctgtataaaatatggtccaattccattcaatgacataactaggcagtatccccctctccttatggctacatcccagccaacaaaagcatgccaccctcccaaccccccaaaaaaatcccccagcaacaattaattcgattattgcaacacaataattggaaagctaaggtaaaaaattgtaacagacttgtctctaccaaaaccaactaccatggtgcgaaagcagctggaatgttattacagagtcaagcagtaatagcatagaactgtcaaccctgtatccgtccgatgggaatcctatatgccgatcttcttctcaaacttctggatctgattcaagaatatccaggtcatcatgacatggggtgcaatcctgacgcagtacaccgggaaaccagtgtagaacttgaatgggccaccgctcttgaaggtcttcacagcacagtccaaagaccctgtgtatgggtacttgccattcgcatcaggttgcatcttctgaatctgtgtcttcacatagtcaaagggcaaactgcatgctgaggcaaagaatccagaaacagcgct

SEQ ID NO: 73534 - DNA, 188 bp, Zea mays
  Clone ID: LIB3078-046-Q1-K1-E5.R1
cccacgcgtccgcccacgtgatcgcacatgcgtccgcctacgcgtccgcccacgcgtccggacggtcaagcccttcgttaacggcggggcctcggggatgctcgcgacctgcgtcatccagcctatcgacatggtcaaggtgaggatccagctggggtgaggcctctgctggtcaggtcacaaggaac

SEQ ID NO: 73535 - DNA, 612 bp, Zea mays
  Clone ID: LIB3078-046-Q1-K1-E5.R2
cccacgcgtccgcccacgcgtccgcccacgcgtgcgtccatgcgtccgcccacgcgtccggacggtcaagcccttcgttaacggcggggcctctgggatgctcgcgacctgcgtcatccagcctatcgacatggtcaaggtgaggatccagttgggtgagggctctgctggtcaggtcacaaggaacatgcttgcaaatgagggtgtccgttctttctacaagggtttgtccgccggattgctgaggcaagcgacgtacacgactgctcgtcttggatcctttagggttctaactaacaaagcagttgaaaagaatgaagggaagccattgcctctatttcagaaagcttttattggtctgactgctggtgcaattggtgcttgtgttggtagtcctgctgatctggcactcattagaatgcaagccgattcgaccctgccagttgcacaacgacgcaactataagaatgctttccatgcactctaccgtatcagtggtgatgagggagtccttgcgctttggaagggtgcaggtccaactgtggtgagagctatggcactcaatatgggtatgcttgcttcctatgaccagagtgtcgagctatttaggga

SEQ ID NO: 73536 - DNA, 484 bp, Zea mays
  Clone ID: LIB3078-048-Q1-K1-C4.F1
atataaattatatattacccaataagtcaacaggtccattttcatagactcccagccataggagtacacttaattattgggtgacaatgaaatgtagaaactacagtacaggaccaatgcttgtttcagcatttatatatatatacgagtacacgtgttgtacatctaggcatacaactatacatgccataacgcccatatgtcccaaccatccaagcgtacaacagtgcttattgagctgtctaatagatgcatacatactacatctgtggtcttgtctggactacatagatttttccatccttcactactccctcgacgtcctgaggagaaccgtatagctcctcgatggcatggccagcccgtgctatgcttgagaggattgagcttcggaatccacggtctactataagagggtcagttgtgtattcagtacaactcatcctcctcatccatgggaacgctatcatataatccctgccca

SEQ ID NO: 73537 - DNA, 625 bp, Zea mays
  Clone ID: LIB3078-048-Q1-K1-C4.F2
atataaattatatattacccaataagtcaacaggtccattttcatagactcccagccataggagtacacttaattattggtgacaatgaaatgtagaaactacagtacaggaccaatgcttgtttcagcatttatatatatatacgagtacacgtgttgtacatctaggcatacaactatacatgccataacgcccatatgtcccaaccatccaagcgtacaacagtgcttattgagctgtctaatagatgcatacatactacatctgtggtcttgtctggactacatagatttttccatccttcactactccctcgacgtcctgaggagaaccgtatagctcctcgatggcatggccagcccgtgctatgcttgagaggattgagcttcggaatccacggtctactataagagggtcagttgtgtaatcaagtacaacctcatcctcctcatccatcggtacgctatcatataatcctgctccagcataaccttccaggtcctcaccgttggagtcggaacggaagatgattgattgccttatgaagagaccaattggcttgcttgggtaaccaagtaacttgggagagtcaaggtcatcttttttgcaacaaagctatagcac

SEQ ID NO: 73538 - DNA, 117 bp, Zea mays
  Clone ID: LIB3078-048-Q1-K1-C4.R1
tgatcctgttttaaggaatgttgctcacctcgcaagttggcaggttataagccggttgaagtatcaggttatgtggttgaggatgatgacttatttgcggtccagaacaaatcttat

SEQ ID NO: 73539 - DNA, 646 bp, Zea mays
  unsure at all n locations
  Clone ID: LIB3078-048-Q1-K1-C4.R2
tgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctcaaaggaaaagtaccttcatgggtcggtgtcccaacgtcagttgcgataccatntggcacttttgagaagggtttgtcagatgggcttaataaggaagtagcacagagcatagagaagctt

SEQ ID NO: 73540 - DNA, 191 bp, Zea mays
  Clone ID: LIB3078-048-Q1-K1-D6
ctgacatttgccattaatgtatgttgtttggtatgttattcctaagaattcctgggggattggaacgtactgtataaaccgtggtatccgagcttcatgtttgcttgatgcttatgcaaattgaaggttgaataagtgtcagtttcaccaaattataaaactaaaaaaaaataaaagaaaaaaaaaaaata

SEQ ID NO: 73541 - DNA, 386 bp, Zea mays
  Clone ID: LIB3078-049-Q1-K1-F7
ggaacttcctcggcgagaagaaggtcagaaaggtggacatgcttgacggcgtgaccatccgtccgctccgagaaggtcaaggacgagcttattctcgatggcaacgacgtcgagttagtctctcgctccgccgccctcatcaaccagaaatgccatgtcaagaagaaggatatcaggaagtttttggatggtatctatgtgagcgacaagggtgtgatcgaagaggagcagtgagggacaattagttgttatcgtttgagttggaattattgtttggtttgcaattttctcaaggtgaactttgtaatcggttaggatgtgttgtggaccattatcttatcctacaatattatcgtatctgcttaagaatatgaagcttgtttatc

SEQ ID NO: 73542 - DNA, 282 bp, Zea mays
  Clone ID: LIB3078-049-Q1-K1-F8
gttgatgctcgcggacgccgtgtgcgttgtggaggtggtgaatggcgacggggcccagggggcgctggtctggaccgagctgctggagccggacgtgaagccccccgtgctgagctgatgaggtggcgtggaagccgtgatctggacgcgactctttaggaacttcgattttgtcgtcgcctgctatatatcattgccgagatcgtagtgtgtaaattatgcactcgctccgtggctatatccaacacagcgagccagtcaggaacgaacactattttgccg

SEQ ID NO: 73543 - DNA, 316 bp, Zea mays
  Clone ID: LIB3078-049-Q1-K1-H7
ctagcctggaattgttggaaggaaaggagcttccgggagttgttgccttgaatgaagccgccactgtgactgtatgaagcatgctttcattttgtttcgtcttcgtcttcatgtgccgttgtatacttgctacattctcgcttgcacctccccagccgctcgctcgaaatgtaagagaccaatgttttatagagccaatggaaatcgtttgaacaacgacgacccaaatagtatgtgctttaccgagtgatctttcctcggtaacgtaactagtgatataaaaaacattcaaaggcaaaaaaaaacaacatgaaaa

SEQ ID NO: 73544 - DNA, 457 bp, Zea mays
  Clone ID: LIB3078-050-H5-F1A
aattccaacttccaaggcggtagtattatactagtagtagccaaatcggcacattgtgtgcagggaggaaaaactatacaattcttccaccaggatataatggaatttaagaagtggcatttgaatttcagaaacagaaccagcagtgtaagtctgacaatcagccaatgtttgaagagcggcttggtgctaccgtctaatctacgcgtttcagacttccaattctcttcatacaaactgcaggccaacaaatgcatgatcacccagtttgctcactgagcccttctttcctttggaatttggagcattatgcagccacaaccactgcgcctcatccggcaacgactgcggacgacctgctcatctgcaaccaagaggccaggtcatctcttgaactgatgaagctgccggcttgagattcgctcgcatggaatggcaccgccatttggtccagatg

SEQ ID NO: 73545 - DNA, 415 bp, Zea mays
  Clone ID: LIB3078-050-H5-R1A
cccacgcgtccgcagaacctggtcaagctgatcagagtgctcggcgacgcccaggtcggtggtgccgatatcacagaggagctgaagagcgtgctgaacagcggctgccccatgacgtacgccgtccttactgcaactgtctgatcgatgtatgccgcaaccacggcttccctccacagagggcaagggaagtcttccaccttgcccagacctatggtttgtactccaagcttcagagcaggaaggacgaggagtggtcgctggacctgcggtcgctctcggttggtgcagccaagacagcgtttgatgactggatgcagactgtctcggagcgctgggcgcacaggaaggacttgccagagatccttcagcgtgtagagcaggtccagcacccacaagtttgcgcaggggctgg

SEQ ID NO: 73546 - DNA, 486 bp, Zea mays
  Clone ID: LIB3078-051-F7-F1A
gctcagaccacatggaatttttatattttcaatttatttcaaaatgttcaatgaattagactgaatatgtacagcttaagattattcccgacatctccggggcaccccccctctacatgttgtacaaaagaaacaatacaggagttccaactacaaaatcgtccactcactctcgtcaaatggccctggcgaagaagatgaagtggatgccggtggcacctccgacgatctcacattcttctttgaaaatatgctgaccttcttgtcaaaaaggttggagaatatcttcgtgttcttttcctctgacgtattcttctcgaccttttgagaaatcttgtcatcctttgtcgtgcgcttccagagcggcgggcgatctttggccataaagttgagcttcagcgtgaagcggtttttattgtcaacagacttctcatcaggttgctccatgatctggagagcttcttcagggtgggttactatggcttc

SEQ ID NO: 73547 - DNA, 466 bp, Zea mays
  Clone ID: LIB3078-051-F7-R1A
gcgagatgtatgcaagacataatactggtgattatgtccttcgacttggtgctgaccagtcatctgagaacttaacattgctggaaactggtgagcctatctattccccgacactgcaggaaggccccatcatgacagcagagcttataacagacacagaggagctagtgttacggacaggaagtcttggtgctggatgctctcaacttctatcagatatgcaggctttcaaggcagcaaatcctggttgtgtcctggaagactttgttagatggcactctccacccgattggtctgaggattgtactgcaaacagtaccacagttggggaaggctcatctagacgtgggcggttaagtgataggatgcaaacaaaagacggtaacttgtggaaggaactgtgggaggctgcaaaacctatacctgctgttgaacagactcctatatatcatgaagatttagctgg

SEQ ID NO: 73548 - DNA, 490 bp, Zea mays
  Clone ID: LIB3078-051-G4-R1A
tagaaaaaacacggtatgatagagggacataactagtcagaagtcgtagacgtttatggttggtgcagtcgtggtgggtaggtaagggattgtccccgatgtgttgtgagggtccagttgcgtggatggtttgcgtacatagttgcgttatgcggtcagattccgttgctgcgtgctggagggctgcaaactttcaaaactaggctgcaaggtggtgtctatattgtgaggctgaggagctgaaatgatttcaatcgttgattatgcatttcagcggaggaacacaacggcagaaaaagcaattgttagttgaactgtactcccctggacttcagctattcaaggatctgactgtgcaaagttcctcctgatacaatttccaagcttgggttgcagatagcatctgtcctgctgcatatgactattgtgattgataaaatcttggagaaaggtaccgttgagtacttaatagtgcacacggccatattgg

SEQ ID NO: 73549 - DNA, 216 bp, Zea mays
  Clone ID: LIB3078-051-Q1-K1-G8
gtcctgctggagctgccaccaggcctggatgtaagaactaggagttgcaggaaagcggagtatgacccaagaagagacctcactacaactgactggcccagtggccctgctgcgcagcaattaggggtcagcatacgaagcgaaacaacagatgatatgcatggatatgcacaaaactgtaataagagattgttatttcaagaacatacgacaaaa

SEQ ID NO: 73550 - DNA, 348 bp, Zea mays
  Clone ID: LIB3078-051-Q1-K1-H8
gtggcggcgagcgcgggcggggcggcggcgcagcagtgcagcgcggcgcagctggcggcgtgcgccccggcgatcatcagcgggtcgccgcccacggcgtcgtgctgctccaacctgcgcgcgcaggagccgtgcttctgccagtacgcgcgcaacccggcgtacagcagctacatcaacagccccaacgcccgccgcacgctcacctgctgcggcatcgccgtcccgagctgctagggcgctagctcgtgcctcgtggtgtggatgaataaaaagatgcatgtcgatctctgcttactgttatcgtatctgtagtacctcgtgtgatatgaacaatatgtattattt

SEQ ID NO: 73551 - DNA, 161 bp, Zea mays
  Clone ID: LIB3078-052-C2-R1A
aaagcaaaaaaaaataaaaaaaaaaaaagtaaatgagataaaaaaataaggagaaattaagaataaaaatagaaaaagaaaaaaaaaggagaaagaatagaaaaagaaaataaaaaaaagaagaaactaaagaaaattaaaaataagagacaaaaataaaa

SEQ ID NO: 73552 - DNA, 372 bp, Zea mays
  Clone ID: LIB3078-052-Q1-K1-A4
cccacgcgtccgagattgagaagtctaccttcagcatcttcccacttcaaaacgtctggatgcgcaaggtgaagatactcaaggcccccaagttcgatcttgggaagctcatggaggttcatggcgactacaaagaggatgttggtgtgaagcttgagaggcctgtcgagggagatgaggctgtgcaggaggttgctgctgccgagtagtttgtttgctacttctatatctaggctgagtctggacatgaggttgcttatgacgtgaacttagagttgtctacttgttttcatccgcccctaagattttgtctggaaacaagtttaaaattaagattattctcaacaagtgtttaagattaaaaaaaactaa

SEQ ID NO: 73553 - DNA, 361 bp, Zea mays
  unsure at all n locations
  Clone ID: LIB3078-052-Q1-K1-A5
gccgacgaccctgaggccttcgcggagctcaaggtgaaggagctcaagaacgggcgcgtcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgagggggtggaggcgccaccgtccaccggccaccgctgcggatatctaggtgttcggatgcacgtgagcgcgcactggttccagtttgtaccatgatgtaaattacttaccgtaccagggttcaatcggcaaggaagaattgttgtgttcaaaaaanaaata

SEQ ID NO: 73554 - DNA, 333 bp, Zea mays
  unsure at all n locations
  Clone ID: LIB3078-052-Q1-K1-C9
gcgtgtcaacaaagtttagtcacatcggctactgcaangttaagtgaagacattgtcaaccaatgtgtaaatcccatcttgaaaggataatcttctacaacaagagtcactaagcttgctgcattggcagctctatgtgcacaatacgaatcagagttcatgcccaacatgagcatcgttgttaaagcgctttcgcctctccttcaacaaagacctgcaccaaccaccgaatagccagctccacaacctgggagctcataccattcacatgtccatgcacccctaggcataagccatctccgaaaccattcaatcagcacattctataaatca

SEQ ID NO: 73555 - DNA, 210 bp, Zea mays
  unsure at all n locations
  Clone ID: LIB3078-052-Q1-K1-C9.F1
gagaaacttcgaaccaactgcatataccattgtgcggcgcaacatcaagccacgaactaggtggccacaaacagcaggggcaagttcatgtatgctatacccaactgagaacgctacagaacaaataccccaaaatannctctcaatgatttatagaaatgtgctggattgaatggtttgcggagatggcttatgcctaaggggtcccat

SEQ ID NO: 73556 - DNA, 474 bp, Zea mays
  Clone ID: LIB3078-052-Q1-K1-C9.F2
aaaaaaacttcgaaccaactgcatataccattgtgcggcgccaacatcaagccacgaactaggtggccacaaacagcaggggcaagttcatgtatgctatacccaactgagaacgctacagaacaaatacccaaaatactctcaatgatttatagaatgtgctgattgaatggttgcggagatggcttatgcctaggggtcccatcacatgtgactggtttcagctcccaggttgtggagctggctcttcggtggttggtgcaggtctttgttgaaggagaggcgaaagcgccttaacaacgatgctcatgttgggcctgaactctgcttcgtactgtgcacatagagctgccactgcagcaagcttagcgactccctttggaggatattctcccttcaacctgggatctacacattgcttcaccttgtcttcacttaaccttggagtagcccatgtgactaaactttgttgac

SEQ ID NO: 73557 - DNA, 115 bp, Zea mays
  Clone ID: LIB3078-052-Q1-K1-C9.R1
acgcctcgcgggccggtccgaggtcaacacatttatcaatgggctactccaggtaatgagaaagtcagcatgtgttgatccaggttgaagggagaatatcctctaaagggagtcg

SEQ ID NO: 73558 - DNA, 474 bp, Zea mays
  Clone ID: LIB3078-052-Q1-K1-C9.R2
ggtcagaaagtttagtcacatgggctactccaaggttaagtgaagacaaggtgaagcaatgtgtagatcccaggttgaagggagaatatcctccaaagggagtcgctaagcttgctgcagtggcagctctatgtgcacagtacgaagcagagttcaggcccaacatgagcatcgttgttaaggcgctttcgcctctccttcaacaaagacctgcaccaaccaccgaagagccagctccacaacctgggagctgaaaccagtcacatgtgatgggacccctaggcataagccatctccgcaaccattcaatcagcacattctataaatcattgagagtattttgggtatttgttctgtagcgttctcagttgggtatagcatacatgaacttgcccctgctgtttgtggccacctagttcgtggcttgatgctggcgccgcacaatggtatatgcaggtggttcgaagttttttt

SEQ ID NO: 73559 - DNA, 455 bp, Zea mays
  unsure at all n locations
  Clone ID: LIB3078-052-Q1-K1-H1-F2A
gcgcggacgcgtgggcgccgccactcaccagcaaattcccaagcctgcccttcccccatctctttcgcgccccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaagctcgccgccgaggcagccaagctcgcccgctacaacaagaagcccaccatcacctcccgggagatccagacctcggtgcgcctcgtnctccccggcgagctcgccaagcac

SEQ ID NO: 73560 - DNA, 397 bp, Zea mays
  Clone ID: LIB3078-052-Q1-K1-H1-R2A
actagcaagattaatatattagaaaacttcaacaggggtaactgattcattcagcaattataacaaattctacattgttgcacgaacaacctagcacagtcctaaatatgagaaaatttagcaacgtgcggcggcggcggcaccctaagaggatgtaaacttggtaaccgccttggtcccttcggagacggcgtgcttggcgagctcgccggggaggacgaggcgcaccgaggtctggatctcccgggaggtgatggtgggctttttgttgtagcgggcgagcttggctgcctcggcggcgagcttctcgaagatgtcgttgatgaaggagttcatgatggacatggccttggacgagatgccaatgtccgggtgcacctgcttgagcaccttgaag

SEQ ID NO: 73561 - DNA, 332 bp, Zea mays
  Clone ID: LIB3078-052-Q1-K1-H10
gcgcttgctttgtactgctttctccggtccatccggctcaatcgtcatgggtcatctttcgaaccttttgatacccctttcataatttggtatatttgccattcaaaaaatacttttgccttccaatgcaaagtttgaaaaggctcgtcgacagatttgggtggtcgtagccaaacgcacgccgacagactgttcaacaagtgcattcctttatttgttttactattctcgttgcatgcctgtatatgcattgtccggtgtctccttaaatttcacttgtactttgtgtgattttgtatcaaactattctctttttttgagattccattatt

SEQ ID NO: 73562 - DNA, 588 bp, Zea mays
  unsure at all n locations
  Clone ID: LIB3078-053-Q1-K1-E4.F2
gccaaaaacgaacgacaatataatgttcaaatataagagacaatcctccacgtaacatccatcatgtcatgtgggcaacgcaacaccgttctacaactaaaacactaaccaactggaaagaaaagaaaaagaaaagaatacaccacccagagctcagctccgtccacgccacccttgttggccttcaggccccttcctgaagcagcatctgatcaaagtgccacaccccgtgccccttgttgcccactctcctcagctgcgcgacatacttggagaccttatttatggcttccacctgctcctcgaggaactcactctcgatgaagtctatcagctgaggatcattgcaccttgttgccacaccatgcaggctgtgcagcttctcattaaccagcttttccagagccagagtcagctccatagcgtacagagcatcgcctttctcggggtggtcaaactcggtcaaaggcgccacaatcgactggagcctcaccctgcctccgcgtttgttctgatactccatgagcntttcagcgtgctccctctcctcgtcgctggattccttgaagaacttggcaaatcctttga

SEQ ID NO: 73563 - DNA, 529 bp, Zea mays
  Clone ID: LIB3078-053-Q1-K1-E4.R2
cccacgcgtccgagatgatgcttacggtttccgcgtctccggccgccgcggtggccaaccatctctctggtggggccgcggcgaccacggctcctgccagggtgacggcgcagcgcagcggcgtctcgctgtccgccgccgccgccgccggcaaggggaaggaggtgctcagcggggtggtgttccagcccttcgaggagatcaagggggagctcgccctcgtgccccagtcccccgacaggtcgctcgcgcgccacaagttcgtcgacgactgcgaggcagccatcaacgagcagatcaatgtggagtacaacgcctcgtatgcgtaccactccctcttcgcctacttcgaccgcgacaacgtggccctcaaaggatttgccaagttcttcaaggaatccagcgacgaggagagggagcacgctgaaaagctcatggagtatcagaacatacgcggaggcaggttgaggctccagtcgattgtggcgcctttgaccgagtttgaccaccccgaggaaggcgatgctct

SEQ ID NO: 73564 - DNA, 411 bp, Zea mays
  Clone ID: LIB3078-054-Q1-K1-A1.F1
cacgagggatactgcattactagtaatgatacacaagtgactaggaacatactgcacgtacaagttcagcagggtctcaatctacatatctactatacatagccctgcaaagtctatagacgctaataggcttaggcgcgtgtgtgctctgccagattcagttttacatgtgccgtgattcagttcacaagcggcgaggagctgccggcgatgtgagtcactcgtcgggggtttctgcacggttatcacccagtcactctccactctccagggttccagattcagcttcgttcacaggcggtggtgagatctagatcgagttcacgatcatctaagaggccgctgtgatggaaggacgctgagctgcccctggaacagcgaaggcggtggcaagggctcggagttctcttc

SEQ ID NO: 73565 - DNA, 607 bp, Zea mays
  Clone ID: LIB3078-054-Q1-K1-A1.F2
cacgagggatactgcattactagtaatgatacacaagtgactaggaacatactgcacgtacaagttcagcagggtctcaatctacatatctactatacatagccctgcaaagtctatagacgctaataggcttaggcgcgtgtgtgctctgccagattcagttttacatgtgccgtgattcagttcacaagcggcgaggagcctgccggcgatgtgagtcactcgtcgggggtttctgcacggttatcacccagtcactctccactctccagggttccagattcagcttcgttcacaggcggtggtgagatctagatcgagttcacgatcatctaagaggccgctgtgatggaaggacgctgagctgccccctggaacagcgaaggcggtggcaagggctcggagttctcttcctcgtcttcctcggcgtcccacaggaacccggcgtaagagcccaggacgtagcagtcgtcgggcgcggcctggacggcgcggctgtagtagtcctcggcgcggccagcgtcgcggctggtctcccaacgaggcccgcgtagagcgacagcgcctcggcgtcgccggggctggcgaggatggcgcgctcgcagta

SEQ ID NO: 73566 - DNA, 336 bp, Zea mays
  unsure at all n locations
  Clone ID: LIB3078-054-Q1-K1-A1.R1
ggtgcagaatgagtgacggcgacggtaggcagcaaccgcgccgccacggacgctcactaccggcagatgatcnaggcggacccgggcaactcgctgctcctggtcaactacgccaggttcctcaaggaggtggccggggacgcggcaagggcgcagtagtactgcgagcgcgccatcctcgctagccccggcgacgccagagcgctgatcgctctacgcgggcctcgattgnggagactagccgcgacgctggctgcgccgaggactactacagccgcgtagtccaggccgcacccgacgactgctacgtcctggactcttacgccgggttcctgt

SEQ ID NO: 73567 - DNA, 158 bp, Zea mays
  Clone ID: LIB3078-054-Q1-K1-B1.F1
aatccaagaattctcattccacattctgcaatcgatacaaactttcttctgaaaattgggattggggttgagagaactagatacaagtgatctttataagggacagagatgtccatgtattgtgtgcaatacacagctgcttgcaccttgagcggaaa

SEQ ID NO: 73568 - DNA, 529 bp, Zea mays
  Clone ID: LIB3078-054-Q1-K1-B1.F2
aatccaagaattctcattccacattctgcaatcgatacaaactttcttctgaaagattgggattggggttgagagaactagatacaagtgatctttataagggacagagatgtccatgtattgtttgctatacacagctgcttgcaccttgagcggaaaataagcatttccctgaccctttgaagtttgaacacgaaccatttcagttacttacatgccatgatcaggatgacagcttgatttcagatcctacctaacaaacagtgataccaacaactgggagaacagaataaattcactgacaacgacggcgggggagtggatgcctagaaagggcacgatatcaacctgcaggaaattttccactgcagatccgacagttgcaccagctgcaagtcccccgacagtgatcaatgcagccttacctaagttcatatttttctttgccaggaaatacagtgatgcaccaaatcctgttgctaggataaaacctgggacatcagggctagtgtatgcagatggcaaagat

SEQ ID NO: 73569 - DNA, 474 bp, Zea mays
  unsure at all n locations
  Clone ID: LIB3078-054-Q1-K1-B1.R1
actatagcgaagtggtagctgcaggaccggtcggaattccgggatgaccacgctccggagagaggacgctaggttgncgtgttgccatctgcatacactagccctgatgtcccaggttttatcctagcaacaggatttggtgcatcactgtatttcctggcaaagaaaaatatgaacttaggtaaggctgcattgatcactgtcgggggacttgcagctggtgcactgtcggatctgcagtggaaaatttcctgcaggttgatatcgtgccctttctaggcatccactcccccgccgtcgttgtcagtgaatttattctggtctcccagttgttggtatcactgtgtgctaggtaggatctgaaatcaagctgtcatcctgatcatggcatgtaagtaactgaactggttcgtgttccaacttcaaagggtcagggaaatgcttattttccgctcaaggtgcagcagctgtgta

SEQ ID NO: 73570 - DNA, 533 bp, Zea mays
  Clone ID: LIB3078-054-Q1-K1-B1.R2
atctttgccatctgcatacactagccctgatgtcccaggttttatcctagcaacaggatttggtgcatcactgtatttcctggcaaagaaaaatatgaacttaggtaaggctgcattgatcactgtcgggggacttgcagctggtgcaactgtcggatctgcagtggaaaatttcctgcaggttgatatcgtgccctttctaggcatccactcccccgccgtcgttgtcagtgaatttattctgttctcccagttgttggtatcactgtttgttaggtaggatctgaaatcaagctgtcatcctgatcatggcatgtaagtaactgaaatggttcgtgttcaaacttcaaagggtcagggaaatgcttattttccgctcaaggtgcaagcagctgtgtatagcaaacaatacatggacatctctgtcccttataaagatcacttgtatctagttctctcaaccccaatcccaatctttcagaagaaagtttgtatcgattgcagaatgtggaatgagaattcttgggattaaa

SEQ ID NO: 73571 - DNA, 63 bp, Zea mays
  Clone ID: LIB3078-054-Q1-K1-B12
gtttggagactacgtacgcctgaagcaatagcaactttgcgagaaaaagaaaaaaaagagaaa

SEQ ID NO: 73572 - DNA, 591 bp, Zea mays
  Clone ID: LIB3078-054-Q1-K1-B6.F2
aagtgtatctttgtcgtgaatgtcataaattatgcaaattcacttggcgaaagagtgtcatactacaatttcacatgaacaacccctaaaactcaacacataataacaactacagagcatttcgctttgagtaaacaaggaaaattctcgtggtggatgtgatatatccagtttactcaatgattttgttgatgacaccagcaccaacagtcttaccaccctcacggatagcaaacctcataccctgctcacaagcaacaggctggatgagctgaacaaccatcttgatacggtcaccaggcatgcacatcttcgcctcctcatctttgtcattcataatcacagtcacattccctgtcacatcggttgtcctcatgtagaactgcgggcggtaaccagggaagaaaggtgagtgccggccaccctcttccttcttaagcacatacacaacagcctcaaacttggtgtgcggtgtgatagagccgggctttgccagcaccatgcctctctcaatgtcatccttctgcataccacggagcagcagtccgacattgtctccagccatggcatcgtccatggtcttctggaaca

SEQ ID NO: 73573 - DNA, 633 bp, Zea mays
  Clone ID: LIB3078-054-Q1-K1-B6.R2
cccacgcgtccgcgcagaccaaagagcacattctcctcgccaagcaggtcggcgttcccaagatcgttgtcttcctcaacaagaaggacatggtcgacgacgaggagctgctcgagctcgtcgagctggaagtccgcgagctgctcagcaactatgagtacgacggcgacgaggtgccaatcgtcgctggctccgccctcaaggcgctcgaggccctcatgggcaaccctaccctgaagcgcggcgacgatgagtgggtggactgcatcttcaagctggttgattctgtggattcctacattccagtgccacagcggcagaccgacctcccgttcttactcgctgttgaagatgtcttctccatcaccggtcgtggtacagttgccactggccgtatcgagcgtggcaccgtcaagattggtgacacagtcgatatcgttggaatccgggacacccggaactgcaccgtgactggcgttgagatgttccagaagaccatggacgatgccatggctggagacaatgtcggactgctgctccgtggtatgcagaaggatgacattgagagaggcatggtgctggcaaagcccggctctatcacaccgcacaccaagtttgaggctgttgtgtatg

SEQ ID NO: 73574 - DNA, 333 bp, Zea mays
  Clone ID: LIB3078-054-Q1-K1-C7
gaacggcaagacgcacttcgacgccggcgacgagcgcgccaaggagttctggggcctgctcaagtccaacgaccccgtgggcttcaacctcgtcgacgtcctcgcctggggctcgctcggccacatcgtcgcctactacatcctcgccacctccagcaacggatacgaccccaacttcttctgagcggccggctgcgggcatgttcttgagcctgcctgtattctactccgtgtgtgttgagccatatatctgatgctcaaggattggttaatctgaacaagtggtgcaactgcgcgtgtacatggatttgctcttcctctaaaaagaaacta

SEQ ID NO: 73575 - DNA, 96 bp, Zea mays
  Clone ID: LIB3078-054-Q1-K1-D12
cagcagttctctgctggatgtgatgtattcattgttgcaatcatggccgggcattggcgacctctatacctgctacaaaactactgcaacgcctat

SEQ ID NO: 73576 - DNA, 571 bp, Zea mays
  Clone ID: LIB3078-054-Q1-K1-E3.F1
caggcctccaacaattattgcacgacagaatacagtccaatggtccacagaaacagaaagaatgtaactagtaagaagaacacgcacattgtcgaacaaaatcaatctgaagtgaaagatctaacaattttatggaccaaaaaagagagatccaaagctactacttttgttgctggtcatctccatgccaggcccagactatgtccttcagtgctggccggatgtcctcttccaacagtttcttgtactcaagtgaatcaccgcccgtttgtttcatctcgatgaggtggtaggatgccgtgatctcaaatatttcagtgtcgaactccaggacacccttcctccccaccttcctcccctgaatcttgacaacaccattgtccttcttccttaccctgagattcagtgcttttgcaacatcttcaagcttcgagatgatggacacggcacccttatcagaagtgaaccgcgtctccttccttacactcctttctgataaataggccagagaggtccaatcctgtggagaaagatataatttcaaaggcgtttaagcttgtgacagtcgggg

SEQ ID NO: 73577 - DNA, 496 bp, Zea mays
  Clone ID: LIB3078-054-Q1-K1-E3.F2
caggcctcccaacaattattgcacgacagaatacagtccaatggtccacagaaacagaaagaatgtaactagtaagaagaacacgcacatgtcgaacaaaatcaatctgaagtgaaagatctaacaattttatggaacaaaaaagagagatccaaagctactacttttgttgctggtcatctccatgccaggcccagactatgtccttcagtgctggccggatgtcctcttccaacagtttcttgtactcaagtgaatcaccgcccgtttgtttcatctcgatgaggtggtaggatgccgtgatctcaaatatttcagtgtcgaactccaggacacccttcctccccaccttcctcccctgaatcttgacaacaccattgtccttcttccttaccctgagattcagtgcttttgcaacatcttcaagcttcgagatgatggacacggcacccttatcagaagtgaaccgcgtctccttcttacactcctttctgat

SEQ ID NO: 73578 - DNA, 328 bp, Zea mays
  Clone ID: LIB3078-054-Q1-K1-E3.R1
ggatcatgacatgggggaggaaggctaactctttgccagtcccacctgattggcgccacagtgtgatttatactttttgcagagagagaagatatggagtcgacaggaaagattttgatggagcggtatgaggtggggaggctactgagggaaaggcacatttaggcaagggggcctacgcaaagaatcttgagtccaacgagagtgttgccattaagatgatggacaaggacaaagtgctcaaggccgggctttcggagcaaataaagcgggaaatcacaacgatgcggttggtgggccataagaacttgttgagcttcatgaggtc

SEQ ID NO: 73579 - DNA, 656 bp, Zea mays
  unsure at all n locations
  Clone ID: LIB3078-054-Q1-K1-E3.R2
ggatcatgacatgggggaggaaggctaactctttgcccagtcccacctgattggcgccagcagtgtgatttatactttttgcagagagagaagatatggagtcgacaggaaagattttgatggagcggtatgaggtggggaggctactggggaaaggcacatttggcaaggtgcactacgcaaagaatcttgagtccaacgagagtgttgccattaagatgatggacaaggacaaagtgctcaaggccgggctttcggagcagataaggcgggagatcacaacgatgcggttggtggctcataagaacattgttgagcttcatgaggtcatggcgacgcggaacaacatctactttgtcatggagtatgtgaaaggcggagagctctttgacaagattggcaagagtggcaagctcacagaggccgctgcacacaagtacttccagcagctcattggtgcggtggattactgccacagccgaggtgtgtatcaccgggacttgaagcctgagaaccttctgttggatgagaatgagaacctcaaggtctcagattntggactgagtgcactntcagaatccaaggngcaagatggcttactccacaccacctgnnggactccagcatatgtagctccagaggtgatcagcaagaca

SEQ ID NO: 73580 - DNA, 411 bp, Zea mays
  unsure at all n locations
  Clone ID: LIB3078-054-Q1-K1-G4.F2
ataaaaaataaataatactccatcgcggcgcggtgcaaaatatgatgaagctaactcatacagctgacacacatgatcgagtattccaagtttgcagacaaatacgttaagaacacacgacaagacacgacagattgaggtgtgatttngcgtgactaacaacatcataagaggcatgcagcaaaatagagtacgtacagctaacaagctgcagcagtacttcttttgttcaagatgatcctgaagctacttcactgcagcctacaggactctctcagatgagttacaaattttgttggcaagattaagaacattaataacatcatacacagctgcccacttcagtatatggaaatgctgctcgacctcatggtccttgttgatgagctgaccgagggtgggggacgcttg

SEQ ID NO: 73581 - DNA, 342 bp, Zea mays
  Clone ID: LIB3078-054-Q1-K1-G4.R2
cggactctctggcgggctcgtggtctgcgagtcgttgaatcaggtaggatccactggattcgctggggtcgccaccatccagctagctgccagagttccagataggtcttggaacaattggtgtgcagtctagtaatgttttgtcagctcaagaggcacagcttgatggcaaggtggttgtagatgtgccaagtgttcctatatcgcacaacactgcgactcgagcggttcaagttgcgaccatgggcatatcagaatgaagacaaaagcaagtctaccttattctactgataaacaaaggcagagttgcggccaaagggaagttagtgactacagttagcc

SEQ ID NO: 73582 - DNA, 162 bp, Zea mays
  Clone ID: LIB3078-054-Q1-K1-G8
cggacgcgtgggtgcatcccaaatgtgtgatgtaaactgagacagaacagcagccagatgaagcagagatttgctgaaaaaaaaaaaaaaaaaaaaaaaaaaaaaaaagaaaaaaaaaaaaaaaaaaaaaaaaaaaaaaaaaaaaagaaaaaaaaaagaaaa

SEQ ID NO: 73583 - DNA, 388 bp, Zea mays
  Clone ID: LIB3078-054-Q1-K1-H6.F2
acatctatatgccatgatcagcacagaacaatatttttcttaggttcagccttagcagacgaagatcattacagtgggaaaaatgaaatgaagtaagggaaaggcaaaaaaaaaacactttctatttcttcttcccggcttttccttccttccttcggacaacttcatccatatatctgataccctttcccttgtatggctcaggtggcctccacttctttatggtagcagcaaactgaccgatcgcgctcttgtcatagccgctcacggtgatccttgtgttctcctccaccttgaccgccaggccttcaggaatggccatccgaacagggtgggagaatcccaggttcatcacgagatcgttgccctccaccgccgcacgataccc

SEQ ID NO: 73584 - DNA, 387 bp, Zea mays
  Clone ID: LIB3078-054-Q1-K1-H6.R2
gggtatcttgcggcggtggagggcaacgatctcgtgatgaacctgggattctcccaccctgttcggatggccattcctgaaggcctggcggtcaaggtggaggagaacacaaggatcaccgtgagcggctatgacaagagcgcgatcggtcagtttgctgctaccataaagaagtggaggccacctgagccatacaagggaaagggtatcagatatatggatgaagttgtccgaaggaaggaaggaaaagccgggaagaagaaatagaaagtgttttttttttgcctttcccttacttcatttcatttttcccactgtaatgatcttcgtctgctaaggctgaacctaagaaaaatattgttctgtgctgatcatggcatatagatg

SEQ ID NO: 73585 - DNA, 166 bp, Zea mays
  Clone ID: LIB3078-055-Q1-K1-A7
gcgcccacgcgtccgcccacgcgtccgaagcagaccccagcagaagaagcgaagtggtcgggggagcacgaggaagagcgagcagcaagatgtcgtggcaggcgtacgtcgatgaccacctgctgtgcgacatcgaaggccagcacctgagcgccgacgccatcgt

SEQ ID NO: 73586 - DNA, 406 bp, Zea mays
  Clone ID: LIB3078-055-Q1-K1-H1-F2A
gctaagaaaaaacatgccaatatatgatcattcttcttgaacaagattgaaatttacagatgaattgcagtaatctacagttgggagtgcctcccagaaatttacagcagcttgtgtagcagctctatataaaactatatgcacaaggtactacaaagaacaattcgcaccagtggattctgaaaataaaataggagtatgagtggtatctgtctgaagatctacagaaaattggcggcatccctcttgcctcatttcaactgcgctcagcctccgtcacagtgcccaggtgagattcagggacactcctctccaccggcgaaccaggcacaaaggggacgaaacctcgccccccgaacaccgggcgcatgaaccgatcgtcaaacttgcgccaaaggcgatggac

SEQ ID NO: 73587 - DNA, 616 bp, Zea mays
  Clone ID: LIB3078-055-Q1-K1-H1-R2A
gtggaattcttactgtcttcttctgtggaatagtaatgtcacattacacttggcataatgtgacagaaagttctagggttaccaccaagcatacttttgcaactttatcattcattgcagaaattttccttttcctctatgttgggatggatgcattggacattgagaagtggaaattagctagtagcagtcctaagaaaccaattgctttaagtgcaattattttgggcttggttatggttggaagagcggcatttgtattccctttgtcgttcttatccaacctaagcaaaaaggaggcccgtccaaagatctccttcaagcaacaagtaatcatatggtgggctggtctcatgagaggagcagtgtcaattgcgcttgcctataacaagtttacagcatctggtcacactgaagtgcgagtcaatgctatcatgatcaccagcacaggtattggtggtctatcagcacaatggtaagccgtctgctataccttattattatcatcttgttcttcatagatgtgcgtgttacatagtccagcacaaaacatgacaatgaaacggccaaggtataataataactcatgtgatgtttttcatatttgtttcttcat

SEQ ID NO: 73588 - DNA, 523 bp, Zea mays
  unsure at all n locations
  Clone ID: LIB3078-055-Q1-K1-H10.F2
aagaggggaattctattatatttcgtgctacaatccctgtttcacagtgcttgaataaggagggagcaaaagagcagcagtcatatttacagatgcatccacataacaaaaataatatctagaatgcagactaacatttccagctagaacaactaatttccccttccatatcaaaacaaaaacttgtatatcaccatgtttaagttcccatggcggtaccattcaacttgaaaccagctttgatttccaacgagtcttttaaggaggccaacgctgatctttgaaggccctgatgcattctaccgtggaccggatgctgctcgacacgcccttccccagcttcggcagatcaactccccctggaacctgagggctgtcctggaacctcggaagcttctgtcgagattctntcctcatagccgctacattgcccacgtagctgatggcgtcccataccagacctctgatgatggttagggcgtagaatctcgctgaatcaacagggacgctgctcgcaaaacca

SEQ ID NO: 73589 - DNA, 223 bp, Zea mays
  Clone ID: LIB3078-057-Q1-K1-A10
tttcgtttacgcttgggcgggaacctcccgggcggggttgcgtctgtcgacggcagggaggagagcatgaacgctctgcactgggcgctcgacaacctccgcctgcaccccaactgctagctcgtcgtgctgcacgtccagccgctgtccaacatcgacatgggactcaacccggcgcccatccccttacgcagcctcattcagttggaggttcctgcattca

SEQ ID NO: 73590 - DNA, 295 bp, Zea mays
  Clone ID: LIB3078-057-Q1-K1-A2
cacaaaatgcagctgccatcttgtgtaataagtttaaagcaaagttggaggagctagcatgcaagacacacatcagagctcccagtcatgtaccaagaaaactaaatcccaccggataatgggtcacttgagagaagcagtatgaagctagtaataatgtgtgagtccacccactgtccgcacaattaaatagtccattcccacctgggacacatggcttcatcatcaaaaccgtatactgtgtgcattgtgctgcgcagaaaactatttcgacggcctgtctgctggattgact

SEQ ID NO: 73591 - DNA, 624 bp, Zea mays
  Clone ID: LIB3078-057-Q1-K1-B3.F1
taattttttttcctacaattttgcaccttgcggctttatttatcgctgtattgttgaatacaaataagccggtttgtggatcgctcatcctcaggctacagacccagaccagcacaaaccgtgcacatctaactagactactagagtactctgtatcgatcaagcaacatgtttcagaaatctacagtggcttttatcgcgtccaggaccttgttcttggtgggcatgtaaaatggctcgtacacgagagggaaaggggtgtcgagaccgcagactctcgccacgggtgcttctaacctctggaagcagcgctcggcaatggacgcggcgatctccgcgccgaagcccccggtgactggagcctcgtggctaacgaggagcttcccggtcttcttcaccgaggcctctaccgtttccttgtcccatggtacgagtgttttcagatcgatgagttcgcaagacaccccatcctttgcagcatcttcacaggcttctttcagcaccgcaagctgagctccccatccaacaagtgttatatcacttccttccctaatcacttctgcctcggataatggcagcatgtaatcctcctcgggaacttcttcaacagccaagcgatacagc

SEQ ID NO: 73592 - DNA, 609 bp, Zea mays
  Clone ID: LIB3078-057-Q1-K1-B3.F2
gcaccttgcggctttatttatcgctgtattgttgaatacaaataagccggtttgtggatcgctcatcctcaggctacagacccagaccagcacaaaccgtgcacatctaactagactactagagtactctgtatcgatcaagcaacatgtttcagaaatctacagtggcttttatcgcgtccaggaccttgttcttggtgggcatgtaaaatggctcgtacacgagagggaaagggggtgtcgagaccgcagactctcgccacgggtgcttctaacctctggaagcagcgctcggcaatggacgcggcgatctccgcgccgaagcccccggtgactggagcctcgtggctaacgaggagcttcccggtcttcttcaccgaggcctctaccgtttccttgtcccatggtacgagtgttttcagatcgatgagttcgcaagacaccccatcctttgcagcatcttcacaggcttctttcagcaccgcaagctgagctcccatccaacaagtgttatatcacttccttccctaatcacttctgcctcggataatggcagcatgtaatcctcctcgggaacttcttaacagccaagcgaacagccactttggc

SEQ ID NO: 73593 - DNA, 507 bp, Zea mays
  Clone ID: LIB3078-057-Q1-K1-B3.R1
gcgctgggcgccggcgccggcggaagcggaaggagggagggaaggcggtgaacctgttcacggccgtcaaccaggcgctccacatcgccctcgacaccgacccccgcgcctacgtcttcggagaggacgtcgggttcggcggcgtcttccgctgcacgacaggcctcgccgattcggttcggcaagagcagagtgttcaacacgccgttgtgtgagcagggtattgctggatttgccatcggcctagcagcgatgggcaatcgagctatcgcagaaatccagtttgcggactacatatttccagcctttgatcagattgtcaatgaagcagctaagttcagatatcggagtggaaatgaatttaactgtggaggcttaacgattcgaactccctatggtgctgttgggcatggtggtcattaccattcacagtcaccagaggctttcttctgtcacgttcctggactcaaggttgtcataccacggagtccacgcgaggctaaaggg

SEQ ID NO: 73594 - DNA, 642 bp, Zea mays
  unsure at all n locations
  Clone ID: LIB3078-057-Q1-K1-B3.R2
gcgctgggccgccggcgccggcggcgaagcggaaggagggagggaaggcggtgaacctgttcacggccgtcaaccaggcgctccacatcgccctcgacaccgacccccgcgcctacgtcttcggagaggacgtcgggttcggcggcgtcttccgctgcacgacaggcctcgccgatcggttcggcaagagcagagtgttcaacacgccgttgtgtgagcagggtattgctggatttgccatcggcctagcagcgatgggcaatcgagctatcgcagaaatccagtttgcggactacatatttccagcctttgatcagattgtcaatgaagcagctaagttcagatatcggagtggaaatgaatttaactgtggaggcttaacgattcgaactccctatggtgctgttggngcatggtggtcattaccattcacagtcaccagaggctttcttctgtcacgttcctggactcaaggttgtcataccacggagtccacgcgaggctaagggggttgctgttggccagctnccgagatccanacncagttgtattttttgagccaaagtggctgtatcgcttggctgttgaagaagttcccgaggaggattacatgctgccattatccgaggcagnagtgattag

SEQ ID NO: 73595 - DNA, 540 bp, Zea mays
  Clone ID: LIB3078-057-Q1-K1-D7.F1
gttataataatttcgatgctttactcccaaaatttatacggtaatacaacataatagcaagcatatagatatataggctatggtcgataatacatgtttttgttacttgagcatcttcttgtagtccttgaaagctgcccgagaacggggtcaccctgccttccgacaccacccaaagctcgtccacgcttccagtgataagatgctcatcgtgactcaccatcagcacccctccctgaaaaatgagtaaaccctggatgagcgcctcaacagcgtccagatcaagatggttagaaggctcgtcaaggagaatgatgtgcggcttcttgaaggttattttcgcgaatgaaccctactcttctgaccacctgataaagtgtacatagattggagggcaaggcttcccgaaacaccaaacgaacccagatgtgacctcaacttctgctccggcacacccggatagcacttcatcatgtacaaaaggggattcaccgtcaaatcaagggcatcaacatgatgctgatttgatacagccatgcg

SEQ ID NO: 73596 - DNA, 583 bp, Zea mays
  unsure at all n locations
  Clone ID: LIB3078-057-Q1-K1-D7.F2
gttataataatttcgatgctttactcccaaaatttatacggtaatacaacataatagcaagcatatagatatataggctatggtcgataatacatgtttttgttacttgagcatcttcttgtagtccttgaaagtgcccgagaacggggtcaccctgccttccgacaccacccaaagctcgtccacgcttccagtgataagatgctcatcgtgactcaccatcagcacccctccctgaaaaatgagtaaaccctggatgagcgcctcaacagcgtccagatcaagatggttagaaggctcgtcaaggagaatgatgtgcggcttcttgaaggttattttcgcgaatgcaaccctactcttctgaccacctgataaagtgtacatagattggagggcaaggcttcccgaaacaccaaacgaacccagatgtgccctcaacttctgctccggcacacccggatagcacttcatcatgtacaaaaggggattcaccggcaaatcaaggccatcaacatgatgctgattgaatacagccatgcgaaccttgngagagcgaaatactggtccaagaagttggcttgca

SEQ ID NO: 73597 - DNA, 578 bp, Zea mays
  Clone ID: LIB3078-057-Q1-K1-D7.R1
cccacgcgtccgcccacgcgtccgcccacgcgtccggtttttgaatacggttgtcaccgatatccttcatctgcatggtagaaaactacatgcttacaaaggtgactatgacacatttgagaggacaagggaagagcaccttaagaatcagcagaaagcctttgaaacaaatgagaaggccagacagcacatgcagacattcattgacaagtttcggtacaatgcaaagagagcatcacttgttcaatcaagaatcaaggcattggagcgaatggaacatgttgatgcagttgtcagcgatccagactataaatttgaatttccaaccccagatgaccgccctgggccaccaatcatcagcttcagtgatgcctcatttggttaccctggagggcctaccttgtttaaaaatttgaattttggtatcgacctggacagccgcatagcaatggttggtcctaatggcattggcaagtccactatactgaaactaatttctggggatctgcagccaactttctggacagtatttcgctctcccaaggttcgcatggctgtattcaatcagcatcatgttg

SEQ ID NO: 73598 - DNA, 624 bp, Zea mays
  unsure at all n locations
  Clone ID: LIB3078-057-Q1-K1-D7.R2
cccatgcgtccgcccacgcgtccgcccacgcgtccggtttttgaatacggttgtcaccgatatccttcatctgcatggtagaaaactacatgcttacaaaggtgactatgacacatttgagaggacaagggaagagcaccttaagaatcagcagaaagcctttgaaacaaatgagaaggccagacagcacatgcagacattcattgacaagtttcggtacaatgcaaagagagcatcacttgttcaatcaagaatcaaggcattggagcgaatggaacatgttgatgcagttgtcagcgatccagactataaatttgaatttccaaccccagatgaccgccctgggccaccaatcatcagcttcagtgatgcctcatttggttaccctggagggcctaccttgtttaaaaatttgaattttggtatcgacctggacagccgcatagcaatggttggtcctaatggcattggcaagtccactatactgaaactaatttctgggggatctgcagccaacttctggaacagtatntcgctctcccaaggttcgcatgggctgtattcaatcagcatcatgttgatggccttgatttgacggtgaatccncttttgacatgatgaagt

SEQ ID NO: 73599 - DNA, 308 bp, Zea mays
  Clone ID: LIB3078-057-Q1-K1-E12
acttcataataagagttgtattatcgttcctttttaattagctccaaatattttatttgagctgtatacatgcatacatacagaggatgtgtataacaggaacaagaagcctggtcatgtcgccgccgccgccgcgccctccggttccttcttcttggccgcttcgtcctccttatcatcatcgtcatcctcgagctccgcgacaagatcctctagcaccacggacttggggttggccatagggggtcccttctccctgccctcgagctcgtcgaggttgaaggtgatgagcctgtcccacaccccac

SEQ ID NO: 73600 - DNA, 297 bp, Zea mays
  Clone ID: LIB3078-057-Q1-K1-H5
cccacgcgtccgcctgatttggggagaaggttaaactggatgcctttccatgtaattaattgcctctctttaccattctacgtgctactagtattgaagtatcatcacccttgttgtgtccttctgtctgtggcgtgatggtcatggactcatggtctgtgtttcttcggtgaagagttcgtacccgtacataaaagatcttcaatcagtggccggtttggtacctgtttggttcagcttttttctgaccagcttttctgaaaatctggctgtggtgagaatcatacagaaaacaac

SEQ ID NO: 73601 - DNA, 458 bp, Zea mays
  Clone ID: LIB3078-008-A8-F3A
aaacgacggccagtgagacaggattatcaaggatgctgatcgagaggcgctgaagaatgagatcgtgaggctgcgccaggtctacgagcagcagaacctcaagatgtcagccggcgctgctgcctctgaccatggcccgccaccggtgcgcgcggagaaagagctcatgagctagctacccagtcgatccacgcgtgcccgctgtgcagtgcagcccgcccgccttatcattaattaacatggagggaacattgcatcatgatttctctttttttcggattatgtggatgttttcttctttctttctttcttcttccattgacacgtgtgcgttaattctttggatgttgattttgggatttggttcactgtgcaaattggggtaaagtcatcagggaaactgatctgttgggtaaatcacttttttgaagcattacattcctgggaatctggttacc

SEQ ID NO: 73602 - DNA, 326 bp, Zea mays
  unsure at all n locations
  Clone ID: LIB3078-012-Q1-K1-G8.F2
ggtgnantgtcgtcgggttttccccnttttttttnggcncggttggtttttgtttttgttcttggttggcgtttttttgggttcggtcccccttcntgatttttgtttgtccatttgntgttgctgctgctggggggggccgcngggggcngcnttcctttttggcttctnnccagctcttgggttgtgcccccnttggtcggttgggcccgggggcaactgtttacacttgctggcgaggctggcaaaagtgtccgggtttttgggttgaggggggacttttggttgcctttccctaaggtgccgtcttgtgcaggttttccttt

SEQ ID NO: 73603 - DNA, 565 bp, Zea mays
  unsure at all n locations
  Clone ID: LIB3078-012-Q1-K1-G8.R2
gcgttcggttttttgttttttccgccgcggttcaaggccccggcgccaagcgcaagaggtcggcggcgccaagcgcgggctcacccccttcttcgcgtttttggctgggtttaggccgcagtacctgngagaacaccctgagctcaagggcgttaaggaggtaagttgcttcttctcaccctaggcgtgtagctgggtttcgcttaggtggctggtatatgcctttgctcgtcggtgactttgcttataggtgagcaaggcggctggggagaagtggcgctctatgtcggatgaggagaaggcgaagtatggcggttgcgagaagcaggatggccaagcaagcaagaaggagaacactatctccaagaaggccaaagcttatgttcgggagggggatgaagcagaaggttctaacaagtcaaaatctgctgttgcggatgatgagcaggatggtaatgaggacgaggatgagttaatagtacgatggggaacagcagctttgcaattggagtgtttgctgctttacttatttttctatattgctgttcctttttgtggtatatgc

SEQ ID NO: 73604 - DNA, 595 bp, Zea mays
  Clone ID: LIB3078-038-Q1-K1-B2.F2
acaaaaccacatcataacaatacaccatttttagagagcaagagagattattgagtacacggtgaataaagcaagcacttacatgatatgattatgtggattatgctattacacataggatcgatgttgtgacgctagccagcacagcatgcagcttcacagtctcattttacaactactacaaatcaatcacacggaagctagcgcggagcccttgagccggccggccccactcatttcacctgtgagacctcttccaaggcgtaattgttggtggacacgccggcgtagttcaccttgttgaaccgaacaaccaccgggtaacgggtgttgggatcctgatcaacggtgacggccggtggtgctgaacacgaacgtgtgggccatcggcgacggcaagaaggagcaccaattcgacctctggttcgacccctgcgacgactaccacacctacaccatcatctggaacccggccaacatcctgttcaaggtggacggcgacgtgatccgttgcttcaagcgctacgccgacctgccgtaccctagcgcgaggcccatggcgctgcacgccactctgtgggacggcagctactgg

SEQ ID NO: 73605 - DNA, 585 bp, Zea mays
  Clone ID: LIB3078-038-Q1-K1-B2.R2
agcccttacaatatcatgttgcatcaattgatcacgaaaattcctcattgcaagaacaaaaggtcgaccacggcggatagaagcacaaatttgtcgcaataccaacaccccatgtcagcaggaggaaataacagcacattttgggacctaactctatagcttgaacgaattggtaccatcctatttcctgcttggcacgctccagaaaagcatcaaaatttctggacctgttcttgttgattcacagatcaagctccagccacctattctgcatcgccggcaccaaaaccgtcgtcttcgacttcgtcaaccttttgaggtgccacactaccttcgacagctgttgggtcatcatctccaaacttttcagggcctggtcctgcagacactttgaccattgctgggcgaagcagtctttccccgagtttgaaaccttttcggaattcctggagaataatcccctcttcaaactctgatgattcttctctcataatagcctctgaagcattgggataaaatggtttgcccgaccgtttcaacatcttcaacgcccaatgaattcaaaatctcgatgaattgcttata

SEQ ID NO: 73606 - DNA, 497 bp, Zea mays
  Clone ID: LIB3078-032-Q1-K1-G9-F2B
cacaaaaatgggaaagggttcagaaaaacatctgagttgcacaacttcttcaagttaattccatgcatcattactcgtattagggttacatctttgaatatgaaagaatcgttatttttcatcactcatacaccgcggatggaacaatgacattctcgattcttaacagactcaggaggcaatggtagctaataaagggactacagcagggcccgtgtctactacaggtgatgaggaaatgtgcgaatctgaacatgcattctgaaacatcaatcacagcgccttctttttggcgtccttggccagccccttcttgcggatcttaatgcacatgcccaggcgcacgctgtcaataagggactcgggaagattggggatcaagacccacaccacaaagtgtggccagtatggtgtgcacctaggctcgtatccaatgtgacaaacggcagcacgagcataggtgtcagcagatgggaccatgaaggaagacttcctga

SEQ ID NO: 73607 - DNA, 607 bp, Zea mays
  Clone ID: LIB3078-032-Q1-K1-G9-R2B
ctagttctagatcgcgagcggcctccctttttttttttttttagagtacataaccttgtatttgcaaattcataataacaaggtgctagtatgaattttgacactgcaacaaacaaaacattgcgctaagccaagtatgctataaagctgtagatattacatatctgatacccagagattacagtgaaatatgatgatatcgatagggaagtgaaaaaaaggtttaagagaaatcgagatggtggtggaaaagttgttctgtcagcatatctgatttcacttgaatgttgaaaagcggggaagcttgtctttcaggtagtacaactttgctctcctcactttcttgtgcctgataaccgggatttccttgatcctgggtgagtacactgggaagagaatctcaacttctacaccagcaatgatccttctgacacggattgtggtgggaacaccaactctgtgctttgcgaggattatgcccttaaagagcgacaatctccttttgttgggccggtgcatcctaagctcaatgatatcgcccggacgcgtgggcggaaccgtgggtccacccgccggcgtggaggcgctcaaggactccatccggggg

SEQ ID NO: 73608 - DNA, 237 bp, Zea mays
  Clone ID: LIB3079-006-Q1-K1-B9.F3
atttcgctctgctcttccaataaacagaaaaagaatacgacgtggacaagatccggcggctcggcagcgtcctctgcaatccacatccggtgatgacgtaaaaggggtgtggcagtagtttctgatggagtgcatcgcgtcaacaatatggagcttgaactatacaaaccctactgataatgtgtcaccatttcatatgtatatgtactccattcattaacaaaaaaagtgtcttat

SEQ ID NO: 73609 - DNA, 95 bp, Zea mays
  unsure at all n locations
  Clone ID: LIB3079-006-Q1-K1-B9.R3
tactttgcgcagtacactatcaggnaaaaaaagacactttggcaggcaacattttggtgtttgcaccacacaactatagcaggtgcttgtggaag

SEQ ID NO: 73610 - DNA, 514 bp, Zea mays
  Clone ID: LIB3079-024-Q1-K1-E4.F3
gtccataggtcttgaagcagtaaaatctgttagaattctgatctaaaccctaagattctgatgttgggatggcaaggatatttccatcggatgccactcaagcaacagccagcagacttgtgggcacatagtaaggtggatacatggctaatgaattgcatctgatggccttctctcgatcaagtcagatgttttcagtttagtattaatggtgtatctgtatggtgttctacattatttccttccataaaacctgggaactgtggaaagacaggagatggaataagttcaatgatcaatcatttggtgatgactacgaactggaagagctgatgaaataccttgctgagttgctgtggtattgttgtgtgttatgagaaaaaaaacaatagatcatcctacaatgcctgatgttgttgcaactcttagcagtgatggcatcacattgccagaaccaaagcagccagcttactcctatgcgaaattaaatgtgtcagtcactgtattgagtagc

SEQ ID NO: 73611 - DNA, 526 bp, Zea mays
  unsure at all n locations
  Clone ID: LIB3079-037-Q1-K1-D6.F3
catataatctcggcctatatccttgcaagnaagtgctgatcacttcaaggaagttttgaaagcaaatcctgtgcaggcaggatctcaggctgatttctcccagtggttatgttatgtccataacgtggttaatcgaagccttgggaagccaatatttccctgccaaagagtaactgcacgttggggtaaactggattgtcctgagcgctcgtgtgatctagaaggcagcatcgacatcatgccaaaccgatgacatggccaagaaatcgcttgaactttctacccgtagatgatttcatttcaataccactcattgatgagcacttgagcaataccagggagataagaaagagaattcaggactccgtgctgacatagcagggcgtccatatgcttctgtatctttggcgttggaccgttgtagtaaaagatatgaatgtctcgtgatatttgtacttgtctatgcctagtctgatgtctgacgactcttccataacccataccagtccgtgcagattttcatttt

SEQ ID NO: 73612 - DNA, 138 bp, Zea mays
  unsure at all n locations
  Clone ID: LIB3079-037-Q1-K1-D6.R3
cggggggcgatgagggtgtggcgggagnaagcggcgacggtctggnggacgggcgccagcggattccagcccgtcagtggcatcgaggtggtggccgcgggctcgcgtgcgtgtggtggggacccggggtagcaagcg

SEQ ID NO: 73613 - DNA, 248 bp, Zea mays
  unsure at all n locations
  Clone ID: LIB3079-039-Q1-K1-C9.F3
tactgctgcggggnaaatttgggnangnactcacgcccagtcagnctgtccaagctgtagcagatttaatctcgatttcactgcagcccttgtcgtctgggttctgctggacacagaagtgcagaatctctgctgagcactgtacaagatttgtctatcaagtcactgtcaggaaccacacatttcagtctagacatgccagacactgatttcttttttttgttaaggaataaagcattctggcctct

SEQ ID NO: 73614 - DNA, 300 bp, Zea mays
  unsure at all n locations
  Clone ID: LIB3079-039-Q1-K1-C9.R3
ggcacaaccctttgccgtactccaggttattatcccgcaggtttcagtcataccataaccctggntaatgtcgacaccggggaacctgtcagccatagccaccatgacgtccttgccgagcggcgcggcgccagagccgatgcatctgagcgagctgaggtcgtacctgccgcccctgcnntgtgtcttggcagagcgcagattcatcgcnncggcggggcgcagaaagaggtacgtgacgcggtgccgctcgatggcggccagcacggcgtcgacgtcgaaccgggccatcacgacgac

SEQ ID NO: 73615 - DNA, 663 bp, Zea mays
  unsure at all n locations
  Clone ID: LIB3079-040-Q1-K1-C4.F3
tttgcaacagnagcatcagtgttacagnatatgctatgcacttcgcctccaatcacatgaagagcagccccagtgaggatctcaatgtattcgtcgactgaaggaggcagatccaccaccagcacggtttcgaatgcctctacatctgtcactgacatgttctcccggtctttcacaatgacattcatcagccccacactgctgcatattgtaaaggagttgccacatgagtcatcaatcactgtgcaattttccagcttcagcgacagtgacatgagccgtgcttttttatcgcttgcagctactagaagcacctttgatgtctttttaggatgatcttgcaatatctgctcaagaatttccttaacctttgttgttttcagctcctccgatggacagaagtgtacatgctgggctataaatgcacttcgtgaagaaacagaatcattgatagaaagctttgtaattcttccacggagtagatttttagccattgttgcaatatttttatcagatggatcggtgaagatagtaatctgaagattgtttgatatggcgtctctaatagaaaatattttgtcactaacattgtggtctacgaaacatttcagtccatcaatgaccaacattgatacacctngatatgtcaatcgcctttaacga

SEQ ID NO: 73616 - DNA, 415 bp, Zea mays
  unsure at all n locations
  Clone ID: LIB3079-040-Q1-K1-C4.R4
tttttagcgagtgtctacatgttggttcttggtggcctgcaatgtttcgtacccacatgttagtgacaaaaattttctattagnancgccatatcaaacaanctctcacattactatnncttcaccgnatccatnctgnnataaaaatatctgcacacaatgcgctacaaaatctactccgtgngaagaattacaaagctttctatcaatgattctgtttcttcacgaagtgcatttataagcccagcatgtacacttctgtccatcggaggagctgaaacaacaaaggttaaggaaattcttgaacagatattgcaagatcatcctaaaaagacatcaaaggtgctttctagtagctgcaagcgataaaaaaccacggctcatgtccactgtcgcttgaagctggaaaaattgc

SEQ ID NO: 73617 - DNA, 210 bp, Zea mays
  unsure at all n locations
  Clone ID: LIB3079-054-Q1-K1-D6.F3
tgtcgaacctttgttcttctagtttccagcatcgacaagnaaaatgaatagcagcacttaggagttattttggtccaactgtcgcctcattgggaatatattgatgaacacctcaatttctgcccgattgtaacctggtcatgtgctattgccaattgaacctaatgctgtgcattggctggaaagcaacttaaaaatgttacggatttt

SEQ ID NO: 73618 - DNA, 643 bp, Zea mays
  unsure at all n locations
  Clone ID: LIB3079-054-Q1-K1-D6.F4
ctcttaactgcagcaactccttcgctactaaagaagaggccgactgctgcacagcgagnaacaagcgcaggcagagtccttcggtngaaatgcaagggggataatctaccgagcaaagcccagattcttcatagggccatgcgtcctgccagccgactttctgatattcttcgatcaattgctgcgtcaacagagttcatctgctcatacaaattgtgaaataaaaaacttggtgttagatatgggtgctgcctccaaaacaatgagtcgagcagcatctcaggctcactggccaaatgaaagctgacctggagcaagactcttgtcacattctcgaccaaacttaagctacaataaatgctaccgtattggcagaacctcagccacctagttttgctacaaacccatatttgcatgcagtaaattggcaatgaataaaattaatgcttcaattgaaattaaatacatacatatttgccagctgtccagggcttggtcgataaccctcaagccattagcataggcaccacgaaatttgtcagattatagaaaacttactagtaggaagaatggtgtaaatacctacttggaactcctgatgtgtgcaaaatcagcaggatataggtgaccaatcaacacaaca

SEQ ID NO: 73619 - DNA, 400 bp, Zea mays
  unsure at all n locations
  Clone ID: LIB3079-054-Q1-K1-D6.R3
aaatggctactgtgttaatttactnctaatgaacggctcaaagaaaacattatattatcaaatgcatcagttaagttcatagtgagaaccaagaaaaaagggcaagtttatgtatcacaaataagtagaatagcaaaaccttccaagaattctatactatacttaaagcaccaatttcaacggtcatcatgcgtcatctttttaaaataacccctcagctatttcaaattaatctgctgcacgtctatatagatggccaaacggcgaccggcacaggctagacgcacgcgtggggttcgaacccatgtcctgatggaagaaggacgaaagacactgggtgaagctgtctaaccagtagaacatcatgctaagatgtttttaatattgaatataaattgta

SEQ ID NO: 73620 - DNA, 650 bp, Zea mays
  unsure at all n locations
  Clone ID: LIB3079-054-Q1-K1-D6.R4
ataaaaattggcatattcacaatatactgaattgtgaacttgtcaagnattcaagggcatgcaattcttgaacgttttagtggaatatgaaagtctcatctggtcatacaatatgtgagtctgagatgattcatattttatgccactttttacattttcaaatgtctctgttgtgttgattggtcacctatatcctgctgattttgcacacatcaggagttccaagtaggtatttacaccattcttcctactagtaagttttctataatctgacaaatttcgtggtgcctatgctaatggcttgagggttatcgaccaagccctggacagctggcaaatatgtatgtatttaatttcaattgaagcattaattttattcattgccaatttactgcatgcaaatatgggtttgtagcaaaactaggtggctgaggttctgccaatacggtagcatttattgtagcttaagtttggtcgagaatgtgacaagagtcttgctccaggtcagctttcatttggccagtgagcctgagatgctgctcgactcattgttttggaggcagcaaccatatctaacaccaagttttttatttcacaatttgtatgagcagatgaactctgttgacgcagcaattgatcgaagatatcag

SEQ ID NO: 73621 - DNA, 269 bp, Zea mays
  unsure at all n locations
  Clone ID: LIB3079-001-F5-F4A
gcctaccacttgtcattctcagtggtaatgtgacagacagcctaccagattggcccgtggatgagttcttcagtaactcagaatatggtccaaactttggcttnctccgaaaatggttcttctagggtgataccgtaactgggggcgctgtgatctccatgcgtgtaagtagtgtggattagcagcctgagcaccataaatgccgcctgatagcggtagtcttacaactggtatgtgatggtctgttacaaagtgttgatatctcaact

SEQ ID NO: 73622 - DNA, 608 bp, Zea mays
  Clone ID: LIB3079-001-F5-R3A
gagatccccagcgccctccagcttagcggtatcacccttagaagaaccattctcggagaagccaaagtttggaccatattctgagttactgaagaactcatccacgggccaatctggtaggctgtctgtcacattaccacctgagaatgacaagtggtaggccccatcactattgccattaatttggttggagaagactgttgtggtctggctagattgcagaagtgtggggctttcctctgaaatgtacttaggcggagattctactgatcgaattgtactattattcatagtccaatcaaccacttctgccctggctgttgggacaaaattctgccttgaacaatctccatttgttacatttttggtaggaacagaagcactcccttcaactgaaaattgaactgtcgggcttctccttggctgatgtctcactggttgattcactgatccaccaacagcattaacatgcttttcagcaataggtggaactggatcagcaggatcaagacccacctgaactccagttagcaggaatctctgatgtactgaaacaaaggaattcactgtgtgtatagcaacatcacagtctctacaaagtagtgcac

SEQ ID NO: 73623 - DNA, 345 bp, Zea mays
  Clone ID: LIB3079-030-F3-R3B
tccctgatgagatctcgaggcacgaccggggctcccgtgaggacggcgacgtcggcagctcctggaagtggctgtcggcggcggcgctgtggtggtgaaacgggctggttcttgccgggaagcgagaggctgagggcacacatcacatgctcctactgcggacggctcatggcgcagtccgccggctcgaacccgccggagcgcgcggccacggtgcggtaaatctggccggacccggacccggacccggacccggcgccgtggctgctgaggtcgttacggtcggaccccgaccccgaccccgaggggctgtcgggcggcgagatgctcatcatcattattttg

SEQ ID NO: 73624 - DNA, 282 bp, Zea mays
  unsure at all n locations
  Clone ID: LIB3079-034-B7-F4A
gcttgtgctcgcactcgcgtgtaactaaggcacctatgacgcgacatcttcttggatctccatcaggttctggatatatgtcttaggtgtcttttttttcagttgacctactttgatgtataaaatccacggcatcgcctcaggcgctgtgaatgtttctcctaacttcccgccgggatgaagttctgtaaattgagttgctgctggagatgtacaggccccccccccncnccntnnnttgnaattaatccagaactttgggaataactggtggaacctaat

SEQ ID NO: 73625 - DNA, 720 bp, Zea mays
  unsure at all n locations
  Clone ID: LIB3079-034-B7-R4A
ttgcagatgccataacgagaatagaatttgcaaagttcttcacctggacgtattggaagacccattggacttaagacacaatccggagggggctgtgatctcacacggggatgatggaacttgcacactgcaccaaatttacaatctcctgtcttcatgtaatattggcattctggttcatcgggtctctcaggaaatacattatctctctgcaacgcatattgaggcacaggaaatgaactggatctatagggtgatagcattccctgatttcctgcactagcttcgccttgttgtgaacttccataagtttgttgagccccaggtgactgcagctgaccaggatatgaattccagctcggcacttggacaaggccatgaggtacaaccattggtgcataatttgaaggactttgccacctagggcttggtataaaagaagctcgtggaaaagtccagcttgacatagttccagtatatgactgtggaccagcgcttgcagaggaatgtacagaagtataaataggtgaaccacgtgacgaaggcaccacattgaaaagttctgggtggtggaatttacaagtatttgcatatttacattgtcctgtttttaaataatacgcacanctcttttcattctacaaaagtaaagtagactccttttcagcanaacanacagacatatgtagaagaggacatgtaactgggcaagaaaaacaa

SEQ ID NO: 73626 - DNA, 391 bp, Zea mays
  Clone ID: LIB3079-013-Q1-K1-G10
cccacgcgtccgccaccactccctcctctcctctcccgtcctatccatccggcacgcgcagcgtccatccactcctcccctgctccggctccggctccggctccgccatgggcctttcaacagtttactccccggccggaccgcgcctcgtgccggcccctctcggccgctgccgctctgcccagccccgccgcccgcgccgagccccgctcgccaccgtccggtgctccgtcgacgccaccaagcaggcgcaggatggcgtggcgacggcggtcgcgacggatgcgccggcgtcgcggaaagagtgcttcggggtcttctgcaccacctacgacctcaaggcggaggacaagaccaagtcgtggaagaagctagtgaaatgtgctgtgtc

SEQ ID NO: 73627 - DNA, 433 bp, Zea mays
  Clone ID: LIB3079-007-Q1-K1-B3
caaaagcccacagcttcttctccctactcctccagtcctccgtcatccgtttcggtcgctgccgccgccaccgcacaagaagctagctcctgcctgtaccgccccgtcatggcgatgctatcccgcgcagcctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcgtcaagatgattgaagagtcac

SEQ ID NO: 73628 - DNA, 335 bp, Zea mays
  Clone ID: LIB3079-001-Q1-K1-G1
tcgtcaccgacttcaccggtgacagcaagtcgagcatcttctacgcctatgccgggattgccctgaacgaccacttcatcaagctggtctcttggtacgacaacgagtgggtctacagcaaccgcgtcgtcgacctgatccggcacatgttcaagacccagtagagagagatattgctgcctccctatcgtgggtcgaacccaatggcctgtggtcgcagactattatgtgctgcttagttatgctgagaataaatgtgaacggtgcccctggacgctggatccatgctggatttggacactttgtcttatgtgtgtttaacttatctgctaccg

SEQ ID NO: 73629 - DNA, 459 bp, Zea mays
  Clone ID: LIB3079-002-Q1-K1-H3
cccacgcgttcggagctgttgccaacccaaagaagccatttgccgccattgttggtggatgcaaggtctcaactaagattggcgtcattgagtcgttgctggcgaaggtcgatatcctcatccttggtggtggtatgatctacacattttacaaggcacagggatattctgatggaaaatctctcgtggaagaggataaactcgagctcgcaacttctcttattgagaaggcgaaagcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcac

SEQ ID NO: 73630 - DNA, 408 bp, Zea mays
  Clone ID: LIB3079-004-Q1-K1-D5
cggacgcgtccgcccacgcgtccgcctacgcgtccgcctgggacaacgccaagaaggacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttcccgtttct

SEQ ID NO: 73631 - DNA, 427 bp, Zea mays
  Clone ID: LIB3079-006-Q1-K1-D10
tgacctgagcgaccgctaccacacccactgtgacccaaggctgaacgcctcccagtcgctggagctcgccttcatcattgcagagaggctcaggaagaggacgatgccgtcggggctcaacaacagcctgcctctgccaccactggctttctaagtagccgaagctgaacagagaaggtagagggatagttgcggcgactcgaaagattacgcctgtttatttgctgatgcttggtgtggaggcctggcgggcgctcttggcacaagttacatgctggggagctataggagggtacctgttgcgttgtggaagacagtagctagtattatgtgttgtaattgtatgccttcgattcatgttctgagtgcgtgacttgtcgactttgctgcttctggggttctgaccttggtaaggagagaatataga

SEQ ID NO: 73632 - DNA, 376 bp, Zea mays
  Clone ID: LIB3079-014-Q1-K1-H12
cccacgcgtccgggtgaaggtcatggggaaatcaaaggttctggtgaaggtacatcccgaaggcaaatatgtggtggatatagataagagcattgatatcactaagatcacaccttcaacaagagttgctcttcggaatgacagctatatgctccatctgatcctaccaagcaaagttgatccattggtcaatctcatgaaagttgagaaggttccggattctacctatgatatgattggaggccttgaccagcaaattaaagagatcaaagaggtcattgagcttccaatcaaacatccggaactgtttgagagccttggaattgcgcaaccaaagggtgtccttctttatggaccttcgggcacaagaaagaca

SEQ ID NO: 73633 - DNA, 421 bp, Zea mays
  Clone ID: LIB3079-021-Q1-K1-D7
gtcaggaatattgggaagaacagcccagttctttcctcagtgaatatgctcattgtgggggaaattctttcactgaatccactcctcctgttagtgctgcgtcacctgatatcttccagctctccaagatttctcctgcacaaagcccttcaatgggctctggcgagcaggcgttagagcctaaacatgagtcggcagcttcacctcgtcctgaaaacttgaggcctgatgcattattctctgggaacacagccgatccatccattttcaataatgccatagccatgctcctgggcaatggcattgatgccgagtacaaacctgttcttggtgatggaattgtgctcgattcttcgtcatggaacaacatgcaacatgcttttcagatggcgggattcaaatgagttccatgcaccttgtt

SEQ ID NO: 73634 - DNA, 435 bp, Zea mays
  Clone ID: LIB3079-007-Q1-K1-B7
cggacgcgtgggcgaccgccaccaagatgaacaaggagaggctcatgaagatggccggggccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcaaacacatgggtggtcagtggatctccacagacgaaaaagctacaggatgttctccctgggatcattaaccagcttggccctgacaacatggagcacctgaagaggattgccgaggagatgcagaagcaggtggctgctgccggtgcggcagcacaggtcaaggaagacaacg

SEQ ID NO: 73635 - DNA, 421 bp, Zea mays
  Clone ID: LIB3079-002-Q1-K1-E9
ggccaaatcaggaagatggaggcgatcttccccaagaaacacacgagattgtcaagcctgttgcagttcattcccagaatccaattaatgttgatgaactcgtgggcatgtcaaagctaagcatatgggagcatggtcaggagacagtgtctacttctctgtcgctaaatctgctagggggtcaaaataggcagtcggctttccatgcaaaccctcaaacaagagctcaagcctgatcatcccctaccagcacagaaactgcattttagatggaatcctgggcaaaataagctttgctctttttttcttcttctaaatttaagatcactgagtcataaggtcactggttcgaagtagcttctccgtatttgcggggaaagcctgccctgggttctctccttcatcagaccccactcatatg

SEQ ID NO: 73636 - DNA, 420 bp, Zea mays
  Clone ID: LIB3079-013-Q1-K1-A1
atctccgctccggctgcgctctgccttgctttcctgctacctgttctagcgcgagcgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacc

SEQ ID NO: 73637 - DNA, 278 bp, Zea mays
  Clone ID: LIB3079-019-Q1-K1-B12
gcgcaggaagaagaaggcagtccacaagactacgaccacagatgataaaaggcttcggagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccgtccattatcaaccagctcggacctgacaacctagacaacctgcgga

SEQ ID NO: 73638 - DNA, 465 bp, Zea mays
  Clone ID: LIB3079-001-Q1-K1-E12
gccgccgccgcttcccctgcgccccgagccaagatgaatgttgaaaagctcgagaagatggcaggtgctgtgcgcactggggggaagggtagcatgcgcaggaagaagaaggcagtccacaagactacgaccacagatgataaaaggcttcagagcaccctgaaaagaataggagtgaacaccattcctggtattgaagaggtcaacatctttaaggatgatgttgttattcagtttgtgaatcctaaagtgcaagcttcaattggtgctaatacatgggtggtcagtggaactccacagacaaagaagctgcaagatctgcttccgtccattatcaaccagctcggccctgacaacctagacaacctgcggaggcttgcggagcaattccagaagcaggcccctggtgcttcaggtgcagaggctggcgccagcgctggtgctgctcaggacgatgacgatgac

SEQ ID NO: 73639 - DNA, 436 bp, Zea mays
  Clone ID: LIB3079-001-Q1-K1-D12
cccactcgtccgcccacgcgtccggggaggcggatcagatcgagtggagcaggatccagacccctactgatgaggtggtggtgccctactataccgtcgcgtcgcctcccgaagatctcgaggagactaagaagctgctggataagctcgttgtgctcaagcttaactgagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcatagccagtatcctctcattgttaccgaggactttttgccact

SEQ ID NO: 73640 - DNA, 302 bp, Zea mays
  Clone ID: LIB3079-019-Q1-K1-A10
gaggatgtatctggagcagtacggtggtgccgatgacgtgtggattgggaaggtcgggtacaggatgtctctcgtcaacaacgagctcctcctccggacagctcaagccgacttcagaagtttccagagacaatgcaagctcgagtggcatggcctcagaaaatgggccagcaggagaaacctccaagcatacggcgtgacgtctaacagcacgctgcgatcctacttcttagccgcagccagcatctttgagccagacagagcgacagagcgtctgcgatgggctcgcacggcggtgctcg

SEQ ID NO: 73641 - DNA, 444 bp, Zea mays
  Clone ID: LIB3079-013-Q1-K1-G8
cgaacgacctcacgcagatgacctttggctacagcagggatgatgtggggaagttgagccccatttatctggctcagggcatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgaggggctgcctcctcgttggcagcctgctgttggtgcatctggtgattaataatactactatgacagagccatatgctctgtgaagagtattaatagcagcgctcataaaagctacagttccatctat

SEQ ID NO: 73642 - DNA, 353 bp, Zea mays
  Clone ID: LIB3079-001-Q1-K1-H3
gactagttctaggtacgatgctgttcagtccatcaaacctacagttctgattgggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgtaatatttgccagtggcagtccatttgaccctgtggagtacgatgggaaggtttttgtacctggacagtcgaacaacgcctacattttccctggatttggcctcggtcttgttatctctggagccatccgtgtccacgaggacatgcttc

SEQ ID NO: 73643 - DNA, 430 bp, Zea mays
  unsure at all n locations
  Clone ID: LIB3079-004-Q1-K1-A10
ctggcgaggagtatcatgagcttatgtgttagagttcatggctgctgttaagcagaatctgacggcgagaaagtcctcattcagtttgaggacttcgcgaatcataatgcttttaatttgcttgcaaaatatagcaagagccatcttgttttcaatgatgacatccagggcacagcatcagtggtccttgcaggtttgttagcagcactcaaggtggttggtgggaccttggcagagcacacttatttattccttggtgctggggaggctggaactggtattgcagaactcattgctcttgagatttcaaaacagacgtcggctccaattgaagagtgccgcaagaagatttggttggtggactcaaagggtttgattgttgactctcgtaaaaactccngtcagtcattcaaaaaaccttgggcacatg

SEQ ID NO: 73644 - DNA, 420 bp, Zea mays
  Clone ID: LIB3079-007-Q1-K1-C11
ctcttgggaaagaatttgatctggatggcaaccgggtaaatcaagggctatgtgtagatggaaacaaaggaagcactgaccagcacgcttacattcagcagctgagagaaggtgtacacaacttctttgttacttttatcgaggtcttgcgtgacaggcctgctggtcatgattgggagcttgaacctggagtcacatgtggtgactatttgtttgggatgttgcagggaacacgttctgctctttatgcaaatgaccgtgaatctatctctgttactgtgcaagaggtaactcctagagctgttggagcactggttgcactttatgaacgtgctgtggggctttatgcttctttggtaaatatcaatgcctatcatcaacctggtgttgaggctgggaaaaaggcagcaggagaagtgt

SEQ ID NO: 73645 - DNA, 451 bp, Zea mays
  Clone ID: LIB3079-035-Q1-K1-H3
caatttagaagcgcccttcctcctctcccctatccgtacccaatctaatcgacacccggccgagatgggccgcaagttcttcgttggtggcaactggaaatgcaatggaaccacagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcaccggtgaaattagtgctgagatgctcgtcaaccttggcgttccctgtgtcattcttggacactctgaaaggagagctctgctgggagaatcaaatgagtttgttggatacatggttgcttttgctctgtcttatggactaaaagtcattgcatgtgttggt

SEQ ID NO: 73646 - DNA, 217 bp, Zea mays
  Clone ID: LIB3079-035-Q1-K1-H4
acgaaaaaaaacataaaagaagcatgcaaaaatttagaatagaaccaagaatggcaagacaatcaggcttgaaagaggagtactgagacaccattgacaatgtcaaggctaagatccaggacaaggcgggcattccacctgaccagcaacgtctcatctttgccggcaagcagttggaggatgggaggacccttgctgcataccacccctaagacgc

SEQ ID NO: 73647 - DNA, 240 bp, Zea mays
  Clone ID: LIB3079-035-Q1-K1-H6
gccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgcataccacccctaagacgcagtaccaagtggatggtgctctccttctagatgtt

SEQ ID NO: 73648 - DNA, 422 bp, Zea mays
  Clone ID: LIB3079-035-Q1-K1-H7
acgcgtccagttataaatactctcgcaaaaggcttagatatacgcctcaaccataaggtttcgggaattggtcgccaccggaacagggtagaggttactgtaagcagagggcaaacattcgacgcagacgctgagaggacactgatacgctgggtgtactgaaagtgaaaaccatcagatttgagccgaggctggcatagtggaaagaagaggcaatcagagaactgacgactgaagttgacaacaaaattcgtctgcactttgaccactttttctggcctaacgtggatttcctcggcgtcgaaacctctaccacgtatggttgcagctatttcctgaacctggacaaggcaacaggccaccctgtgctagttacatgcctgctggccgacttgctcgtgacattgagaagatgtcagatg

SEQ ID NO: 73649 - DNA, 244 bp, Zea mays
  Clone ID: LIB3079-035-Q1-K1-H8
aacagagaaaacataccataataagaagcccccgtttttgtacaggtatacatatcttttaacctttggactttgtagaaactacacagtaactttcacctattgagttctgacgttgggtacacatgctcaacaaatctgcaagaatcacaggccttgatcccgaactactttacgcgccagagaaagaaaaagaaagaaaaaaaaaagggttcctagtagtgttaccctatgacgaggagct

SEQ ID NO: 73650 - DNA, 247 bp, Zea mays
  Clone ID: LIB3079-036-Q1-K1-A1
cccacgcgtccgcccacgcgtccgaaaaaattaaaataaaaaaaaaaaaaaaaaaaaaaagggaaaaaaaaaaaaaaaaaaaaaaaaaaaaaaaaaaaaaaaaaaaaaaaaaaaaaaaaaaaaaaaaaaaataaaaaaaattaaaaacacaaaaaaaaaaaaaaaaaaaaataataaaaaaaaaaaaaaaaaaaaaaaaaaaaaaaaaaaaaaaaaaaaatatacactaacataaaattataataat

SEQ ID NO: 73651 - DNA, 439 bp, Zea mays
  Clone ID: LIB3079-036-Q1-K1-A10
gaccactggatcttctgggtgggccctctcgtgggcgctgccatcgcggccttctaccacgcagtacatcctccgggctggcgccatcaaggccctcggctccttcaggagcaacgcgtgatgagcggggcttggctgtggagcaatggcgggcgacctacgggcggggggccgtgagcgaggagaatgccatcattcatcgatcgacttgggtgccggtggttggttcgggtcgccttttttttgtttcagcagctgctgcgttgcgcgcgtgcgtgagatttggtttggtttcgttcccctgcaatgtaatcatgtcgtgactctcaagggattattccgctctgctcttatggtctctgttttctatttaatgattgttattaccatgtagcagtaaccatcgtcatcagtgagaaccttgttgcttctgtctaaa

SEQ ID NO: 73652 - DNA, 453 bp, Zea mays
  Clone ID: LIB3079-036-Q1-K1-A11
atctgatgattgtggaacctgagcagcgagtccctgattttatcaaggcaggtgctgatgttgttagtgtccactgtgaacaaacatcgaccatccatttgcacagaacagtcaatcaggtaatatctgtaccaccttatatttacaagttaatgctcagataatagtatggaacttcaatgtatttggatataaataccaacgaatgtggcttttaccttcttgcttggtgttgtacaacacaaatggcttcaacgaatattttgcttaaacccttcactgtatttttttcattcaggatttagctaatcatggactattacgtaatgaatgtttttctttgtgtgtgtgtgtgtgtttgtttgttttgtgaggctgaattattactaattactgggctccaacaatagctataggagcacatttgctacttgctagtgttaggcctacaac

SEQ ID NO: 73653 - DNA, 460 bp, Zea mays
  Clone ID: LIB3079-036-Q1-K1-A12
caagaagcctgtaccggattttagcttctatgatcgttctgctccaatttatactcaaccgagatatttgcctccttcaaaggttcttgatgctgatgtgacagacagtgttattggagaagggtgtgttattaaacattgcacaatcaatcattccgtagttggactccgttcctgcatttctgaaggtgcagttatagaggactctttgctaatgggtgcagactattacgagactgagaatgataagaatgtcctttctgagactggtggcattcccattggtattgggaaaaattcacatatcagaaaagcaatcattgacaaaaatgctcgcattggagaaaatgtgaagataatcaattttgataatgtccaagaagcagtaagggagacagaaggatattttatcaaaagtggaattgtcacggtgattaaagatgctttaattcctagtgga

SEQ ID NO: 73654 - DNA, 442 bp, Zea mays
  Clone ID: LIB3079-036-Q1-K1-A2
gcgagcagtctgacagctacacacacaggcagacgccgttccgcgggggaaaggtgcggacgcctgaatcctctccaactccggcaccgcattcgcacgcccgcgaagccccgaatcggagaggacagaggagtcatggacgcggcggcggcggcggctgcggctgcgagccccacgagcaagaggatcgcgctggtgacgggagggaacaagggcatcgggctcgagacgtgccggcagctggcgtccaggggcgtcagggtcgtcctgacggcgaggaacgaggcgaggggtttggaagcggtcgagcgcgtcaggtgcgcccgcggcgacgccgaggtttacttccaccagctcgacgtcaccgaccccttgcagcgccgccggctcgcggatttcgtcagggatcaattcggtaggctggacatcctgatcaacaatg

SEQ ID NO: 73655 - DNA, 298 bp, Zea mays
  Clone ID: LIB3079-036-Q1-K1-A3
cccacgcgtccggcacatactgtgctgctgttaccattagaaatataataacgtatgtgaggccggtgcatatatatatgcatcatccatctacctgcgcggtgcaaaattctgaataaaacctgcataaaacctgattgagcacaaacaacagcagctgcagctgcaagccccacgagcaagaggatcgccctggtgacggtagggaacaacggcatcgggctcgagacgtgccagctgctgtcttccagcggcgacatggtcgtactgaccgcgaggaaccaggcgaggggattgg

SEQ ID NO: 73656 - DNA, 437 bp, Zea mays
  Clone ID: LIB3079-036-Q1-K1-A5
gaaagacaagagcattggttcatgctatggtggagattctttttttatgtggaactggaaaaagagctgttgtagcatctgttgcacgtgccaatcgtggaaaaattgatgcagctttggaagatctttctgtcgaatcagcagtggatctgcagaaagttcttaaaacaagtacatttacttcaaggaaggatgcattcaacacccttttggctaacattcctttgtttcaaagtcgactgggagccatgctatttcttatttctgctttgctttcacgaggattggaagacatccaagcagacagggatgatccaagccagccattggtcactgctccatttggtcatgcttcacaggaaattgtgaatttattactctgtggagaggctgttccaaatgtatttgatggcaagatggaccttggtggtggcatg

SEQ ID NO: 73657 - DNA, 300 bp, Zea mays
  Clone ID: LIB3079-036-Q1-K1-A9
cttgaaatcgcacactctcaccaccgtcattctcgtatatgttcgcaatgtaaaagcatcgatcgtgtgtggtgactgtggtcgccgtatacctgacgtaaaaaaacagcagtccacattcggggggtcgtcgacacttgcaccacgcactcatcgctgcacccttgagaacacgagacacatctaatggtcatcgtgtcttgacagagtagtacaatagttaccatcgtgtcttgtcggttaatgtgatatgatccaattttgggttgggtgatctaatggtcatggtttttttttggt

SEQ ID NO: 73658 - DNA, 460 bp, Zea mays
  Clone ID: LIB3079-036-Q1-K1-B10
cgcgcatcgaacccccacttgtgctgattctgctgatccctcgccgacaacggccggagagtcgacaccatggccgctgcgcgccggggccgtggcgactgcgccaacggcgtcgtccgtccccgcccccgcgaccgcggcatcggcggcgggagcatggcggggcgcgtggccgtcctcgccttctgtgtcgcagggatctggtccgcctacatctaccagggcgtcctccaggagactctatcgacgaagcggttcgggccggatgcgcggcggttcgagcacctcgcgttcctcaacttcgcgcagaacgtcatctgcttcgtctggtccttcataatgattaagctgtggtcgggcgggagtagctccaatggcagcgcaccgatatggaagtactggggcgtcagcgtcaccaataccatcgggccgaccatggggatcgaggctctcaagtaca

SEQ ID NO: 73659 - DNA, 345 bp, Zea mays
  Clone ID: LIB3079-036-Q1-K1-B11
aaaaaaaaaaaaaaaaaaaaaaaaaaaaaattaaaaaaaaaaaaaaaaaaaaaaaaaggaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataataaaaaacaaaaaaaaatttaaaaaatataaaatataaaaaattaaataatatttaaatatattaaatatataaaaaaatttaataattaatttatttgaaataaattctagaaaaaatattaaacaaatatcaaatatatgtatcaatataaaaaaacaatataaaaata

SEQ ID NO: 73660 - DNA, 414 bp, Zea mays
  Clone ID: LIB3079-036-Q1-K1-B12
ttaacgtcttcgaactctacctgcctaactttcgtttctgtccgcgacagctcgcttatagcttggtactttaccactgtgagccatgtcaacccccacgactccaacaaggtctactctgcccatctcaaacactacgtcatgatcgatcttaccaaatctgttcacattgacaacactgccatgttcaacgaactcactccttatgactatgtctgctactacatcatggctgcatctgtatcaaggaagatctacttgacacatgccattcgtgttgatcgcttccagaatactaatggtgcccatcacatgaattgctcacgctcacctcacttctgcaagaacatttgctccatctcacgcaacatccttcatcatctgcaggacatgaacatcattgatgtcgatccc

SEQ ID NO: 73661 - DNA, 450 bp, Zea mays
  Clone ID: LIB3079-036-Q1-K1-B2
gcaaaataagagacacatcagagtttgtccaatcttttgcatcagagcatcttaagacgccattaggagaacttgtgaaaggtaataaaaacaagtccaccactgagttatgggtagagaaattctataagaaggtaaccaatctaccggagccttttccccatgatcttgttgagaagttagaagaatacctggataaacttgaagggcaactcgtggacttgtcttccttattgtatgaccaccggctggtcgatgcatatcaaaacagtaccgatatcctgcaaagcactatttttacacaacagtatgtggaacgtgttctagctaacgagagagacaagatgaaatgctgtagcattgaatatagtcatccaaagcagtcatcccaggcttttgtctatggaaggatccttctggctggatttcttgtgtattcactggttattt

SEQ ID NO: 73662 - DNA, 240 bp, Zea mays; identical to SEQ ID NO: 73647
  Clone ID: LIB3079-035-Q1-K1-H2

SEQ ID NO: 73663 - DNA, 453 bp, Zea mays
  Clone ID: LIB3079-035-Q1-K1-F9
gtcgcagctagccttgagggcaagaagcttttatctttcactagaatatcatcaacagtcgagacagctatggaggatgcgcttcttcgtattttgaccccaaggcgctctattgacatactgagggacgtgcacgctgccaaggagcgtgggaggccatatgttattgtttttgttggggtgaatggagttggcaaatccaccaatcttgcaaaggttgcttattggcttcttcagcataacctcagtgttacacttgcagcatgtgacaccttcagatctggtgctgttgagcagctgagaactcatgcaaggaggcttcagatacctatatttgagaagggttatgagaaagatccggcagttgtagcgagggaggctattcaggaagcaacccggaacaaatcagatgttgttctggttgacactgctggacgtatgcaagacaacgag

SEQ ID NO: 73664 - DNA, 415 bp, Zea mays
  Clone ID: LIB3079-035-Q1-K1-G1
agctattgaagtttgactgccaagaattctaattaaaaccatctcgctcgatacattttggatgtgcaaaagctcacatattctcttctattgatacacatgttggatatttgctatctaggtactcagtgccccacgtatttgacgtatgtctgtaaataagtggcacattcgagcgctcttcgctctgccattgaggtggatcgaagctgccacatattttctccgcaggacatcggcacgaattttgtcttagcaaaccagttaattttgtactctttagattctttaattggttccatgctctctttggtacttttcatgtcagtttgctttgcaaacattatcagcgtgcccttgtagatttcgtaatggttatatgtatatgccctattgaaattgtcaaaaataaaaa

SEQ ID NO: 73665 - DNA, 462 bp, Zea mays
  unsure at all n locations
  Clone ID: LIB3079-035-Q1-K1-G10
cccacgcgttcgagtaattggagtcgtgttataagcttaatggacctcctatttggggtgatcttcacagatcaacaagtgagcggtctttgcatgctgcatgagatcaagcaagccgccgactggcaatgctccacctgccattcagttcgttggtgaggtattaatcaccagccatgttggcacttggcggcatgcagatggagcagaacatccaggtgaagcggacagatacatgatcgatcatgagttggcgcagacacaggccatacaaccagaggctatattccaattcatacattccatgataagcaaaggaagatccatgacaacacatatatacaaatagttagttatacaagcaaaaatcctgttgttttgtgcctcccattttctagtccagaattaatatgacaattnttcactgaaactggttggatcagagaccaggaaaaaaaggga

SEQ ID NO: 73666 - DNA, 141 bp, Zea mays
  Clone ID: LIB3079-035-Q1-K1-G12
gcactcgtacgaccaaacctaattaacatctctcctttagtttgcctaaaccagcttcatattcccgcaagcttattattaaatcaccgaccaccacaacaatcacaacccttcttcctctacctaactctccaccttcat

SEQ ID NO: 73667 - DNA, 401 bp, Zea mays
  Clone ID: LIB3079-035-Q1-K1-G2
tcggcacattagcaacaacctaacaacaatggctaccaagatattatccctccttgcgcttcttgcgctttttgcgagcgcaacaaatgcgttcattattccacaatgctcacttgctccaagttccattattacacagttcctgccaccagttacttcaatgggcttcgaacacccagctgtgcaagcctatatgctacaacaagcaattgctgctagcgtcttacaacaaccaatttcccagttgcatcaacaatgcttggcacatctaacaatacagaccatcgcaacgcaacagcaacaacaatttctaccagcactgagccacctagccatggtgaaccctgccgactacttgcaacagcatgtgcttgcatcaaacccacttgatgtggcaaacg

SEQ ID NO: 73668 - DNA, 437 bp, Zea mays
  unsure at all n locations
  Clone ID: LIB3079-035-Q1-K1-G3
attcccgagtctccagccaaccgcatccagtccacccccatccccctcgaccccgacaaacccgacccgatggcgcccaaggccgagaagaagccagcggagaagaagccggcggccgaggagaaggcggagaagacgaccgcaggtaagaagcccaagtccgagaagcgcctgccggcctcgaagtcctccggcaaggagggcggcgagaagaaggggaagaagaaggccaagaagagcgtggagacctacaaaatctacatcttcaaggtcctgaagcaggtgcaccccgacatcggcatctcctccaaggccatgtccatcatgaactccttcatcaacgacatattcgagaagctcgccggcgaggccgccaagctcgcgcggtacaacaagaagcccaccatcaccttccgcgagatccagacctncgtgcg

SEQ ID NO: 73669 - DNA, 410 bp, Zea mays
  Clone ID: LIB3079-035-Q1-K1-G4
ccggtcttcttcgtcccctccgtcgccttcacacctgcttgccatttgcgatttcaccgtgcccgtcccgtggcgcaacgaccgccgccttccggccacccggtcgcggctcccccggattcgcgcccaccgcgcctccggatcgtctcggagatctgccgctgagggagttgcatataatctgagctggtgctcctcaagtgttcggaagaggtccctgttttattcgtttttgttggtgcgattgcgagtgtaatggaggaagtggaggaagcgaacagggaagccgtggagagctgccacagggtgctcgccttgctctcccagccgcatgaccccgcgcaggccaggagcatagctctgggcacggacgaagcatgtgccaggttcaggaaggtggtctctctact

SEQ ID NO: 73670 - DNA, 461 bp, Zea mays
  Clone ID: LIB3079-035-Q1-K1-G5
gtcagcccaagaccaccattggcgaagccaaaaagcattacccgaacccctgtgacatctgcattgcgaagcgttagccggagcccagctaggatttcaaggagcccacttaggccttctaggagaagccctatgagaagtccacgacggaacattcacagaagtctcagcaggagccctgcaagaatacttagaagtgtgagcagaagtccagtaagaggtggtcgacctcgccggaacattagcagaagtcccagtccacttcgcagggcattaacaccaccaaacaatggaaggagccgatctaggagtgattctcctgatgggtcacccaaacgcataagacgtggacgtggttttactcaacgctattcatttgcaagacaatatcgctcaccttccgctgatcgcttgcatcgctatggcggaagaaatgaccgtgacagatacatgggttaccg

SEQ ID NO: 73671 - DNA, 460 bp, Zea mays
  unsure at all n locations
  Clone ID: LIB3079-035-Q1-K1-G6
ctgcaagctccaccgacttttatggcagtgtgacctcctatttccgtctctcctcctggtgcaactccaccgcaaggtcccattgcattgacaccaccaaatatgcccaccatgtaccgcggccagcatccaccagtaccaaatttcactggttcagcgccattggtttccaggcctcctggtggtggggctcagtcttttcctacagctgcgcctcaaggcccttcctcagtagcatttcccggtggaccatcgctgcggccaccttaccctccggcgcctgatcaagcgagggggccaccttcagctttctctccagttggatcaactcctggcatggtgcctccacctattgcatcttccggcctgcctgccccgcgtactgcgaacactagctgcatccagacacaagtagtagcccctttgagacctncgntcccagccgcgggcgaatttactt

SEQ ID NO: 73672 - DNA, 386 bp, Zea mays
  Clone ID: LIB3079-035-Q1-K1-G7
cagggtcgagccaggcgtacgcgtacgcatccgatatgcgcccgggactgatcctatttctgtacaactactacaagcaccaggtgcgaggaatgttggaggccgttagcttcaggcagacggacatgcacccgaccgactgagaagacaaagaggaccgccgcaacgtctggctttccggcacatgcgctgttcagcaacccggaagatctacgacccgctcgaggaagacgccttacgcaccgtcctagaccaattcgacgaccatagttacggcgttgagctgtacttaccgatgaccatggcatgctcaacaaccagtgcgactaggactaagactgttgccaatctgaactgtcgcagggtcaatctaagctagtatgcac

SEQ ID NO: 73673 - DNA, 315 bp, Zea mays
  Clone ID: LIB3079-035-Q1-K1-G8
gcggccgtacgagacgcatgcagatctttgacattaccttgactggcatgacaatcagccttggggtggagtcctcagacaccattgacaatgtcaaggcaaagatccaggacaaggagggcatcccacctgaccagcaacgtctcatctttgccggcaagcagttggaggatgggaggacccttgctgcataccacccctaagacgcaggatcaagtccatgttgtataactacctagaggtgcgattgcgagtgtaacggtggaagtgcaagaagctaacagtgaagccgtggtcagctgccacaaggtgctc

SEQ ID NO: 73674 - DNA, 458 bp, Zea mays
  Clone ID: LIB3079-035-Q1-K1-G9
ccgcctccctccgcttctctcggtcgccgagctgcgcggctgcatcgcgcgcgaacgccggctagcaggcacggaagaagttcgactccgcttgatcctgcgggggaagacgctcccgcaccaagacgacagccatgtcactctccgcgatggggatactcttatagtcgccgtggcacctaagcctcctgttaatcatcttcttgatgatgacgttgaggacgaagaagaggatgaactgaagttcagaataccacaaacgacaaccttgtggaagaggaaattttttatgtttcttcgagacaaattgagattgcctgatatcattttgatggcgctgttttctctcagtatgaaagcatggattatcattgcaatgtggttcctattggcaccgattgctcagaagtacgacattggacctttatatataattggtactggtttcttgatcatac

SEQ ID NO: 73675 - DNA, 242 bp, Zea mays
  Clone ID: LIB3079-035-Q1-K1-H1
aaaaaaaaaaacacaataaaaaaaataaattataacatacaaaataatataaaaaaaaaaagggaaataaaaaaaaaagaaattagataataaaaaatggcggatgctttggaggctcaggtcttgctttcacgagcgtccaatgtcttactttttgtttcgggccctttaaatatattttagtggccggtgttttaaactgctgggcctgggtaaacccgggctttacccagcttaaccgt

SEQ ID NO: 73676 - DNA, 404 bp, Zea mays
  Clone ID: LIB3079-035-Q1-K1-H10
cccacgcgtccgggacaggaggacggacgccagccgcccagcagccaccgctagtccggtgctccgctagccgctagggcagggcaagtgtgtgttgtccgccagcctgaccgcctctccgcctccggtgctcacccagtcggccagtcgcccgcctcgtcggccgccgcctcgccgcgcgcagcgcgctgccaggaaataggccgccaggcgcccgcagtgcctgtccggcgtggtgacgtccgcctcaagctgtcagactgccgctcgacgctcgttacgcacgccgtcagcccgctagtgtaaggatcagaaagtctgccacaggcaacaagtgaggaacctagcctagctacgaggattcaaggaacatgggagaaaatgggtacaactaggacaacagc

SEQ ID NO: 73677 - DNA, 422 bp, Zea mays
  Clone ID: LIB3079-035-Q1-K1-H11
cccacgcatcctaggactcagcagcatcgtttaccactgcttctgtccctacctaggctagtcatcaaccacatgctctcagtgctcttcatgcaagcaacatctaccaaccatacctatctaatttcaagctcctctcttcacagtcagatgctccaacaacttcaggacagtgacctctatagcaaagtatgatgacaggacattgtccttggatctgaaggatctgcactcctctaccatccacatcaaccatgatctatgactatcacccataatcttcaccattattcagatcatgaccttttacacatccgttgctcaacttaaacctatgcaatcttgactaacagaacagatacttctattcatcagcacgcatatgatcttcatggcatctgtcttaaccatcatactaccat

SEQ ID NO: 73678 - DNA, 200 bp, Zea mays
  Clone ID: LIB3079-035-Q1-K1-H12
tcccacacatactaatacttatcacctgggattaccactgctactctccctacctaggctagtcacctacctcatgcgctcactgctcttcatgcaatttccttctactaccctacctatttttacaagcttctccttcacaacttatgctacaacagcttcaatccaattacatttttcgcaaactatcttgaccccac

SEQ ID NO: 73679 - DNA, 450 bp, Zea mays
  Clone ID: LIB3079-035-Q1-K1-F8
cttcaggggagcaaaaccttgtcgcatgggctcgtccacttttcagagaccgaaggaagttctgccagcttgctgatccattgttgcatggcggctacccgaaaaggggtttgtaccaggccttagctgttgcagctatgtgtttgcaggagcaagcagcatcccggccgctgataggagacgttgtcactgcactgtcttacctagctgcacatccttatgatccaaatgcgccttccacaaaggattctaagacctgcccgtctaccccaagggcaaagacacaccgacgaaccaccagtgttcctgatgctcaacatgctgctgagtcgcttattttgaacttcccagacatgaggaaggagactgtcagaggaggggaattcgagaaggatcgtactgaaggttctggcagcagcagtagctctggaaggaacgattgcctggatg

SEQ ID NO: 73680 - DNA, 370 bp, Zea mays
  Clone ID: LIB3079-035-Q1-K1-E12
aaagacattctcattcacttgctaacgatacaatgagatccatctcattatcaggaaggttactacttacacttacaacctattaatcaacaatcatttactcaaccaattcatacacaacatccctaccaaaatcagtcctattgccttacaaactagatctacctactattattcctataccactgacccaactactgccaaattaacctcttactctatctacaatcacttaactaacattactacctaaagcaccaataccttacaatatattcaataacgacaaaataatcccttgactacctaatatctatccaatcactactacttattctatcaattgcttaattaacttgctgttgccatc

SEQ ID NO: 73681 - DNA, 435 bp, Zea mays
  Clone ID: LIB3079-035-Q1-K1-E2
ggcgatacgggacgggccgcggaacgactggagccggcccgagatccaggccgtgtactgctcaccgctcctcgacctcctgtttcacggggctcaggtccacagaaatgtccataaattcagagaagtgcagcaatgcacacttctttcaatcaagactggtggatgcagtgaagattgttcttactgtcctcagtcatcaagatacaacactggattgaaggcccaaaaattgatgaacaaatatgctgtcttggaagcagcaaaaaaggcaaaagagtctgggagcacccgtttttgcatgggagctgcatggagagaaaccattggcaggaaatcaaacttcaaccagattcttgaatatgtcaaggaaataaggtgtatgggcatggaagtctgttgcacactacgcatgatggagaacaacaagctgat

SEQ ID NO: 73682 - DNA, 453 bp, Zea mays
  Clone ID: LIB3079-035-Q1-K1-E3
tgctgagtcacgaaaaaggccagaagaaatgcgcagcagaactagagtaagaggttactctggtcatgaaggtcgccggtcttcttactatggtcggtctcgttctcgctctcctcgctatcggggccgtcctcggtcgagatcatactctcctgctccaaggcgggggaatgactactctgcctctccaaggagacaggaagcccatcgctcatctcctcccaggcgcctgccaaaggagcatgatgaagataagaagcggaggtcctactctcctgccagtagagatgatgctgacaatgtttatgagaagaggtcgcccccagcagacagcgatggatctcctctgcaccgcaggtcccccaaggagtactcgggctcaccttctggatcccgctccaggtccgccgacgattcctctgttgccagtgactgatcgaccgatggatgcta

SEQ ID NO: 73683 - DNA, 457 bp, Zea mays
  Clone ID: LIB3079-035-Q1-K1-E4
atgggtcgtattttacacagaatgccccctgaaggtggtagctgctaatttgtgtctccgtaacaaggttatagcacccaaaattccatgggacagacacaaatcagaatgtgactcagtgtcagacgcaagccaaaggtcagaggatcaggatgagtgtggcatagttgacgcattggcggcagcaataacacgtgttagaatatcagagccaaagagaagtcggctctgtagccccgcaattaccattcagcaggaatgctcgtcaaacttgaagaataatctttgcacggctttctgacctgacctagtttatagcacctgatcggaatggcgtccattcttctcgctgagaaggtcgttctgatttaggtgttgtagaggcgaggataataactcagcttttccagccagcaacaaacgtctggtatttagtgtttctttcagtgttcctgat

SEQ ID NO: 73684 - DNA, 189 bp, Zea mays
  Clone ID: LIB3079-035-Q1-K1-E5
cagctgcactagagtaagatgaggctcgagtcattaacgctcccggtcgacgtactattgtcgcactcattctcactcttcttgctatcatcgcctccctcgctctacatcatactctcctgctccaatgctttctaatgtctacacttcctctctaacgtgacacgactcccattgctcatctccttc

SEQ ID NO: 73685 - DNA, 164 bp, Zea mays
  Clone ID: LIB3079-035-Q1-K1-E6
acgcccacgcgtccgaaaaaaaaaaacaatactttatcatttatgtaatatctaataaataatgggaaagtaacaaacctatacctcccaaaatttcatctgacttacccttatcatacccttaacttaataacctactctctccaaatcttatattataatta

SEQ ID NO: 73686 - DNA, 330 bp, Zea mays
  Clone ID: LIB3079-035-Q1-K1-E7
tgctgagtcacgaaataggccacatgaaatgcgcagcagaactagagctagaggttactcgggtcatgaacgtcgccagccttgttactatggtcggacgcgctctcgctctcctcgctatcgcggccgtcctccgtcgacatcatactctgctgctccaaggcggtggactgactactctgcctcttcaaggagacaggaagccgatcgctcatctactgccaggcgcctgccaaaggagcatgatgaagataagaagcggaagtcctactcttctgccagtggagatgatgctgacactgtgtacgagatgaggtctaccccagcaga

SEQ ID NO: 73687 - DNA, 422 bp, Zea mays
  Clone ID: LIB3079-035-Q1-K1-E8
cccacgcgtccggaactttgctggaacctctactcaacagtttaagccacaacagagcattcatgaagctggagtgtcaaatcagtatcaagctgctttaacccagaatgtactgccagcaatcgctcagatttcacagctagttgctgggagccatcgtccagttggcatcccaaatcaggcccttgctgttccgcctcaatatggtagtggtagtgcaaattattatggagtgacgtccaccaggccatacaggcccatcactctacctgctggacctggtgctttgaatggtccaagtgcgcaggcatcttcaagatcaaggctctattctggagatccccttgcggctgtctcccgatcatcagattagaagggatcgtcttacaagtattctttgaccaatatgtcaacttatgatc

SEQ ID NO: 73688 - DNA, 456 bp, Zea mays
  Clone ID: LIB3079-035-Q1-K1-F1
cccacgcgtacgacctcctatgccctggggtcagtcatcaaggccagttaacggctcccggcatccccaaagtcctaaacactatgggtatgctccaatcagcggtgtactttcagcaccaccagttggagctcatcacgtcccaccgtctgatgggatgcagccactatttgtagcccctgctcctatttctgctgcagccatacctttcacgccaactgttcccttgcaaaatacatcagctgcttggatacaagaagttactccaaggcctgctacgacacgattccctggtcctggtacgggggtcttacttgctccgggatcaggccaccctctgcctcatcagatgatgccggcttctcatggccatggcgaacccaactatccacaaggttcatccgcttacctgcatagtaacgtcaatggcacagagacatctaatggcaatctttc

SEQ ID NO: 73689 - DNA, 458 bp, Zea mays
  Clone ID: LIB3079-035-Q1-K1-F10
gcttggagcggtccaagcgccctgcgaagcaaactacgccgatggcttcggcggcggcgtgggagggtccgacggccgcggagctgaagacagcgggggcggaggtgattcccggcggcgtgcgagtgaaggggtgggtcatccagtcccacaaaggccctatcctcaacgccgcctctctgcaacgctttgaagatgaacttcaaacaacacatttacctgagatggtttttggagagagtttcttgtcacttcaacatacacaaactggcatcaaatttcattttaatgcgcttgatgcactcaaggcatggaagaaagaggcactgccacctgttgaggttcctgctgcagcaaaatggaagttcagaaggtcatctataactgtaattcattttagtactcaattcagtactaccgagcatttgtagtgaaagatgttaggttagtttggcatc

SEQ ID NO: 73690 - DNA, 457 bp, Zea mays
  Clone ID: LIB3079-035-Q1-K1-F11
gtccgcggcggcgaccggcggtgtcgcgaaggtcgtcgccccgaggaggaagagggcgcgggcgggggagcctgctgcctccgtgggcgctggtggggacggcggaagctgctacatccacctgcgtagccgcatgctgttcatggcaccgcctcagccgcagccgccgtcggttccgaccccggcggaggctgctgatggcgctgcaggacagcagggcgcggcgctcgcggccgggctctcgcgttgctccagcacggcgtcgtcggtgcacgtggggggtcagcgcgggagccacacctgccgctccgacgacgctgcagaggctggcggggatcacgtcctggtggatgtctcggcggcgagcaactccgggagcggcccagaccgcgagaggcgagagacgacgccatcgagccgggcgcacggcgagctcagcgatctggagtcggatctg

SEQ ID NO: 73691 - DNA, 221 bp, Zea mays
  Clone ID: LIB3079-035-Q1-K1-F12
ttccctcttgtacaccttcagttcctcgattttctactcccataacacaaatagggcgcgtgttattcaacctgttagactccaaaaacactgatctcgactgatgaacctactacattcacctgccaaaccgcatgctcctcattgtacctactcatccatagcctcctttagatacaacccacacacatgctgcttattgcactacatgacatcaaggc

SEQ ID NO: 73692 - DNA, 366 bp, Zea mays
  Clone ID: LIB3079-035-Q1-K1-F2
acaggacacgcgtccgagacaacgagagctcggcttctatatttacttatgcgcgatcagatggtgaagctgctggcgatgcaagctcgacgcagcaagtgttaaaagactttcatgtccatacatatactgctggcgaaacataagaagcatgtgaggtagctcgaaacagcatagaacttcattgaactgctctttcctcttatgctgagcatgatgctctaaaggatgactcgacgaccactctcatgcaacactgctaccgatctcagcacactctgcatatgattattgatagcgtcggagacaatgaagctgcgctatctgaggtctagagcgtgaacgacgagatcgatagcgtattat

SEQ ID NO: 73693 - DNA, 345 bp, Zea mays
  Clone ID: LIB3079-035-Q1-K1-F3
aaaaaaaaaaaaaaaaaaaaaaaaataaaatttaaaaaaaaaaaaaaataaaaaaaaaaagaggaaaaaataataaataaaaaaaacaaaaaaataaataaaaataaaaaaaaaaataaggggcgcccgttttataggttcaaagtttacttacccttgcttacaccttcattgctttttaatagagtcccttaatttcaattatctgcccacttttttacaacttcgtctcttggaaaccccttcctttccccaattaattgaccttctaacacttcccttttagtcctttttgctttttaccgaaaaggcccttccctatcttttttccaaacatttgcccat

SEQ ID NO: 73694 - DNA, 359 bp, Zea mays
  Clone ID: LIB3079-035-Q1-K1-F4
acgaaaaaaacaatgaacgcttggtttctttaaatactcaaaaacgatcagaaggtgaggctgctgtcgattcaagcttggcataagcacgtgttcgaagacgtgcatgtacatacatatactgcttaaaaaacaaaagaagcattagatgtagctcgtaacagcgtagaacttatatgaactcgcctttcctcttctcctgagcacgattctttacaagatgacttgacaaccactcttgtgcaacaatgctagcaatcttagcacactatccatatcattattgagaccgatggagacaattgatctgagctctctgatgccttgagcgttaacgacgagatccacaaagtgttatc

SEQ ID NO: 73695 - DNA, 406 bp, Zea mays
  Clone ID: LIB3079-035-Q1-K1-F5
gcaaggatgcccccatgtttgtcgttggtgtcaactagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaaggctgttggcaaagtgcttactgtccttaacggaaagttgactggaatgtctttccgtgtcccaaccgtcgatgtttctgttgttgatttgactgttaagcttgaaaagtcagcaacctatgatgagatcaaggc

SEQ ID NO: 73696 - DNA, 460 bp, Zea mays
  Clone ID: LIB3079-035-Q1-K1-F6
cccacgcgtccgtgacaatgagagcttggctcctatatttactcccgcgcgatcagttgctgaagctgatgttgatgcaagcttgccccagcaggtgttcgaggacgtccatgttcatacatatactgctgaagaaacaaaagaagcatttgatgtagctcgtaacagcgtagaacttctttcaactgttctttcctcttctcctgagcaggatgctttgcaggatgacttgacaaccactcttgtgcaacaatgctaccaatctcagcacactatccagatgattattgagaccgttggagacaatgaagctgtgctctttgaggccttgagcgtgaacgatgagatccagaaagtattatcgaagtacgaagagatgaagcagcccatggccttcgagcatgcagaacatgtaccagttgtcataccgattgctgcggagcatgaagatttgaatgct

SEQ ID NO: 73697 - DNA, 368 bp, Zea mays
  Clone ID: LIB3079-035-Q1-K1-E11
cgtccgagtcaacctgcggcagtctacgctcctgcagatgtgcatgaatacatgtgacactgcggatggcgtgttcacagattgacggatcctagatctagattaagagctgggtatgcctcttagctgatgtaagcactctcgatagacacttcatctttactggcgcggacactgtccgatgatctgagactttaccgaacaatttgctggactcaaccgatactgtgtccacctgaaatctggtgtctatgatgacttgacagagcatgcatgatgacacagacagacagtgtctcatatactacaccgctgactacacagatcaactaatgttcaaccttcatatacgcatcactggtctggac

SEQ ID NO: 73698 - DNA, 385 bp, Zea mays
  Clone ID: LIB3079-049-Q1-K1-B9
gacgcgtgcgtgcgacggcagtatccgagctcgcactcgttcactccgtccatcgcatcgcatctgtcctcgcatgccctcagcgccaccgcaccgcaatcacacgcgcgccacccgcgatgacgccggcggcggcaatcttcggctacagcagccacgtcgtcgtgttcttggtcgggctgatgcagccgagcatgctccgtgcgctcaccgattggcccatcgccgccgtcatctatgacgagactctccacgactgcctgaacgagatctcgtgcactctcctacaggccgatgtccagttcaagatggtccgcgacatgtttgccaacattaatcgcatcgtcaaacttgaggcgcttgccgcatgcaccaacaagcgccg

SEQ ID NO: 73699 - DNA, 458 bp, Zea mays
  Clone ID: LIB3079-049-Q1-K1-C1
gcgtccgtgaatgctgcgcccatctacaagttctcgtaatctagcaaaggtggccttttcgtctgatcttcaagtggaacttttccaagttcttggttgacaaggagggacgtgttgtggatcgctttgctccaaccactttacccctgttcattgagaaggatttcatgaatcttcttgttagctcttaatcattatctttgttcaatgctttttattattttgttttttcttttcttctgttattattttatttttatttgttttttttttttaattttttttttttttttttttttatttttttttggtgtttttttctttttttattatttttttttttttttttttttttttttttttttttttttttttttttatttttttatttctttttttttttttttttttttttttttatttctattttttatttttttttttatttttttattttt

SEQ ID NO: 73700 - DNA, 433 bp, Zea mays
  Clone ID: LIB3079-049-Q1-K1-C11
gccaatccgaaatctcgagctttcgcgccggcgactcacagcaaagaggaggccacagcacgacagcgccccagggttcctactctcgtcgcagcggcagcagtgaggggaagatgtcgtcggtgttcagcggcgatgagaccgcccccttcttcggcttccttggcgccgccgccgctctcgttttctcatgcatgggggcggcgtacgggacggccaagagtggcgtcggcgtggcgtccatgggtgtcatgcgcccagagctcgtcatgaagtccatcgtgcccgtggtcatggctggtgtgctcggtatctacggcctcatcatcgccgtcatcatcagcactgggatcaaccccaaggccaagccatactacctctttgacggctatgcccacctgtcgtccggccttgcctgtggtcttgctgggct

SEQ ID NO: 73701 - DNA, 253 bp, Zea mays
  Clone ID: LIB3079-049-Q1-K1-C12
gcgcggcaggaggacgttctgaaacacgagtcactgggctgctacgtcacgcactgcggcgagaactcggtgctggaagctgtgctgcaaggggtccgcatgatctgctaccctgtctccgcagaccatttcgtcaactgcgcctacgttgttaacttgtgttaaagcatgagtggacctgcggatcagatgacagtgaactgcgacgcgccgctcttaatgcggcatgcgctgctacaagtggaggactttt

SEQ ID NO: 73702 - DNA, 457 bp, Zea mays
  Clone ID: LIB3079-049-Q1-K1-C2
cggaacgtccagaaatcagtggcgcttcttatagcaggcatgcctggattcaggcttctgctatgttgtggatcatgggataagccaagagttcatggatgaagtttttgcccagagcaagaagttctttgaccttcctcatagtgagaaaatgaagcttctccgagacgagaagaatagagggtacacacccatgctagatgaaattcttgatcctgaaaatcaagtttatggtgactactattgttgatattatattggagttgatgtaccttgctaattattcataatcatatcttctatttttatggtctcatttcattgctcttttatataagtttctactctaatttgtttgtaatttattgttcttttttttatggtatggttttttttattttttatattttattttttatatttattttttttttttttttatttattttttattttt

SEQ ID NO: 73703 - DNA, 389 bp, Zea mays
  Clone ID: LIB3079-049-Q1-K1-C3
tggcagcctccaggacaacttctttgtcagttttgctctgggttggctgatcaccagcggtgctggtcttgcatcttaccccattgatactgtccgcagaaggatgatgatgacttctggtgaggctgtcaagtacaagagctcattggacgcattccagcagatccttaagaaggaaggccccaagtccctgttcaagggtgctggtgctaacattcttcgtgccattgctggcgctggtgtgctttctggctacgaccagctccagatcctcttcttcggaaagaagtacggctccggcggtgcttaaatggagaaaaatgatgacgaacaagagcagttcgctcccggtccagcccaatcaggatctggtcaagttttttgccttt

SEQ ID NO: 73704 - DNA, 284 bp, Zea mays
  unsure at all n locations
  Clone ID: LIB3079-049-Q1-K1-C5
gcgcgcacgcgtccgcccacgcgtcttgtctccaccactgctccgcccgcgccggatcganggaggtgcaggcggacgaggaggagggatgagtctcttcgggcttggacgaaaccagaagacattccgccccaagaagagcgctccatcaggtagcaagggagcacagctccgaaagcacatagatgccactctcggcagtggaaaccttatggaagctgtgaggttgcctcctggataggatatcaatgaatggcttgcggtgaatactgttgatttcttta

SEQ ID NO: 73705 - DNA, 416 bp, Zea mays
  Clone ID: LIB3079-049-Q1-K1-C8
gactgcaaggtcgtctacgacaacaaagaaggttctattacgtctgtccaggctatatatgtgcctgctgatgacttgacagatcctgctcctgctactacctttgcccatcttgatgctacaactgtgttgtcacggcagatctctgagcttggtatttatcctgctgtcgatccactggattccacatcaagaatgctttctccccacgtgctgggtgaggatcattacaatactgctcgtggtgttcagaaggttcttcagaactactaatatcttcagggatttattgctatctgggtattgattttcttagttgagtttgactagtgtcctttttttctttctttttagtttatcttttttttatctttttttttattttttttaatttttttatttttttttttttttat

SEQ ID NO: 73706 - DNA, 369 bp, Zea mays
  Clone ID: LIB3079-049-Q1-K1-C9
attccccgcccgacccatacgtccagtcacacttccgtatcacttcttctttttttcctttatctccctgaatcaccatttgccggctacttagagttccaaaataaccaaatcatacttacagattctcatcataatacaattccttacctacaaatctacactatacaactacctaccactactttcataacaccttcataaactacaccgaaaacctatactcaaaaatcatcctatacacacacacacatatgtacctctaattaaacttcaacaacttatccacgtatcaaacaatgccgaaatccattaacatcattaaccccaatcatctctaccatcatatcatcaacttctactaatccc

SEQ ID NO: 73707 - DNA, 109 bp, Zea mays
  Clone ID: LIB3079-049-Q1-K1-D10
gttggtgttggtgctcggagagtgaggtctttgtttcaagctgcaaagaagaaggcgccagtcattttcttcattgatgaaatagatgctatgggttcaactagaaaac

SEQ ID NO: 73708 - DNA, 101 bp, Zea mays
  Clone ID: LIB3079-049-Q1-K1-D11
aaaaaacaaacaaaaaaaaaaaaaaattaatttaaaaaaaaaaggacctacaatctagggggggccatcttacgtactcttacatgcaacactctatctac

SEQ ID NO: 73709 - DNA, 369 bp, Zea mays
  unsure at all n locations
  Clone ID: LIB3079-049-Q1-K1-D12
cccacgcgtccgcccacgcgtccgcccacgctttcgcaccatgaagcatttgctgaagatgcctgcatgagagaagaataaggtctgagcatggtcctgcttgaaattttggccgctcaattctgcagctagcagaaaagcactgcttctttctaaggcatgggagtgccgtatgaagcttacaatagaatgaagcagcctcgcccgcaattctgttacctagtactaattgcgttgtgtcacgtgatagcttatgtacctgacatattcttttattctaattatactcattcatctacctttcgagtttcgactgtacatattatccaccgngtggaatggaaggactgagttaacatgtgatacgaa

SEQ ID NO: 73710 - DNA, 329 bp, Zea mays
  Clone ID: LIB3079-049-Q1-K1-D2
aaaaataaaccccccccacccaacaaaaaaaaaaaaacaaaaacaaaaacaaaaaaaaaacaaaaaacaacaacaaaaaaaaaaaaaaaaaaaaataaaacaacacaaaaacaacacaaacaaaaaaacaataaaaaaaatcaaaaaaaaaaaaaaaaacacaataaaaaataaaaaaaaaacaaaacaaaaaaaaaaaaaaaaaaaacaaataaaaataactacaaaaaaaaaaaaaaaacaacaaaaaaaaaaaaaaataaaaataaaaaaaaatacataaaaaaaaaaacaaaacaaaaaaataaaaaataaaacaaaacaaaaat

SEQ ID NO: 73711 - DNA, 140 bp, Zea mays
  Clone ID: LIB3079-049-Q1-K1-D6
aaaaaaaaacacaaaaagctaaatcaaacaaaccaacaaaaaacaacaacccgcaccataaaaaaaaagaaaacaccaccacccccacaaaaacaaaaaacaaaaaaacacataacaaaaaaacaaaaacaaacaacaaa

SEQ ID NO: 73712 - DNA, 383 bp, Zea mays
  unsure at all n locations
  Clone ID: LIB3079-049-Q1-K1-D7
ctataatatttatttgctagttagagtnttatacttacgacatgctagatgtggttatccttatagttggttagcctattgtagaaggtggttgaacttgtactttgagaccaaatatatattgcatacttgatattatactattatttgagcttgtcttattgtactcttatctgttcttatgaaggttagaggaatgtgtttggggtgagtaatttttttgtgttgtttcctctatccatggccatggaggagcaaaggaggccacctagctcgaagatagcgccagtgtccatgaaggcgtcctctgcaaatgcgacgcttcaaggcatgaagaacagaagccattttcgaagggacaggaaaactgcgctgcaacaaga

SEQ ID NO: 73713 - DNA, 376 bp, Zea mays
  Clone ID: LIB3079-049-Q1-K1-D8
cgaggatgataggcctatagagctaaatctttctaaccagcaaatttcttcacggcggtctaactacgaagatgtcacaagagatggccaggacaatcttcacgatgacagaaatggaggaagtgttcctgctgctgtatcaagggtgccctctccttcagttcctgcaacaactgttcctgcagtacaggtgaatgggggtcatgacagcactgttgaagatgtacctgcaccaccactgctcatgccaggcctaatggatttgatgagtttgatccacgtgaatctgtcccagattgttcccctcttgtaaaccctgcattaattcctaatagcttggagaaggatttgtttggatcagatcctattagtttcg

SEQ ID NO: 73714 - DNA, 198 bp, Zea mays
  unsure at all n locations
  Clone ID: LIB3079-049-Q1-K1-D9
cgcaggcatggaacaagcgacatgggcgtctactcctttgtgtgccgcaacaacggcgtcgangggacctccaagcagcactccggcgagatcgaggcttccgccgctaccccatacgagctgcagcgccgcctcgtcgctgccgcctccgcggccgactctgcctactgcgtccagtcgtcctatctcatggtcacc

SEQ ID NO: 73715 - DNA, 316 bp, Zea mays
  Clone ID: LIB3079-049-Q1-K1-E10
cgaccgacgcgtgcgtccacgcgtccgggacgccttccacggcgtctagttaccacggcggcgtccacgacggcacgaccgtcttcctctgggagtgggccaagggcgacaaccagcgctggaagatcctgccctggtgaacgtgaacagagacgagctagatgaatccaaggaaccttacctagctgctgccgccgtcgcctaattcgtcctgctccgctctaagctgtatctgtcttgggcttcgcgtactcggttcctgaaaggacgaataatatatagcatgcatgtaccggtagcgaccatgtctgaatga

SEQ ID NO: 73716 - DNA, 452 bp, Zea mays
  unsure at all n locations
  Clone ID: LIB3079-049-Q1-K1-B8
cgagcatagatctcgtgctcgcctcctttattctgcacagcaacgcatcagccttgtntaaccatctcgccgccgccacaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgtcgtcgtcgcgtggttttttgtttttttttttttttttttgttttttttttcttgttttttttttctttttttctttcttgggtggggtggtttttttctttttctttttctcttttttgttttttttttgttttttttttttttttttttttttttttttcttttttttctttttttcttttttttgttttttctttttttttttgttttttttttctttttttttttttt

SEQ ID NO: 73717 - DNA, 155 bp, Zea mays
  Clone ID: LIB3079-048-Q1-K1-H7
gtagtcgttatttgtgtgtacggaataaagtggtgagcgctgagacttgcgtgtcagcctagtaataactaaagtaatggccgagttcacgtaacgtgctcgccgaatgtacgatcgggtgtaccggccggacgtatgtacaagcccagtgcaat

SEQ ID NO: 73718 - DNA, 369 bp, Zea mays
  Clone ID: LIB3079-048-Q1-K1-H9
aaaaaaaaaaaaaaaaaaaaataaaaaaaaaaaaaaaaaaaaaaaaaaaaaaaaaaaggtaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaattcccctttttttccaacttttttaaaaataataataaaaaacccttaaacccaataaaaaaaaaattatccccctctccaattttttttttttccaaaaaaaaaaatcaaactccctttccttctacttttttcttttcctccttttttatcttaaaataaaatcttttttatcccccctaaagaactcttaaaatattttttttttttctct

SEQ ID NO: 73719 - DNA, 362 bp, Zea mays
  Clone ID: LIB3079-049-Q1-K1-A1
gcagcacggtagcagtttgaccgttgtctttggtgatgtcagcagtagggagggcagatcatgtcgcctctgccagctgctgtgatctgaagaggcgtttagctcatcatatgcctttagtcttttgagaggtctttagggttgaaaggtacttcgaaaaccgaaccagcgtctacaggcctaagagggatttccattgaaactcgtcgatgatactacagttttctttccccatctgtgccggttgtgttgtactaccactaccagtgacagtgagtgacttctaagctattcatttttttaactggagaagttgatatcatgataattaaaaaaaattgggtgtgtattgaactattacc

SEQ ID NO: 73720 - DNA, 399 bp, Zea mays
  Clone ID: LIB3079-049-Q1-K1-A11
tctgacacatcgcaaaaaaaaaaaaaaaaatttatttaaaacaaaataaaaaaactaaaaagaaaaaattaaataaaattacaccaataacctaattatatttaccaaaaaattttcaatactagcaaatcaatataatccactaattctttggactataccacaaatttctcacacatgctatattttcacgacccacaaatactctatctaatccggctctatataacaattcacactaatcatcatatcaccaatgtcagtgctcatactgttcatctggttggcacttctctgtcaaatccttatctttctttcgcatccactctaaatggtctaactgtaccactgcatgtcctttcaaatcatgaactgctcttatttatcaaatctgtaatt

SEQ ID NO: 73721 - DNA, 199 bp, Zea mays
  Clone ID: LIB3079-049-Q1-K1-A12
gcatgttggcggagatatgttcaagtccattccctccggtgatgccattttcatgaagtagtttctgtcgacgtggaccgacgacgagtgcacggccatcctgaggaactgccacgccgctctgccggacggcggcaagctcgtggcctgcgagccggtggtgcctgtggagacggacagcagcaccaggacgagggct

SEQ ID NO: 73722 - DNA, 274 bp, Zea mays
  Clone ID: LIB3079-049-Q1-K1-A2
cggatttcctcaccaaggaggtgcagttctaggacaggctcttcactctgcaaatatggggcactgctggccaggaaaggtttcagagtctcggcgttgcattctaccggtgagcagattgctgtgtcctagtctatgatgttcattctatgaaatcatttgacaacctgaataactggcgagaagagtctctaattcacgctagcccatcagatcctgacaatttacctgttgttctcgtgggtaacaaagttcatgtagatcgtggcaacag

SEQ ID NO: 73723 - DNA, 341 bp, Zea mays
  Clone ID: LIB3079-049-Q1-K1-A3
ggatttcctcaccaaggaggtgcagttcgaggacaggctcttcactctgcaaatagggggcactgctggccaggaaaggtttcagagtctcggcgttgcattctaccggggagcagattgttgtgtcctagtctatgatgttaattctatgaaatcatttgacaacctgaataactggcgagaagagtttctaattcaggctagcccatcagatcctgataatttcccttttgttctgttgggtaacaaagttgatgtagatggtggcaacagccgcgtggtatctgagaaaaaggcaaaggcatggtgtgcttccaaagggaacatcccgtactttgaga

SEQ ID NO: 73724 - DNA, 362 bp, Zea mays
  Clone ID: LIB3079-049-Q1-K1-A4
tggaaaccatgctctccaaaattcacatgaattagattggtcaccaaataaaaaaaggcagagctcattccagaattctaatgtgaggaaggtgtacgtttgatcatttgttcatccattgtatatgaatcatgcactaaattaatcaaagttttaacatatatattcaaaggctagaaatctgaacctaagtatgagcacccgatagggcatgttgtcgtagggtgtgtttgactatggtacatctggatgaacggatgtatgctaagttgaattgtattttaataaaaggtgtttgatgcggatgtatgaatggatgtaaaaaaatacagagattatttgggtgtatgagttaatgcaat

SEQ ID NO: 73725 - DNA, 230 bp, Zea mays
  Clone ID: LIB3079-049-Q1-K1-A5
ggagcgcggttgcttctgttccaggtttcttctctctgttccgcgtgcgatcgagtggatgaaaaggaggaggaggatggcgaggaattcgttcaagttggagcaccccttcgaaaggaggcaagctgaagctaaccgcatcaaggagaaataccctgacagaatccctgtcattgttgagaaggccgagaggagtgacatcccagacattgacaagaaaaagtaccttg

SEQ ID NO: 73726 - DNA, 311 bp, Zea mays
  Clone ID: LIB3079-049-Q1-K1-A6
agagagaagaatgcacacaagagtgattccaatcacaagaggacttatggaagcgttgctcgatgtactagtgcatcacgtgatgatcaggtgacagttcgagatggatattacacgaatgaagcacaagaaggatcatggcatgctcagaatgagccaggccttctgtatactgaaggaattcacaaattcatttgcggcaaaaacatttgcgacgaacagaccgttccagcagaacacagtagacacgatgtatgtcagggaaaactagaagaaattaaacgagggaaagaacatatcaaaatgcccca

SEQ ID NO: 73727 - DNA, 373 bp, Zea mays
  Clone ID: LIB3079-049-Q1-K1-A7
gcgcgcggatgacatattgaaaaatgtggaatatgatgctctaagggttattttgacggcttccattctgtcatatcgtttaagcccacaatggtaacgatactgtcccctgaggttgcagaaaaagaagcagaagctggtgggaagacgggtgacctagattcttatgagattgaaggcggtgagacaaaagcagagatattgcaaaacctagctgagttccagttttcttgtgtcatgtacaatggtgccctagagaatgcatgcagtgagcttggagcccgtatgtctgccatggacagctctagcagaaatgctggcgatatgcttgatcgtctgacgcttacttacgacaggacacgcctagcattca

SEQ ID NO: 73728 - DNA, 216 bp, Zea mays
  Clone ID: LIB3079-049-Q1-K1-A8
cgatatccaattttccctggagtgtgctattattggatgctctgcaggatttctagactttctaaaataaatggaacccatacagctatgaaatcaggtatgcttgcggcggaagcaactttcaagtccctcgttgaaggatcttacatggaactgtactgctagaacctcatgaagtcatggatctggtacgaacttcataaagcttgtaattat

SEQ ID NO: 73729 - DNA, 442 bp, Zea mays
  Clone ID: LIB3079-049-Q1-K1-A9
gtgtgaagaggcatttacgtggccctggagcaatccctatagggaggccttccattcaccgttctccaattgacctgaaagggaaggcttatgagttgctgcgagagaaggcttcaagcttcctccttgacgacttctacaggactccaggaggcattcagttcgaagggcctggttcagatgcaaagcccatcacgctgaccattgagaaccaggactacatgggtgacattgagatactgaaagagtaccttggcaaggttaggaccatggtgaagccagggtgctcccgggagatcctgaaggcggcgatcagttccatggtgtcggtgactgatgtgctgactgtgatgtcccaccccctcaacgccgagctgcccctctaccattttaagtgagcgagggcatcagtctggttagtattcctagaagtgttttgaaa

SEQ ID NO: 73730 - DNA, 382 bp, Zea mays
  Clone ID: LIB3079-049-Q1-K1-B1
ctatgttcttagtggaaaggatgggttaaatatccaacctttcccatatagaacacgtggaggaatcatgagtcctgttctacttctcgacatgagcaaacatggagacaatgcaaaagggctaactcttgcaacaacgtcctttgatggttatttatatttgattgagggatcgagtggctgtgcagatgttgttgacattggagagacctcgtacactatggttttggctgataacgtggatggtggagatgaccttgatcttattgttaccactatgaatggcaacgtcttctgcttctccactcaatcaccacaccatccgcttaaggaatggaggtcatcaaaccaaggaaggaataatgctgcatatcagtacaac

SEQ ID NO: 73731 - DNA, 433 bp, Zea mays
  Clone ID: LIB3079-049-Q1-K1-B11
ggaaatctgacttcgggagcggctcctccgcgttgcctggatcgcccgggatcagtattgtgcttccagtcagaggtccaaaatatcaaagggatgcagaaagatgtggttgcatgatggagtaccttgcctggaaattggcaggatacacaaacatagttgtactttacttgatctcgatgacattggactgcaaatatatgcacaacaattgcctcatgcacacacacataatggggccgcgagttgtagctcaaccatcgtctctggtttctttctaggtggagatggttaaaattgctggtcacttataattaccagcatcttatacgtcattgctgttcatcgccaacttattcaagtctgaaagtagaacactgaggagatggctgagaaagaggatattctaatgcagagatatgagatgggaaag

SEQ ID NO: 73732 - DNA, 405 bp, Zea mays
  Clone ID: LIB3079-049-Q1-K1-B12
caatgttttagccctcaatcttctttctattctattttatatctcacaactaaaaaattagtctgcaaccttgctgttagtgccttttcttatcttgtcaatgtgtccttccatcttgtattagtttgctttcgtttttacattaactagaacacatgctctggttgtggttacctctatttatgctacaggcttggttagctaccatatcactcgctatctacaacgctagtttgccgcatcgagaaatattatgtgatattgattgtcgagttcttttttctatatcaaaaaatttattacttgtattcatagtcacatttgatgcatttatgtatacattattaatttcatatataggcttttgatcatttcggcatgttaaaaaagaagaaatgcttctag

SEQ ID NO: 73733 - DNA, 184 bp, Zea mays
  Clone ID: LIB3079-049-Q1-K1-B2
tctacccactcatcctcgatattcttactataaaatatcacatatttaatccaacctttcacatatacaacacttggcaatttcaagatttctatactactcctctacattatcaaacatttatacaatgcaaaaatactaactcttgcaacaactttcttttaatcttatttatatattattt

SEQ ID NO: 73734 - DNA, 159 bp, Zea mays
  Clone ID: LIB3079-049-Q1-K1-B4
tctcctattccctctccacccactcttcctcgccagtccacccattccattccacttccttctctcacaatccactctaactcacactgacctacactacacattcatatcatgcttacactttccccatccccatcctcctcacatccaacccatctc

SEQ ID NO: 73735 - DNA, 344 bp, Zea mays
  unsure at all n locations
  Clone ID: LIB3079-049-Q1-K1-B6
aggacatctgccgccgctcccttgactttgagcgcccaacctacaccaacctcaagantcttgtctcccaggtcatctcatccctgacggcttccctgaggttcgatggtgctctgaacgttgatgtgaacgagttccagaccaacctggtgccctacccgaggatccacttcatgctttcgtcctacgctccagtcatttctgctgagaaggcctaccacgagcagctgtccgtggctgaaatcaccaacagcgccttcgagccatcctccatgatggccaagtgcgacccccgccatggcaagtacatggcatgctgcctcatgtaccgtggtgatgtggtt

SEQ ID NO: 73736 - DNA, 309 bp, Zea mays
  Clone ID: LIB3079-048-Q1-K1-H5
ctcaaggaaacctttatccatggctggaggtatcatactacttctgcttgtcatccccctcgtcgtgagaagggaatggagtgtcatgggggagagatccaactcgttctcacaggactccaataattctagccctgctgaaaacaaactcgaaccaggtcctcttttcatattggttatattggttatttattagggatcagtgagcttcgaattgagtaaatctgtaattacttctacactactaattatcattatgtgactgctcgtaaaggtgaaaagtccttcgcatcggaagcatactgtgag

SEQ ID NO: 73737 - DNA, 56 bp, Zea mays
  Clone ID: LIB3079-048-Q1-K1-E2
tgcaatattgataacctgaaaaatacatatgttttaaaatgtacaaccatctaata

SEQ ID NO: 73738 - DNA, 51 bp, Zea mays
  Clone ID: LIB3079-048-Q1-K1-E3
ccttattcccggctctacccactcttcctggagtctttctcctccctctcc

SEQ ID NO: 73739 - DNA, 320 bp, Zea mays
  Clone ID: LIB3079-048-Q1-K1-E5
gatcaacacagagtatgaaagatgccatggctgctctgaaccaggaggtgatgcagagtggccaggcaatgtataaccagcctggtgccagttctgctgggcctactcctggtgctgaggccggacctacgcctggtaccggaccaacgcagaatgattgggatgtcattgacgcagacttcacagatagcaattggggggtgattgatgcatggccatgtgttgagcaaggttggcgttaaggagtgaacaaattgttccttttttgtgttgggattgttactataggctatctagcatggagttgtttagatagtttt

SEQ ID NO: 73740 - DNA, 122 bp, Zea mays
  Clone ID: LIB3079-048-Q1-K1-E8
agagcatgcacatccgagaagaggattctacaccatccacagtaacatgcatgatggctacttgacttcgtcggggcagcataagctgtaagagcccatatcccctggtggcggctcctctt

SEQ ID NO: 73741 - DNA, 394 bp, Zea mays
  Clone ID: LIB3079-048-Q1-K1-E9
ggaagacacacaacgccaccatcatctccgccaatgacagtacttttacaaagtgggcaaggaaaacctacctgtcagccttcctcacctgtcacagcagatttgttcaatgcggcgaaaagtttggagttcggatccttggggccattctcattgggacttccctcaacctcgacacagtttgaggaagaattcccagcgcttcctactagaaagagagccgaaggccccatttcagtggcgcccagcgctaaggctgttgaaaccaaaagcaggtcagaagagagtgaagagatgttccgactgagaaatgaatctgatttccctcccctccaagctggctgccgctgagactgacaggacgtcgagataatccatgctaatcgtaatggta

SEQ ID NO: 73742 - DNA, 316 bp, Zea mays
  Clone ID: LIB3079-048-Q1-K1-F11
atcgccgtggacatggttaactagggtcttgttgagccccgctcaacgatcaggatggtagagtcaggccacctggaccaccttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagcccttaagacgttggtggcatgcactctgctttggggattcttacagagaggggtggcatgactt

SEQ ID NO: 73743 - DNA, 321 bp, Zea mays
  unsure at all n locations
  Clone ID: LIB3079-048-Q1-K1-F12
cccacgcgtccgccagcgttcggtttccacattctctaaccttgataatgatcggggacaattgaaacttcagaatctcanacgcggtccctaggttttccctggagaaacaactaaacaaatggcatcatcaagcttcatgggaaagagaaactgccgtagaatacctcccagaggagaangaaaggtgaaaaggaaaaaagtaaagcctgtaaagctttgtcactgataaattaaaaaggagctgagaaggaaacaaaaagagaagaagcaagaaaggcacattaaagaaaaaagagagaacccggaagcaaaaaagag

SEQ ID NO: 73744 - DNA, 156 bp, Zea mays
  Clone ID: LIB3079-048-Q1-K1-F2
ccgaggcagagggtagcctcaagggcattctgggttatgtcgaggaggaccttgtgggcgtttattttcagggtgacagcaggtctagcatctttgatgcgaaggctggcattgccttgaacggcaactttgtgaagcttgtgtcctggtacgaca

SEQ ID NO: 73745 - DNA, 135 bp, Zea mays
  Clone ID: LIB3079-048-Q1-K1-F5
cagcatttatccttgctaggcttctttgtctacaaataaacatggtatttttcaaggtagtcctttttttactatctcttgagaagtttatttttattattttacatttcataacattgttatatataaactgtt

SEQ ID NO: 73746 - DNA, 139 bp, Zea mays
  Clone ID: LIB3079-048-Q1-K1-F7
tccgcgaatttgctattggctcgttctgcccacgaccccggacgctatactttcagagttcagactcacaatcgccgggagccaccgcaattcccgccacacgtctgccgtcgacgagttggagtactgcgagttgtgc

SEQ ID NO: 73747 - DNA, 154 bp, Zea mays
  Clone ID: LIB3079-048-Q1-K1-F8
gctacgcctcgtcgtcatgggccgggtcaagtacatgagcgggccattcaggaccggatggctcgggctatacctgcgctgcgatgtcaccgtcggcctctgggtggacgccaccgcgggcgacgacggagccggggacgtgccactgctcgag

SEQ ID NO: 73748 - DNA, 280 bp, Zea mays
  Clone ID: LIB3079-048-Q1-K1-F9
aaaaaaaaaaaaaaaaaaaaattaaataaaaaaaaaaacgccgcccccccttggaaagtatacattattacatcctccatcctacaacataattattctataatatcaccaaaaaaaaataaactacccgccattttacaacaacttcactactaaaaaaaccccatcaccaaacaaaataatcttctagcaaatcatccttttttcacctgctttcataataaagaagaccccaccaatcatcattcttaacaacatttcatcactaataataaataat

SEQ ID NO: 73749 - DNA, 378 bp, Zea mays
  Clone ID: LIB3079-048-Q1-K1-G1
tgcttaatgagttagaagagctgaagattgaatctgagaacaggcaactgtctttgagacgagtgtgggaaatcaaagcatgctggtgtggaaaacctggaagacaacggtgttcacctgtctcctgatgaggatcaaaatgctagtccaaaacaaactactgtaaagaaattggaagtgtccccttcagtctccacaccaatttcttgggttaaaaaatgtgctcaggtgatattcaaacgctctccagagaagagtgctgatcccaacaatgatatacctccaaagttgggaaatgtcaatgactgtacctccttagctactgcctattcagatggattgtttgcttgtcacctggaaaatggtgctgagaaagta

SEQ ID NO: 73750 - DNA, 265 bp, Zea mays
  unsure at all n locations
  Clone ID: LIB3079-048-Q1-K1-G10
catggcngctggcgtggccattgcctactgcggcgcagaggcatcgcctncgcncgcgacggtcctctgtgcctcaaaangcccgtgcggcctttatcctggtgctatctcagttatggcaagtagtttcatggcaagttgaacatcttagcagaaaagtgccatgaatagtatgtagtatgtacgcttatgtttgtaacaatataaaaatatatatatatcattagctgcaaaaggaggtcgttttcttagaccttattatttt

SEQ ID NO: 73751 - DNA, 316 bp, Zea mays
  unsure at all n locations
  Clone ID: LIB3079-048-Q1-K1-G11
ctcccgaccctggtgcaagattaccttcggaacaattgtctttatagataaccggtctttccttagatactttatacagtcnaatgccgcattttagtcgatctttcttctccagttgctgttggtgctaggaggccttgagctgttgagggtacttgccctgcntntattatgacgtatatgtacaagtctttgtgttgacaattacacggtgtttttaatttcagtgatacacttccagtccttcatacgtacttcctggatgtttcaatttgcattctagttagatattgatccatctgttctatattaaaat

SEQ ID NO: 73752 - DNA, 238 bp, Zea mays
  unsure at all n locations
  Clone ID: LIB3079-048-Q1-K1-G12
taaaacacaaaaacacaaaacattaccttatacaacacaaaaacataaaacagcgcgccgcttcctttttaaaaaaacacaaacctcccccccaaccnccctcctaaaactatccaacctaactcacccattcatacaactacaaaatcacctatacacaaaccaaaaacaaacccatttaccaattactaccaacatcttaccaataaaaacccttacctaactcaccttattctcc

SEQ ID NO: 73753 - DNA, 362 bp, Zea mays
  Clone ID: LIB3079-048-Q1-K1-G3
cccggtcaagctcgcgcctttcagcccggaccaggaggacgcgtcggtgctgtggagggagagcaaggacgtgggcaagggcttccgctgcatccgcatggtcaacaacacccgcctcaacttcgacgccttccacggcgacaaggaccacggcggcgtgcacgactgcaccgtcgtcgtgctctgggagtggtgcaagggcgagaaccagagctggaagatcctgccgtggggtcccgaggccaactcctccgcggcccacgcgggaggcccgcacgccgtgcgcgtcttctgcaaagccggctgcgaggactacagcctcacggtgcgcatcggcacggcgtgcctggcgcccatcaacc

SEQ ID NO: 73754 - DNA, 273 bp, Zea mays
  Clone ID: LIB3079-048-Q1-K1-G5
gcgtgcttaaagagttatgagagctaggattcgtttgtgcgaacatgcaactgtctcggggacgaggtgttaaatcgaagcatgctgtggtggaaaacctgtaagacaacggtggtcacctgtctcctgatgaggatcaaaatgctagtccaaaacaaactactgtgaagtatatgggagtgtccctttcagtctccacaccatttttttgggttaaaaaatgtgctcaggtgattttcaaacgcctctcagagaagagtgctgattccaaca

SEQ ID NO: 73755 - DNA, 52 bp, Zea mays
  Clone ID: LIB3079-048-Q1-K1-G6
aatagaatggcagaaaacctaaacgttaggatggcgaaaagagaaaagaacg

SEQ ID NO: 73756 - DNA, 121 bp, Zea mays
  unsure at all n locations
  Clone ID: LIB3079-048-Q1-K1-E12
tctgcaagacggcctcggccaccattttcagatggtgtagcgcggcaacagggacggtggcactctagccagcaccaaccccccaaccgccattgcnaacaccttcctggtgcccataaac

SEQ ID NO: 73757 - DNA, 141 bp, Zea mays
  Clone ID: LIB3079-048-Q1-K1-G7
gctcgcgcctttcagccttgtctaggaggacgcgtcgatgctgaggaggaagagctagtacattggcaagggcttccacttcttcctcatggtcaacaacgcccgccttaacttcgacgccttccacggcgacaaggacca

SEQ ID NO: 73758 - DNA, 400 bp, Zea mays
  Clone ID: LIB3079-048-Q1-K1-G9
cacttggcaaatgcacaagggttggctttaataactgtcatgcttgttaccagttggttaatgtcactcgttattgttctttgctggaacaagagtatcttccttgcccttggtttcctacttttctttggcacgatcgaagtaatctacttctcagcttcccttgtcaagtttcatgaaggtgcttgggttcctattagtctctccttcatatttatggtgatcatgagtgtctggcactatggcacaataaagaagtacgagttcgatgtgcaaaacaaggtttcagtaaactggctcttaaaccttggcccttcactgggcattgtacgagttcgaggcattggactaatacatacagaactaatgtctggaatcccaactatcttctcccactttg

SEQ ID NO: 73759 - DNA, 152 bp, Zea mays
  Clone ID: LIB3079-048-Q1-K1-H1
aaaaaaaaaaaaaaaaaaaaaaaaaattaaataaaaaaaaaaaaaaaaaaaaaaaaaagaaagtttaaaaaaaaaaataaaaaaaaaaaaaaaaaataaaaaaaaaaaaaaacaaaaaaaataaaaataaaaaacaaaaaaaaaaaaaaaaa

SEQ ID NO: 73760 - DNA, 373 bp, Zea mays
  Clone ID: LIB3079-048-Q1-K1-H10
ggtcctcctcgccggcacacccgccagcgccgatgaccttgtatcggagctgcaaggtctccgcgcgcggtccccgtccggcgtgatccacctcaccgacacctccgtcacccgtttcctctccgccccctccgcgcgccgcccctactccgtgctcgtattcttcgacgccgcttcgctccactcaaagcctgacctccacctgccccagctccgcaccgagttcgcgctcctctccgcctccttcctcgctcacaaccccgattccggcgacctcttcttcgccgacatcgagttcgccgagtcgcagcactcctttcaccagtttggtgtcaactcgctgccccatatccgcctcatccgttccgatcac

SEQ ID NO: 73761 - DNA, 106 bp, Zea mays
  Clone ID: LIB3079-048-Q1-K1-H11
aaaaaaaaaaagaaaaaaaaaataaaataaacaaaaaaaaaaaaaaaaaactggaaaggtaggaatacacaaataaaaaaaccacaccaaacaccaaaccaacacc

SEQ ID NO: 73762 - DNA, 77 bp, Zea mays
  Clone ID: LIB3079-048-Q1-K1-H2
aaaaaaaaaaaaaaaaaaaaaaaaattaaatttaaaaaaaaaataataaaaaaaaaaggaagagttctaaatcgcga

SEQ ID NO: 73763 - DNA, 309 bp, Zea mays
  Clone ID: LIB3079-048-Q1-K1-H3
cccacgcgtccgctgaatgcaagttgattgacagatatgaagcttcactatttgctgagtgggtctaccctttacttgctgatctttatcatatatttgctgatattccatcgattggtagggctatggtttctgctcagaagttgcttacacaagttcacatgggggagccaatcagcagtgatatgttgtctgatgtgtatgtatttagaattgcaatagaagccctcatgatgggcttaaacagtgcagccaggtcccaaattgataccggagattaacatggctcaaatgatctgggattttaaa

SEQ ID NO: 73764 - DNA, 159 bp, Zea mays
  Clone ID: LIB3079-048-Q1-K1-H4
cgttgctatctctgccccaagcaaagtctcatccatgtttgatgttaccctcaatcaggacgggtacacctttgatgttcacatcctttccaatgctagctgcaccacaaactgtcttgctccccttgctaaggtcattcatgacaacttcaccattgt

SEQ ID NO: 73765 - DNA, 325 bp, Zea mays
  Clone ID: LIB3079-042-Q1-K1-A10
cggcaaggagctcgacggccgtaacatcaccgctaaccaggcccaatcccgtggcggtggcggtggcggcggaggctacggcggcggtcgcatgcggcagcagcagctatggcggcaggcgccgtgaccgcggttatggcggctgcggcagctactgcgtgtcggcgcgaaggtggcggctgcggctactgacgcagaggcggatacgagggtcggcgcgagggtggcggcggcggctacgtgctgcagtgcatgctgcggctgcaggtactgatgtgtaggcccatgctggcttctgccgaggtatattatctatctatagtat

SEQ ID NO: 73766 - DNA, 345 bp, Zea mays
  Clone ID: LIB3079-042-Q1-K1-A11
ccttctcgctcgtcgccgtcgtcaccgtcgtgctcgtcgcggagccgcaccgcgtcagggtgctcggcagcgtctgcctcgccttctccatggccgtcttcgtcgcccccctgagcgtcatcttcgttgtgatcaggacgaagagtgccgagttcatgcccttcaccctctccttcttcctcaccctcagcgccgtcgcctggttcttgtacggcctcttcaccaaggacccctacgtcacgctcccgaacgtgggcggcttcttcttcgggtgcatccagatggtgctctactgctgctaccggaagcgcaagccggcgtccgtggtcgtcctgccgacgacga

SEQ ID NO: 73767 - DNA, 441 bp, Zea mays
  Clone ID: LIB3079-042-Q1-K1-A12
cccacgcgttcgcctacgttgagcaccagaaggccgtcactatccgcaacgacgtcaaccttaagaaggagacgcttaggatcgagcctgatgaagagtgccctggccacttgctcgttgccttcacctttgacgccacggtcgctggcagcatgactgtttacttgtttgcaaaggaagagctcaactgcaatctaacagcagtgaaagaagacctaatgaagcccgttactgttagcttcaaagagggtcttggtcaaaaattcatgcaaccttcaggaacaggaattgacttttaatggttggaggaatcagattaattaaggcagggggccttgaaggataatcacttggcggttaaggttgaacaacattggttggtgatcacccaccagaaggggatgacccaaagatgaaaactcctaacttacagatcaccca

SEQ ID NO: 73768 - DNA, 539 bp, Zea mays
  Clone ID: LIB3079-042-Q1-K1-A2
caataagctgccattcgctgcagcccaaattggtcaggccttcaggaatgagataggtccccgtcaaggccttttgagagtccgtgagtttactttagcggaaattgagcactttgtggacccagaggacaaatcccatccaaagtttggtgatgtttctgatctagagttctggatgtttccgagagaggatcaaatggcaggaaggtcagccacaagacttaaactcggaaattctatatctgagggaactgtgaacaatgagacccttggctacttcattggaagggtctaccttttcttgacacaacttgggattgacaaggatcgtctccgtttccgtcaacacctgccaaatgaaatggctcattatgctgctgattgttgggatgcagagattgaatgctcctatggttggattgagtgtgttggaattgctgataggtctgcctatgacttacgtgcccactcggataaaagcggcgagaaacttgaagcacatgagaagtttgctgaacccagagaagtggagaaattag

SEQ ID NO: 73769 - DNA, 500 bp, Zea mays
  Clone ID: LIB3079-042-Q1-K1-A3
gcgcaataagctgccattcgctgcagacctaattggtcagtttttcatgaatgacatgtgtccccgtgggggccttttgagagtccgtgagtttactttagcggaaattgatcactttgtggacccagaggacaaatcccatccaaagtttggtgatgtttctgatctacagttctagatgtttccgagagaggatcaaatggcaggaatgtcagccacaagacttaaactcggaaattctatatctgagggaactgtgaacaatgagacccttggctacttcattggaagggtctaccttttcttgacacaacttgagattgacaaggatcgtctccgtctccgtcaacacctgccaaatgaaatggctcattatgctgctgattgttgggatgcagagattgaatgctcctatggttggattgagtgtgttggaattgctgataagtctgtctatgacttacgtgccccactcgattaaatccgggaagaaacttgaa

SEQ ID NO: 73770 - DNA, 399 bp, Zea mays
  Clone ID: LIB3079-042-Q1-K1-A4
caacaaccacactcttgcaccgagctagcagccaagatggcgaccaaacacctggctctttgcctccttgttctctttagcataggcatgggcatggccaccgctgctgcaaaccgcaaactgggttatggccccgggggaggaggtggcggtggtggtagcggtggcggtggaggcggtggttacggaggaccaggctatgggtccggatcagggtatggtgagggcggtggcagcggaggtgctgctggagggtatggacatggtggtggcggcggcggcggtggtggtgagggtgcgggagctggtggctctgggtatgggtccgggcaaggatctggctacggagctggcagcggtgctgccggtggatatgggagtggcggaagtggtggaggt

SEQ ID NO: 73771 - DNA, 249 bp, Zea mays
  Clone ID: LIB3079-042-Q1-K1-A5
cccacgcgtccggtagggtgctcttggataaacgagctcaggagtcgttactccttcgcatgcttgacataaccggacttcctcacctggttgctctagtatgatgtggagcgtctagttaaaaaaaatcgatgtagtatgaagcaccttgctgctctgaatattaacaggcaattaaggcaaggtgctgtttcggtttggtggaccgcatgttgcagataataaattagttgttttgtcatttgcgtc

SEQ ID NO: 73772 - DNA, 708 bp, Zea mays
  Clone ID: LIB3079-042-Q1-K1-A6
gtgccaagtatcaggaatggattttgtacttgaacctgtgctgtcaccttgctatgcaaggcctgaacttgttgaaagagcactaaagggacgctatcaagatgcgatgaacatactcgggcctcagggccgagaactcgacttgctgattgttatactgcctgacaataatggttctctttacggggatgtcaaaaggatctgtgagactaatcttggattggtctcccaatgctgtctgactaaacatgttttcaaggtgaacaagcagcagtatcttgcaaatgttgccctgaaaataaatgtgaaggttgggggaaggaatactgtgcttgttgatgctttggcaaggagaatcccccttgtcagtgacatagcgactattatctttggtgctgatgtgacccatccccatcctggggaagattctagtccttccattgcagctgtaagtgaagacctatcctgacaaagaaatgctacctttcagttgaagctttactatttttttctcactgtttttctcctaggtggttgcttctcaagactggcctgaggttacaaagtatgcaggattggtgagtgctcaagcccatcgtcaagaattgatacaggatcttttcaaggtatggcaagatcccgaaagggggactgtctctggtggcatgatcagggagcttctcatatctttctggagggcaactggac

SEQ ID NO: 73773 - DNA, 329 bp, Zea mays
  unsure at all n locations
  Clone ID: LIB3079-042-Q1-K1-A7
gtccgcggacgcgtgggcggacgcgtgggcggactcgtgggggttaagatcaccgagaagtgccacntcggggactcggcgtcatcgtcgtctgactcggacgacgagaagaaggggtccttgttggcgtccgcggctgaagccatgaaggccaagatctaccgccttttcggccgggagaggcccgtccactccgtcctcggcggcggcaagcctgccgatcttatcctatggaggaacaggaagatctctggcggggtacttgctggtgccacggccatctggcttctattggagggcatggagtctcatcttcttaccttggtgtg

SEQ ID NO: 73774 - DNA, 605 bp, Zea mays
  Clone ID: LIB3079-042-Q1-K1-A8
accaaccccagggacgagttccagcactgggtgaaggacatgaggcacagcactagcatcaaggacgaggaagggtacccagcgttcgcgctggtgaacaaggtcaccggcgaagccatcaagcactcgctgggacagagccacccggtacgccttgtgccctacaaccccgagtacgttgacgagtcggtgctgtggacggagagccgcgacgtcgggcacggcttccgctgcgtgcgcatggtgaacaacatctacctcaacatggacgccttccacggcgacaaggaccacggcggcgtccacgacggcaccaccgtcgtcctctgggagtgggccaagggcgacaaccagcgctggaagatcctgccctggtgaacgtgaacagagacgagctagatgaatccaaggaaccttacctagctgctgccgccgccgcctaattcgtcctcctccgctctagctgttatctgtctgtgtcttcgcgtcctcggttcctgaatggacgaataatatatagcatgcatgtacggctagcgaccatgtctgaatgacatcttcgttgctgctgctgctgctactgctacctgtccgtttggtgttct

SEQ ID NO: 73775 - DNA, 373 bp, Zea mays
  unsure at all n locations
  Clone ID: LIB3079-042-Q1-K1-A9
aagccttccgcttacccaaaccccgcgccccaaaaggaaaaccacccagaagggaagaaaaccatcgatcgatccatcgaaataaaaggcttttcttaacatggagcaacagaactgggccttcacctttcgtatcctaggtaacataatctcgctgatggtgttcctttcgccgctgccgacgttctaccgcgtgtaccgcaagaagtcgacggaggggttccagtcgaccccgtacgtggtgacgctgttcagctgcatgctgtggatcttctacgcgctgctcaagtccggcgccgagctgctggtgaccatcaacggncgtcggtgcgtgatcgaagcggcgtaccttgccgcgtacctggtgtacgcg

SEQ ID NO: 73776 - DNA, 433 bp, Zea mays
  unsure at all n locations
  Clone ID: LIB3079-042-Q1-K1-B1
cggacgcgtgggcggacgcgtgggcggacgcgtgggggacaagatcaccgagaagtgtccacggcggggactcgtcgtcgtcgtcgtctgactcggacgacgagaagaaggggtcctcgttggcgtcggcggcggaagccatgaaggccaagatctaccgccttttcggccgggagaggcccgtccactccgtcctcggcggcggcaagcctgccgatcttatcctatggaggaacaggaagatctctggcggggtacttgctggtgccacggccatctggctcctattcgaggtcatggagtaccatatccttaccttggtgtgccactgtctcatactctcgctggccatactattcctgtggtccaatgcctncactgtcatcaacaagtccccaccgaacatttctgaggtcaaaatccctgacgatgt

SEQ ID NO: 73777 - DNA, 244 bp, Zea mays
  Clone ID: LIB3079-042-Q1-K1-B10
gccacgcgtacgcgcccttgttctctgcgactctgcccggccggtctccgaggcgggcggagggaaccagagagcaaggcgaggagcgcggaagggctgagggaaggggcggcggggcatggctcgccggccggcgtcgtgggagcagggcggcgacgagtacgactatctcttcaaggtcgtgctcatcggcgactctggcgtggggaagtccaacctgctctcccgcttcaccaagaacacc

SEQ ID NO: 73778 - DNA, 391 bp, Zea mays
  Clone ID: LIB3079-041-Q1-K1-H7
ctgattcttatagtccccatggctgttgcatgcatgtggatgcagaggtattatattgcttcatcaagggaactaactaggattttgagtgttcagaagtctccagtgatccatttgtttagtgaatcaattgctggtgctgctacaataaggggttttggtcaagagaagcggtttatgaaaaggaatctttatcttcttgactgttttgctcgccctttattttccagccttgctgctattgaatggctcttgctgcgaatggaattgctttcgactttcgtctttgctttttgcatggcaatacttgggagctttccttctggcacaatcgaaccaagtatggctggcctcgctgtaacatatggacttaatttaaatgctcgcatgt

SEQ ID NO: 73779 - DNA, 170 bp, Zea mays
  Clone ID: LIB3079-041-Q1-K1-G1
cccagcgtccgaccaatggacttttttttatgaactaaacaaacggcatccggggctgtgatacaagctttcgagcgctgcatgcacctgttcaagttaatgaccttcacttaaactcaatcatcctgccagggatttacaacgagggacacttctaaaaacccaacatt

SEQ ID NO: 73780 - DNA, 222 bp, Zea mays
  unsure at all n locations
  Clone ID: LIB3079-041-Q1-K1-G10
ctagttctagatcgcgatctagaacgtggcgcgcgtctacctgggcggccagaacgtgaccctggacctcgctaggttccggcagacactggcgaggatgcactcgcacgcgatgcggcagaggctccggcaggagagactgtgatggccggccggccatcggcgacaggtgtacgcacgcacggcggctgactatgctgntccggaccggtagagggagcg

SEQ ID NO: 73781 - DNA, 390 bp, Zea mays
  Clone ID: LIB3079-041-Q1-K1-G11
gtgaaagtgagaaattagttgcaaatctgttccaaatggctcgggaaaatgccccttccattatcttcattgatgaaattgattctttatgcggtcaacgtggagaaggcaatgaaagtgaagcatctaggagaattaagactgaacttcttgtgcaaatgcagggtgttggtcacaatgatgataaagttcttgttcttgctgccacgaatacgccatatgctctggaccaggctgtgcggcgaagatttgacaagcgtatctacattccgctacctgacttgaaagcaaggcaacacatgtttaaggtccatctcggggatacaccacacaggttaactgaaagtgatttcgagagcttggcccgtcggacagacgggttttctgggt

SEQ ID NO: 73782 - DNA, 425 bp, Zea mays
  Clone ID: LIB3079-041-Q1-K1-G2
cccacgcgtccggaccaactagcaacatataaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcat

SEQ ID NO: 73783 - DNA, 353 bp, Zea mays
  unsure at all n locations
  Clone ID: LIB3079-041-Q1-K1-G3
gcagttcctgagttgcaattggtgtatggcattgctgttgacagagtctacactggcacacttatgacatcacttgatatggcaggattatctattaccattatgaagtccggcgaaagcattttgaagagacttgatgctcccactaaagctccagcttggcctgttggttctgaaggaaaccgtccaccagcaaagtttcctgttcctctaccaccatcaccttcaatgaaggatgacgagattcttgctccatctcaggagctgagcaagcaagggtgtatcctggaggctgntattgaagcaagtgctactgaaattatcaatctcatggatagcctaaatgaatggga

SEQ ID NO: 73784 - DNA, 424 bp, Zea mays
  Clone ID: LIB3079-041-Q1-K1-G4
gttagctcttatcggtcatccatcatggcgagatgcctcaagtcctgcagtgtacatggactctggctgctctccatgatccttcttgcatcgtgtgtcgttcatgctcacattattaatgggcggcaaagcaacaccgggagcctcactatgaccacgacgggggaagcaagcatgataattggagatgagaaagatgcaatttgctatataaaagccgcattgtattgctgcaaaaggactatacagtgctatcaggacatagcgcaatgcttgaggaactgccgtaaaaatgtctaacaagaggctatgctttctccaactcgtagatggagatcataaagatgttacgttagacctaatcatgcatagaccggaggagaaatataagcttattagcccatccataattaataacttcgta

SEQ ID NO: 73785 - DNA, 424 bp, Zea mays
  unsure at all n locations
  Clone ID: LIB3079-041-Q1-K1-G6
ccttgaagatagaactgtgagactccaactctgggatacagctggtcaggaaaggttcaggagtttaattccaagctatatcagagactcttcagttgctgtcattgtattcgatgttgcaagcaggcagtctttcttaaatacatccaagtggatagatgaagttcgcactgagaggggcagtgatgttatcattgtgcttgttgggaacaaaactgaccttgttgacaagaggcaagtctcgatagaggaaggagaaggcaaggcaaaggaccttggtgtcatgtttattgaaaccagtgctaaagctgggtttaacattaaggcgctgttccgtaaaattgctgctgcccttcctggtatggagacactctcatcagcgaagcaggaagacatggttgatgtgaactngaggtctggcaat

SEQ ID NO: 73786 - DNA, 365 bp, Zea mays
  Clone ID: LIB3079-041-Q1-K1-G7
caccaagcaacccaaaacagcaaagatatctctgaagaaagatgtcaaccaagttaactctccagttgcttctgataagaagactggtgaacgaccgcctgacaaagatagaaaaaaagatgctcctcaaccccgcatgcaatttgacgatacacatcgggtggtgaaagcaaagaagcgttcagttgttagacaatcagaagctcaaaacagggtcgaactgttcagacatctgcctcaatattcacatggcaactaactaactgaccttgggtcaaaattttttcaaactgatctgatgcatccttctgtgtacaaagtttgacttcaatatttgtctggtgacatatctggtggcaatgctc

SEQ ID NO: 73787 - DNA, 165 bp, Zea mays
  Clone ID: LIB3079-041-Q1-K1-G9
cgctgatccgactcgtggacaacacctgcagcgacagctttgacctgtacaacggcctcttcatgtacaacaagaactccaccgaactgctcaaccgcctcgagtgggccatggactccgtcaagaagaggctcttagacagcctccacgacgtgctcccgaagc

SEQ ID NO: 73788 - DNA, 430 bp, Zea mays
  Clone ID: LIB3079-041-Q1-K1-H1
caccaagcaacccaaaacagcaaagatatctctgaagaaagatgtcaaccaagttagctctccagttgcttctgataagaagactggtgaacgaccgcctgacaaagatagaaaaaaagatgctcctcaaccccgcatgcaatttgacgatacacatcgggtggtgaaagcaaagaagcgttcagttgttagacaatcagaagctcaaaacagggtcgaactgttcagacatctgcctcaatatgcacatggcactcaactacctgaccttgagtcaaaattttttcaacctgatctgatgcatccttctgtgtacaaggttggacttcaatatttgtctggtgacatatctggtggcaatgctcgctgtatagcaatgcttcttgcattcagagaggcaataaatgattactccatgccttctgaaaaa

SEQ ID NO: 73789 - DNA, 221 bp, Zea mays
  Clone ID: LIB3079-041-Q1-K1-H10
ctgcatcagctggtgcagacggcgccggcggccttgtgctccaggaaggtggcacgggcaacaacggcgacgacctctccttcaaaaccctcctcgagacgacgacgacgaccatgggagcggaggcgtgcgatgaggggaacgaccaggacgagtgcgtgcagaggcagctgctcgtcgacgcgcacctcgactacatctacacgcaagacacgggcaag

SEQ ID NO: 73790 - DNA, 424 bp, Zea mays
  Clone ID: LIB3079-041-Q1-K1-H11
caaagacttcgagcgagttagcaaagctgaggctgagcatactgatccagcaacagcaaaaatgttgcatgacagaaagcagtcgatgatcaaagaattaaactcctacgttgctctaaagaaacagcaggcaagtgaaaacaagagaatcgatctttttgatgggccaagtgctgaagatggctttggtgaagaaaatgtcctgttagcatcaaatatgacaaaccagcagttaatggatcaaggcaatcaactaatggatgaaactgatcaagctattgcacgatctaagcagactgtccaagaaaccgtcaatgtgggcacagaaactgcagctgctctgaaagcacagacagaacaaatgagcagagttgttaatgagttggattccatccatttctccatcaaaaaggcatctcaattg

SEQ ID NO: 73791 - DNA, 146 bp, Zea mays
  Clone ID: LIB3079-041-Q1-K1-H12
ggcgacgacctctcctccaaaaccctcctctagacgacgacgacgacgatgggagcgcaggcgtgcgaggaggggaacgacacggacgagtgcgtgcacaggcggctgctcgtcgacgcgcacctcgactacatctacacgcacca

SEQ ID NO: 73792 - DNA, 403 bp, Zea mays
  Clone ID: LIB3079-041-Q1-K1-H2
cgcggagagaggagaggcgcagagcatcgacgatggcgagcggcagcatgaagagggagatcagcgagacccacgacaccctccgcttcggcctcaatgccggcgtcaaggccgacctcgcgccgccgcacccgctccagtccagcatccaatcggaggccaagttctgggcggacaagaagaagtttgggacagaggccatctacggatccgccttgaacatccgcaaggatctcgatgcccaaatcctctcaaggttccaaaggccccctggtgctttgccatcatctctgcttggatatgaggcactgacaggttccctagatgattttggttttgaagattatcttaacatgcctcaagattctgaaggtttccgtcaacctgacatgcaccacggaat

SEQ ID NO: 73793 - DNA, 353 bp, Zea mays
  Clone ID: LIB3079-041-Q1-K1-H3
tttattctgacctccatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgtgggaattcgtgcctactcggcatttcacgagttatgaaagtacaagaaaggatactaaatc

SEQ ID NO: 73794 - DNA, 390 bp, Zea mays
  unsure at all n locations
  Clone ID: LIB3079-041-Q1-K1-H4
cggacgcgtggggtttttattggcacaacgctctttgctttacaacagttatccggcataaattctgtgttctatttctcatcaactgtattcagaagtgtgggggtgccctctaaccttgccaacatatgcatggggatttctaatctatcaggatcaattgtagcaatgcttctaatggacaagctaggtagaaaagtgcttctttcagggagttttcttgggatggcttttgcaatggggcttcaggctgttggagcaaaccgtcagtatcttggttctgcatgtgtatatctttcagttggtggcattctggtggttgtctggtcattttcactaggagcanngccctgtccaggacttttttgcctgagattttcctaataaaat

SEQ ID NO: 73795 - DNA, 243 bp, Zea mays
  Clone ID: LIB3079-041-Q1-K1-H5
agccggccaatctagcatcagcgcgcggggtctgagagcagagcggcagggcgccatggcggcatcggtggcgctgagcagcgggcaccggatgccggcggtggggctgggcgtgtggcggatggagaaggcggacatccgcggcctcatccacacagcgctccgcgtcggctaccgccacctggactgcgccgctgactaccagaacgaagctgaagttggtgacgcgctcgcagaggcatt

SEQ ID NO: 73796 - DNA, 358 bp, Zea mays
  Clone ID: LIB3079-041-Q1-K1-H6
agccagacaatatagcataagcagacgcggagactgaaagcaaagcaggaaaagacgccatggaggaataaggaggagctgagcaaaggacaccggatgccggcggtggggctgggcgtgtggcggatggagaaggcggacatccgcggcctcatgcacacagcgctccgagtcggctaccggcacctggactgcgccgctgactaccagaacgaagctgaagttggtgacgcgctcgcagaggcattccagaccggactcgtcaagcgggacgacctgttcatcacaaccaagctgtggaactcagaccatggacatgtgcttgaagcctgcaaggacagcctgaagaagctgcagc

SEQ ID NO: 73797 - DNA, 421 bp, Zea mays
  Clone ID: LIB3079-041-Q1-K1-F9
cggacaagcacgagaacctggtggaggctggtgtgatcgaccctgccaaagtgactaggtgcgccctgcagaacgctgcctccgtggctggaatggtgctgactacccaagcaatcgttgtggagaagcccaagaaggctccagcagcagctgctgcagcggcaccatagggttctttcaccatgtaataatactttctagtgaaaaacaattttactaggcatggaacaggcacgttagagtgacgaggagaaaaaactatttttgtcatgcgtgggccggaataaattgagtcaggaattgcatggattttgggccaggacgatttgcaaattggttggattagagtgtggatggctgattggacattgtatcctatctgcattctgttcactcagttggctaattcacatttctctcc

SEQ ID NO: 73798 - DNA, 198 bp, Zea mays
  Clone ID: LIB3079-041-Q1-K1-E11
aaaaaaaaaaaaaaaaaaaaaaaaaaattttttaaaaaaaaaaaaaaaaaaaaaaaaagaagagaattttaaaggacacactgaaaggatccaaactatcaaacacaaacaaacagggcaaacattttaaaaaatccaaacctaaacccaattcattccacgtccttttacaactaaaggaccgccaaaaccaattta

SEQ ID NO: 73799 - DNA, 136 bp, Zea mays
  Clone ID: LIB3079-041-Q1-K1-E12
agcagggagacagagccgaacatcaaagcagaaagaaaaatgatccttattaattggttgtacaatacaatatggtacggtgccttattggttcatgatcctatgccttatataatcctagtcttcttcattcctt

SEQ ID NO: 73800 - DNA, 424 bp, Zea mays
  Clone ID: LIB3079-041-Q1-K1-E2
cgcactccctccgctgcacccctttccattctaccgccggcgacgccaaagttcttgggcctcctcatcggcgacttttccgccggcgacaggaaacaacgaaccaaaccacttctctgtcgagaggcgtcgcgctcctctcttcgccctctgctgttatttttcttaacccggctttctctcgattgctgcgtaaagttgaagatgaggaagctcaagttccatgagcagaagctcctcaagaggcacaatttcttggagtacaagagggagggcggccaccgcgaggcgctcgtcacacagcgctaccgcctcgtggagagggacgactacaagaagtacaatgggatatgcttaatggtgcaaaagctcgttaacatcataaagcagatggacccaagagaccctttcagaatccagatga

SEQ ID NO: 73801 - DNA, 398 bp, Zea mays
  unsure at all n locations
  Clone ID: LIB3079-041-Q1-K1-E3
cccacgcgttcgcccctcgttgttattcaaggaattttggggctggcggggttgtttgtaagagcattgtaaaataacttgtttcattttttggtttctgtaacatgaatacatgacatgtgatagttgtatataagatctgtggactgggggcgtatcagcgcattctacacagctaagggttgcatagttgcgagaactgaagcatgtaaatgtctttaaactgccatctgattgagatgcagtagtactgctgttctggaataagacatgtctgcttttggggaaaatgattcaaaaaatgtttcgtttgaactcagcgtctgctgaaaatgaatttggttcccgacccctgttctggttggccgaaattcaaaataataaagcanatggaccca

SEQ ID NO: 73802 - DNA, 347 bp, Zea mays
  Clone ID: LIB3079-041-Q1-K1-E4
cccactcgttcggccgtagttgttatttttcgaatgtcggcgctgccggagttgttgggaagagcattcggaaacaactcgtccgattactgggttcctggaacatgactacttgacatgtgataggcgtatatctgatctgtggactgttggcgtatcaccgcattctacacatctaatggtagcgtatgtgcgagaactggagcatgtaaatgtctttaaactggcatctgattgagatgcggcacaactgctgatctggcatgagacatgtctgctatcggcgaaaacgattcaaacagcgttacggtcgaactcagaggctgctgtacatgaatttggttgcg

SEQ ID NO: 73803 - DNA, 390 bp, Zea mays
  Clone ID: LIB3079-041-Q1-K1-E5
ttttcaaatgaagctacatttcaaggcccagcatttatcatggctttgtgaagtggctggccatgttttttttaaaatttaattaatattccttcttgcagtgcacagtcagtgagatggtatttatctaatatatcgtcttcctccacacccattctccctttgacaattgaagaaaactgcagccactggaggtccaagattatagagcgcagaaaagtctctcgtgttgaaattttgtctccatcctggtgcataaacggtttgctggacagactggcggaagagtacaaagacaaagcgatgtattccagcagatggctttgggttttcatagctgacaatttcatttcctgtaataaaatttgttcaaccatgtcacagtgaaaa

SEQ ID NO: 73804 - DNA, 308 bp, Zea mays
  Clone ID: LIB3079-041-Q1-K1-E6
ttttcaaatgaagctacatttcattttctcacctgtatcatggctatgtgaagtgggtggccatgttggagataaaacttaatgcatattccttcttgcagtgcacagtctgcgagatggtattgatctaatctatcgtcttaatacacacccattctacctttgacacttgatgaaaactgaaggcactggacgaccaagattatcgaacgcaaaaaagcatgtcgtgtagaaattttacctgcatactgttgcgtaagccgttagctggacagactgtcgcaagagtccaaagacacagcgatgtc

SEQ ID NO: 73805 - DNA, 425 bp, Zea mays
  Clone ID: LIB3079-041-Q1-K1-E7
cggacgcgtgggcaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcatgaccgtcacagccatggacgtcgtctacgcgctcaagcgccagggccgcaccctctacggcttcggcggctaggctatgccggtcgcgctcgcgcctcgctgtcgtcgctgcgggtcttggttctg

SEQ ID NO: 73806 - DNA, 407 bp, Zea mays
  Clone ID: LIB3079-041-Q1-K1-E8
aatttttctaaacttgtaatcatggagcagatcagatcagacctatctacaaataaaaaatagcaacaaaaagttgacttcaggtttcgatatgacctgtaatctccagttaccaccaaagtgtggctcatggttccaatctaacaataaccatattaactataatgagatatttgtgtcgcaggggatataactataaattggaccttatagaaaaaaagagaaggtgcattacaatcaccaatcatacatatagattgcccttggtccaccaaaaatatacacaaatagaaagccataagattaaacacatcatcacccacgcgtccgcggacgcgtgggccaaagccaaagccaaagaatcctcttgacttgctgccaccaagcaagatggtccttgatgactg

SEQ ID NO: 73807 - DNA, 216 bp, Zea mays
  Clone ID: LIB3079-041-Q1-K1-E9
aaaaaattgggactacatactgaaaaattattttcactggcttataacacatctatacgagggaatacaacatccaactataagagatctatatctctagcgcctaataatgttgacccagattatgatgacactagatcctgcgctcaagctactacgcaatccttgtgtaagacaaatctgtctacctctacctaaatttgaaaaccgggaaca

SEQ ID NO: 73808 - DNA, 150 bp, Zea mays
  Clone ID: LIB3079-041-Q1-K1-F1
aaaacacaaaatacaacacaaacttattataaaaccaaaccaataataaaaaacaaggagaaaatttcaaaacacaaaaaagacaaaaaaaaaccaaaacaaaaacaaaaacaaaacaccaccaaaaaaaaacaccactacaacatccat

SEQ ID NO: 73809 - DNA, 262 bp, Zea mays
  Clone ID: LIB3079-041-Q1-K1-F10
agaaagactccctaaggtcgacctagaccactgaggacctgcgctctagacgtggaggaccgcatgagggaccattgcgtgacggaggagatggcgcccgcgcaacgcgagtactcaaggagccacgttcggtcccctgtattgtcaagctaggtggatcggcgactaccaacaagggcgagctggagagcatcaacgatgagaacctacggtcggcatgtgcgcagctgctgcatgccatgtacgaatctgactgcgatgg

SEQ ID NO: 73810 - DNA, 302 bp, Zea mays
  Clone ID: LIB3079-041-Q1-K1-F11
aaaaaaaaaaaagtaaaaaaaaaaaaattatataaaaaaaaaataaagaaaaaaaaaaaggggtgaaaaaaaatggaaaaaagttaagaaattatttaatgagggcgtctgttttaggggatcgtcgttttcttcctcgggcttgctctggtcatgcgttttttgttggttgacttaacttcattttactggatgttgctttccttagtcgtgactgtaaagaccttggcgttcccgatcttaatggccttgtactgctttgccttttttccggttggggctttccctgtagggtctgaccc

SEQ ID NO: 73811 - DNA, 112 bp, Zea mays
  Clone ID: LIB3079-041-Q1-K1-F12
tggcactgtcgaaatgggcgtgcgcaggttcatgaagccgatcctctactagggcttcatgttacagcgagtcatgcctcgattcatgagccaacgcggctacttcacccgc

SEQ ID NO: 73812 - DNA, 424 bp, Zea mays
  unsure at all n locations
  Clone ID: LIB3079-041-Q1-K1-F3
ccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctncaaaggtggtcaaggtcgctgactgcggacagctctcctagatctctctgatctggtctgatcggccgtccttcctccgtcatcgtcgactccatctgcgtccgttcctttggatct

SEQ ID NO: 73813 - DNA, 424 bp, Zea mays
  Clone ID: LIB3079-041-Q1-K1-F4
cccctccctcctccccgtcgccaaccaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgaataccgcattagatgaagaaatgtcggcagacccttctgttttcttgatgggagaagaggttggcgagtaccaaggtgcatacaagatatccaagggtttgcttgacaagtatggccccgatagggttctcgatactccgatcactgaagcgggcttcactggcatgggtgttggtgccgcttaccatggtcttcgacctattgtagagttcatgacatttaacttttcga

SEQ ID NO: 73814 - DNA, 313 bp, Zea mays
  Clone ID: LIB3079-041-Q1-K1-F5
aaaaaaaaaaaaaaaaaaaaaaaatattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaagagaaataaataaaaaaaaaaaaaaattaacaacaacggataaaaaaaattaataatgctaccgtagtgaccccttggctattcggaaatctccgtcattttcaaacatttcgacttgggaataaacgtcgtttaggccatttagcggttgggcaccaaaaactttttcacctg

SEQ ID NO: 73815 - DNA, 176 bp, Zea mays
  Clone ID: LIB3079-041-Q1-K1-E10
gatacgcatgcttgaaccctatgtttcatattgggacccatacttgtagagtggcggggatttgatctacgataagttctatctctagctctacaggcagctgatcctgctgattaacaacctagtcatcgatcaggtgctttgtcaagctcaacatcatccacatcgacgatctt

SEQ ID NO: 73816 - DNA, 122 bp, Zea mays
  Clone ID: LIB3079-041-Q1-K1-F6
cttcacttggataacctttcgctgagctcatttcaataagacgtttcggagccatggaaatgctatgtcgcttggagtcaatgtggatgcctaatttcaaatttttattcttcatacatttc

SEQ ID NO: 73817 - DNA, 424 bp, Zea mays
  unsure at all n locations
  Clone ID: LIB3079-041-Q1-K1-F7
gcaggacgccgacccgctggccacgctcttcatgaacgagtacaacgtcatcgagacctgcgacgaccccttctccaccgtcgacacgtacgtgtccaagctcaaggacctccgctccgccggcgccatcctggaagggatcggcctggagggacacttctccaagcccaacatcccgctcatgagggccatactcgacaagctcgccaccctggggctgcccatctggttcaccgagatcgacatcagcaacaagttcgacgcgcagacgcaggccgnctacctggagcaagtgctggcggaggcatactcgcacccggccgtcagcggagtcatgctgtggacggcgctgcaccccagcgggtgctaccagatgtgcctcacggactggaaacctcagcacctgcccacgggggacgtggtc

SEQ ID NO: 73818 - DNA, 374 bp, Zea mays
  Clone ID: LIB3079-041-Q1-K1-F8
gctcgccgtggaatgcaccgacgacctgtcggtaccggcggcctcggatggccgaggtggtggctaggatcgaggtcatcgtccggagcgcggagctgaaggcgaaggccgacacgtgaggatgacgcacttccatagcatctctccctaacctgccagctcggtcgatctctgtggttattttaagatcttgatgtgcacattgcgcggcgatgtacatgttcgtaacattagtcactcttcattatttctctgcaagataaacgcgcagactcaagccgtctacctggagcaagtgctgcgggaggcatactcgcacccggccctcatcctaatcatgctgcggactgcactgcaccctatcgggtgctacc

SEQ ID NO: 73819 - DNA, 372 bp, Zea mays
  Clone ID: LIB3079-052-Q1-K1-F7
cagacaagtgtgtcaaggaaacagatgctagcaaaactggatgtctgcatgggaagccgtgtggcagaagagcttatctttggggatactgaagtgacatccggtgcgtcgtcagatttccaagcagcgaccgcaatggcgagagcaatggttactaaatatggcatgagcaaagcaagtcgccttgtctcttataactacgaggacgatggaaagagcatgagctcagaaacgagacttgcgatcgagcaggaggtgaagaacttcttggagaatgcatacagcaatgcgaagaccattcttacaaaacacaacaaagagctccatgctctagccaacgcacttcttgagcatgagacccttacaggagcc

SEQ ID NO: 73820 - DNA, 256 bp, Zea mays
  Clone ID: LIB3079-052-Q1-K1-G1
caaattttcaacaagctaccccaatttctaaagcaataattactaaatattgcatgagcaaacatgtctgccttgtctcttataactaccaggaccattgaaagagcattagctcataaaccagacttgctatctagcatgatgtgaagaactttttggagaatgcatacagcaattctaataccagtttttcaaaacacaacataaagctccatgctttatcaacccactttttttgcatgagaacctctcatga

SEQ ID NO: 73821 - DNA, 361 bp, Zea mays
  Clone ID: LIB3079-052-Q1-K1-G10
gggatcttatcagaagtctaccggcaaactagtcattcccttggagaatggaaacagtctgaccttgcaacttgataaggaagcagacaaggaattcatgtccagcttggcttcccttcttaagactattgaaagggcgatccaagttcatgaagatttctcaagtgtcgtgaaccctgcagagttattagaatgtcacttcacaaggttgaaagctcttgagaatgaatatgggtctggtgaaattgtttaacctgggacagaaatagttcaaagagctttcaccaaatcattccagtccctacatgaagcatacaaaggggaaattgttgggctggtaatatccacaaatgaagcttca

SEQ ID NO: 73822 - DNA, 328 bp, Zea mays
  Clone ID: LIB3079-052-Q1-K1-G11
cgctcgtgctcctccacctcgcaggcctccaccacgccttgttcggcctgctggtagtcggttagcaccaatcaggagccatccattgaaacgacccatatacatcagagatagacgtcctgctatgccaatgctagatagagctaggcgtttacctccttcagggagatcttatgacaggaggcccccagctccagtttacctgaagaaaagtccaaggagagaatacggtaggcgtgatgaacttcctcctccaaggagcatagctatgattgattacagtcctagagttccagttgatagacgtccttctttgagggatgattat

SEQ ID NO: 73823 - DNA, 439 bp, Zea mays
  Clone ID: LIB3079-052-Q1-K1-G12
gagaacttccccgagttaaagcctgaggaggttgctgggatgataaaggactttgatgagcctggaactcttgcaccaactggtctttttgttggaggtacgaagtacatggtgatccaaggtgaacctggagttgtcatccgaggaaagaagggcactggaggcattactatcaagaaaactggcatgtgcttgattatcggtatctatgatgagccaatgacttcagggcaatgcaatatggtggtggagaagctcggcgattacctgatcgaacaaggcttctaagtttgtcataatgctattttggtcattgggcacttaagtttgcaccttatttggttctgtaatatgtgggcttgtgcatgtgcttggcgtattggatgcagtgaataatttatcttcgcgttgggttggtgacaatgttgggaaccgattt

SEQ ID NO: 73824 - DNA, 402 bp, Zea mays
  unsure at all n locations
  Clone ID: LIB3079-052-Q1-K1-G2
tgccccgaccccgacctctgctctctggttgccggttgtgctaaacttctccatctagtctgtactggatttgcagtcaatgctactgggatggccaaccaactacaactaggaaataggttgccctgngcaaactattcaactaaactaatcgcgactcaccactagtcggctagttgttgctcaggtgactagacttgatttatgatttggaaacactagtagctgcttatcttttatttacgctagttatcctcaaaagaccaccaaatgttattatacacattcgtagcaatcgtataaggttatattatgctacagtgaacgatgtgccaaaaaatggataagcgtgttcatttaaattctaagagagccatttttatgtcctgctggatacaacaa

SEQ ID NO: 73825 - DNA, 414 bp, Zea mays
  Clone ID: LIB3079-052-Q1-K1-G3
tggcccgaccccgacctctgctctctgtttgccggttgtgctaaacttctccatctggtctgtactggatttgcagtcaatgctactgggatggccaaccaactacaactaggaaataggttgccctgggcaaactattcaactaaactaatcgcgactcaccactagtcggctagttgttgctcaggtgactagacttgatttatgatttggaaacactagtagctgcttatcttttatttacgctagttatcctcaaaagaccaccaaatgttattatacacattcgtagcaatcgtataaggttatattatgctacagtgaacgatgtgccaaaaaatggataagcgtgttcatttaaattcttagagagccattttatgtccttgcttgatacaacaacattttgattta

SEQ ID NO: 73826 - DNA, 439 bp, Zea mays
  Clone ID: LIB3079-052-Q1-K1-G4
cgcacgcgtccgccgatgtccgccatggagaccgacatcaacgcgccgtcgcccgccccagccggcgagggagcctccgtggtcggtccgtcctcctcatcctcccgcaagcccaacaagcgcttcgagatcaagaagtggaacgccgtcgcgctctgggcatgggatatcgtcgtcgacaactgcgccatctgccgcaaccacatcatggatctatgcatcgagtgccaggcgaaccaagctagcgcgaccagcgaggagtgcactgtcgcttggggtgtctgtaatcatgcttttcacttccactgcatcagcaggtggcttaagactcgccaagtgtgcccattagataacagtgagtgggagttccagaaatatggccactagttcctgggcaccgtcatgtgatcgtggggctttgctgccactcaagtgtttt

SEQ ID NO: 73827 - DNA, 329 bp, Zea mays
  Clone ID: LIB3079-052-Q1-K1-G5
gcgcagcaaacgccattgtttgagagcttgttggaatatgttcagacttctagatggtcatcttattatcagttgctagactgcaattgggcttatgtttgttcactcaattttgtagtaaacagaatttggtataccaaggggatctatataacaatgtatgccataaattttctgtctaccatttctcatgaaatgcttaaaaaaaaaaaaaaaaaaaaaaaaaaaaaaaaaaaaaaaaaaaaaaaaaaaaaaaatttaaaaaaaaattttttaaaatttatttaatattaaatttgattatttatatttattataattaaatttaa

SEQ ID NO: 73828 - DNA, 378 bp, Zea mays
  Clone ID: LIB3079-052-Q1-K1-G6
ccttgtttgttaagagctgagctacatttattctcttcttcttgagcccctggcctgcccctcctgccaggctgcgcattctttctccagctctctgataagctagccagcgtcgtcgtcgtgtcttgttagttattagctctatctcgccgccctgcagctgctgatcgagtgagggaattcagcagcagcagcagcaggtagcatagcatagatatgacggcggcggaggtggaggccgccaaggacatcgccgaggagaaggccgtcgtgccgttgccaccgtcgcccgccaagccggccgacgacgactccaaggccatcgtcgctcttgtcgtcaaggacgctgctgctgggaaaccttctacagctattatt

SEQ ID NO: 73829 - DNA, 346 bp, Zea mays
  Clone ID: LIB3079-052-Q1-K1-G7
tcgatgatctctcttcgtcactagctcgtggtaataagggaagcttgatcatctgggcttgtggcggtgatgaagagcagcacaatcgtcgcgcttctgttggctgttgccattctgtcctcactgtctccatgctacgaagccggcggctgcattgggaaaccccagaagtcaccgtcggcacccagaaggccatacttctcgtgctatttcgaggaccaccagaactgtcgcttgatctgtagctcgaaaggtttcaaggaccgtggcttgtgtgacgaaagcgtggagcacaaagtgtgctgctgcttccattagaaatataatagcgtatgttatgttgatg

SEQ ID NO: 73830 - DNA, 274 bp, Zea mays
  Clone ID: LIB3079-052-Q1-K1-G8
cactctcttcgatcactgtactgaagataccatggccaagtcgaccgcgatgtttgtggccgtcctggccctggtggtggtgatggcgacgacgagcacaggcggcagggcggcagcggcgtgcgatcccaagccgctggtggtgtgcgatccggcgttcatggacggagcgaaacccgcggcagcatgctgctccaccctgcgtgcgcaagaggcatgcttgtgcgtgtacgccaaagaccccaagtttgcaaaatacatcaacaaccccaac

SEQ ID NO: 73831 - DNA, 433 bp, Zea mays
  unsure at all n locations
  Clone ID: LIB3079-052-Q1-K1-G9
ggcggattcctcctccctcggccgtccccgtcccctttttcggcgcgcgagctcgcccgagatgggaaactcgagatcgggtgtcgctgtgaatgacgagtgcatgctcaagttcggcgagctgcagtcgaagaggctgcaccgcttcctaactttcaagatggacgacaagttcaaggagatcgttgtggaccaggtcggngatcgcgctaccagctactatgacttcacaaacaagcctcccgagaatgactgccgatacgccatctatgatttcgactttgtcactgcagaagatgtccagaagagccagatcttctatatcccatggtccccatccttcggcaaagtgaagagcaagatgctttatgcaagcttaaaccaaaaattcaagaatgggctcaatggcattcaagtggaactgcaagctact

SEQ ID NO: 73832 - DNA, 78 bp, Zea mays
  Clone ID: LIB3079-052-Q1-K1-H1
cccacgccacccagaaaaaaaaaaaacaaaaacaaaaattcaattaaaaaaacaaaacaaaaaacaacacgaccgatt

SEQ ID NO: 73833 - DNA, 353 bp, Zea mays
  Clone ID: LIB3079-052-Q1-K1-H10
cttttgttgggtttgttgagccatggactgagcatgccacaaagaaatcctactgcctgtgtcatccatattcacctgcacaactgttgcccgtgaagttggaccctaatgaaggaactttacacattttagttcgtgcaaatctaaaggaagacccaaaggtgaccggatctgcacatgctctttttgtcaaagggttttacataaaagaacctgggaaattaaatctgactccaagttgcaatcatagtgtcattactatcgatggaaatactgatattgagttgttctggaatgctaaagatttactcagagtcagtcgtgttgacacaaatgagaacaatggtgttctt

SEQ ID NO: 73834 - DNA, 277 bp, Zea mays
  unsure at all n locations
  Clone ID: LIB3079-052-Q1-K1-H11
ctcgaacgaagatgttggcggtgttcagcgggcaggtggtggaggtgccggcggaggtgggggctgcatgcagacggacgccgttgtccaagacgaaggcgtcgcatctggtggggcgcttactgaccgactccgagccggccgtgtccgtgcagctcggcgaccacggccacctcgactacttccacaccaaccaggcgctccttcgncccacgtcgttcgcggccaatgacgaggtgttctgcctgttcgagggggtgctggacaacctgggtcg

SEQ ID NO: 73835 - DNA, 430 bp, Zea mays
  Clone ID: LIB3079-052-Q1-K1-H12
ctgtggtctattctgctgtccgcgctggctcctatgcaactgtgctctcgccaccagactgaccacgtgggaccgacaagccattgcttcccttcagcaaggcagacgaacaagaagataagaaggatgtgccgaggccggtgacatactcctactctttctttcacctcatcttctccctggccagcatgtactcggcaatgctcttgactggctggtcaacttcggttggtgagagcggaaagcttgtggatgttgggtggccatctgtctgggtcaggattgcaacccagtgggcgacagcaggtctgttcatatggtcgcttgttgcacccgtgctctttcccgacagggaattctaagttcaaccacggtaagcctggagcatcaaacgtgtctactgtggtagctaatatatcctatcaagtat

SEQ ID NO: 73836 - DNA, 240 bp, Zea mays
  Clone ID: LIB3079-052-Q1-K1-H2
catgaatactcgatctgctgtactgaaattattagctgattttccaattgacttgggacaatgatgaccgaagagagcagcttaagaaaagtggcctgggaaaggtcattatgtttttgtccaaatctgatgaggagaccactgcaaataggaaattggctaaggagcttgttgataaatggagtcgaccaatattcaacaagagcacgagatttgaagacatgaggagatatgatgatg

SEQ ID NO: 73837 - DNA, 435 bp, Zea mays
  Clone ID: LIB3079-052-Q1-K1-D4
gatagattcagttaatgaccatggacccttgtatattgaagaggttcccgaggatggaaagaatgccgggcctcatgaccgtttggttcatgtctatcattttgaatataatcatcatattcagtattttggtgaacctttcttcttcctaattcgtgatggtgaagctttgtcggatatgaaagtacggattcagaagagacttcaagttcctgatgagcagtttctaaagtggaaatttgctcatgttacattcagtaagccagaataccttcaagattcagatattgtaatgaacagattccataaacagagaccttgttatggaggttgggaacaacaccttggattggagcatacagtcaccaacccaaaaaggtcctacttaggcaacaaccagaaccgccattcttttgagaagcctgtgaggattta

SEQ ID NO: 73838 - DNA, 353 bp, Zea mays
  Clone ID: LIB3079-052-Q1-K1-D6
gcgcgcacacgtccgcactaacgaacgaattctagctccgatcacgagctagctggggtgaacgatttcagctgtgctcaacagcatgaagactccgcaggcggaggtggccatgctggtgacggcagcgctgatggcttcttccgcttcagcggcgatcacctgcctgcaggtggtgtcatcgctcgcgccgtgcataccgtacacgactgtgaggaccagcgcgctccccgcgtaatgctgcatcggccacaagagcctcaacagctcggtgcggaccagagcagaccgacaggcggagtgccgttgcctcaacagccttatcaacagcttcaaacagccacaacatggtc

SEQ ID NO: 73839 - DNA, 345 bp, Zea mays
  unsure at all n locations
  Clone ID: LIB3079-052-Q1-K1-D7
cttctacaacgagctccgtgtttcgcctgaagatcaccctgtgctgctgaccgagggccctctcaaccccaaggccaacagagagaaaatgacgcagattatgtttgaaaccttcgaatgcccagcaatgtatgttgctatccaggctgttctttcgttgtacgctagtgggcgaacaactggtattgtgatggattccggtgatggtgtgagccacacggttccaatctatgaaggatacacacttnctcatgctattctccgtttggatcttgcggggcgtgacctcaccgaccacctaatgaagatcctcacagagagagggtactcccttactacgagcgc

SEQ ID NO: 73840 - DNA, 406 bp, Zea mays
  Clone ID: LIB3079-052-Q1-K1-D8
gttctcatggcacttccctgagcttgtcaagattgtgaacgacaattacctatgtggcaagcttgctaagtttatcgtgaacaaatctgatttgacggaaaaagatattcctgctttggctgatatagttggcgacgaggacaaggctaaagaaattgttgaagcagcaaaggcttcaatgggccaggatctgtcaccagttgatttgatcaatgtccagcaatttgcccaaagggttatgaatctctctgagtatcgcaaaaacctttatgagtatcttgtgactaagatgaatgatattgcacccaacctgacatcgatgattggtgaagtacttggagctcgtctaatctctcatgctggcagtctttcaaaccttgctaagtgtgcaaccttcacccttcaa

SEQ ID NO: 73841 - DNA, 317 bp, Zea mays
  Clone ID: LIB3079-052-Q1-K1-E10
cttccatgctgatgtacatgctggaatcctatggttgctccgtgatgggcgaattgggtggattgattttgggattgttggtcgaatatctccaagaacttgggcagctatggaggtctttttggcttcttttgcaactgaggattatgatgctatggcctctgccctctctgaaatgggtgctacagggaatgatataaatactaatgaatttgcaaaggacctgcgaaagatattctcatcgattcaggacctggatactgaaatcatagtggcaacagcaaggaccccttattcttcaacaggatctgcttatg

SEQ ID NO: 73842 - DNA, 312 bp, Zea mays
  Clone ID: LIB3079-052-Q1-K1-E11
gactccagcatcaattgttctgatcatatactgcttcatctgtgtgtggtttgtgggtgcgctgtgtgttttccatttctatctcatgagcaccaaccagacaacctatgagaacttcagatatcgctatgatcggcgggccaacccgtacaacatagggatctcgaacaacttcatggagatattctgcaccgcagtccctacttccaagaacaacttcagagccagggtcccagtagagcaaggtttacagcaatcgcgtgcgccagcaaggggtttcatgagtctaaacatgggataacccgcttggga

SEQ ID NO: 73843 - DNA, 288 bp, Zea mays
  Clone ID: LIB3079-052-Q1-K1-E12
ccacaacaagaatatccacagcattcttcccaaaacaaccgtttggaccaactcgtgctgggatgagtttgtgagcctgccagctattgttccacggggccctgttgcactactaggtttgggtgctgggacatcagcacatctgatgctaaagatttggccttggttacaacttattggctgggagatcgaccctatgataattgaattgtcaagggattattttggtatgtctgatttagagaaagccacagaatcaggtggttcacttttggtgcgcattggtga

SEQ ID NO: 73844 - DNA, 421 bp, Zea mays
  unsure at all n locations
  Clone ID: LIB3079-052-Q1-K1-E3
cacccacccacccactcgcttcagccgtctccgccgcgcgtacaagcaggtggagacgaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaagtcaatgggcgcatcatcaagaagcgtatccatgtccgtgtggagcatgtgcagccgtnccgctgcacagaagagttccgcctgaggaaggcgaagaatgaccagcttgaggcggatgccaaa

SEQ ID NO: 73845 - DNA, 414 bp, Zea mays
  unsure at all n locations
  Clone ID: LIB3079-052-Q1-K1-E4
ttttgttcattttaaggagcggtacatggctatgaaggctctgaagaacactgagagatatgaactcgatggtcagctgctggattgttcacttgcgaaacctcctgctgataagaaggatagtactgtatcaacacctactgcaaaaggaggcccgttactcccaagttatgccccacttggatatggactggtgggagcttataatccacgtggaaagggattggcagatgcttataataacccccttggaaatggactggcaggtgcttatggtgtgctttccgctcgtgctgcacagccaatggtgtatgctccaggtgctcctnccggctcaacaatgatcccaatggtcctaccagatggccgtcttgtatacgtaccacanngccgcgngcagcagcctgtgcatgc

SEQ ID NO: 73846 - DNA, 302 bp, Zea mays
  Clone ID: LIB3079-052-Q1-K1-E5
cacaagcgcaaccccaagcggctcaagtacgccgccgagcgccagttcacgagaggggatgccgggttgctgcgggtggaggtggagccctccggcggggacttctggaagcttgaccccattatcgacctcatcaatcgcggcgccgtcggggtgatccctactgacaccgtctactccgtcgtctgtgacctgagtaacaatgaatcgattgagcgccttcgcagactgaaaggcattggagactccaagcctctcagcatcctgtgtcgctcattacgtgacatcgatacctacacaac

SEQ ID NO: 73847 - DNA, 400 bp, Zea mays
  unsure at all n locations
  Clone ID: LIB3079-052-Q1-K1-E6
cgacatcgtcccttcgtccccacgagcaaccgataatccgccggcgttgagaggtgggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggatgatattgttgacacattccgtctacaggagcaacctncttttgacaagaaatcatttgtgtcttacatcaaaaaatgcatcaagaatctcactgctgtgttggaaccagaagaagctgatgagttcaaaagggtgtcgagggtgcaac

SEQ ID NO: 73848 - DNA, 368 bp, Zea mays
  Clone ID: LIB3079-052-Q1-K1-E7
ttcttagtcatcgcacaagactcttgtcaacaagaccaacaacaggatgaggactggcgtgcatgctgcgctttgcattgtgcttgtgataatgtcttcaacactttcatcttgcgaggacgatgagaaggtatctatcgcatgtgacacaggatgcaatgccgcgatctcccgtctcaaatgcttcctgatggcctattctgaagggaaagtgttggtcagcagcaactgcgaaacgccgaccaggtgcggctgcgtgtttcgtcacaaacaagatgcaacccttatcgccggcgacgttggcaacaaaaagggatattgatggcagacgtgtatttcttggttgaataatatatactgctagaatt

SEQ ID NO: 73849 - DNA, 320 bp, Zea mays
  Clone ID: LIB3079-052-Q1-K1-E8
cttccctgaccgcatgccccactactgtgccgaccgccacgccactgagaacgcggggctccttcacgccctacgcgtgatccgcgagaggaagatggatggcgtagttgttttcaccgacgacagcaatgttcatagcatggagctgttcgatgaggtgcagaaggtccagtggatgggtgctgtattcgtcggaatccttgcgcatactggcacggcagaccaactacggctcatcgaggaggacaagcagaatatgccttttccagtccaaggccctgcttgcaacttctcagggcatctgattggatggcacacgt

SEQ ID NO: 73850 - DNA, 172 bp, Zea mays
  Clone ID: LIB3079-052-Q1-K1-F10
cgatcacatgcatatggaatgccaatcatgtatataatctattggcaaataacaaagctgtgttcctccaaaaaaaaaaaaaaaaaaaaaaaaacaaaaaaaaaaaaaaaaaaataaaaaaaaaaaaaaaaaacaaaaacacataaacaacataaaaaaaaaaaaaaataaa

SEQ ID NO: 73851 - DNA, 218 bp, Zea mays
  Clone ID: LIB3079-052-Q1-K1-F12
cccacgcgtccgcgtactccggccatccggttgcctgtgctgtggccattgaagcgctcgagctttatcgcgaaagggacattcccggccatgtcaagcaaatcgtcccaaagtttcaggacgggattagggcacttgcagacagtccgattatcggagagatacatatcttggggatgattatggtgaccgaattcacaaactacatgttaccgact

SEQ ID NO: 73852 - DNA, 361 bp, Zea mays
  unsure at all n locations
  Clone ID: LIB3079-052-Q1-K1-F2
tggcatccgcagagagcttgttccgttcaggcaaccaaaaagcaagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctncggttccagagccacgccgtgctggcgc

SEQ ID NO: 73853 - DNA, 439 bp, Zea mays
  unsure at all n locations
  Clone ID: LIB3079-052-Q1-K1-D3
gtcgttgtcttccctggcttctcccatggccgcctatcccccatcccctccaccgtgcccgctcatctcctagcccctctgctcgccaccatcccctatacccttgctagcagcatggcgctcatcccttcctgatgtgagctgcacatgacgtctccagctctccattgatggcagctagctgcgccctcacttcctcccatggtgagatcgcccatggtggctcctcctgctcggcgtactcccctctgcaggagctcgcccagcccctctctgctaggaacagcagcacctncctccatggatgcctagttgttgacttgtgcaattcatagtcatcggtgaggtccctttgtcttatgctacttatctccttaatcgatatatgtgggtttgtggctgattgtgagtatgtgtgtgcttatgtgtgagatgtgag

SEQ ID NO: 73854 - DNA, 407 bp, Zea mays
  Clone ID: LIB3079-052-Q1-K1-F3
agccaagtagctctagcaaacctttctccctactctcaacaacaacaatttcttccagttcagccaactgtctacactgaaccctgctgcttatttatagcaacaacaactactaccattcagccagctagctactgcttactctcaacagcaacaatttcttccatttaaccaattggccgcactgaacccctctgcttatttccagcagcaaatactactaccatttggccagctagctacaacaagccccgcttcctttttgacacaacaacaattgcttccgttctaccagcagtttgtggctaaccccgcaactctcttacaactgcaacagttgctgccctttgtccaacttgctttgacaaacccagcagccttctaccaacaacacatcattggcggtg

SEQ ID NO: 73855 - DNA, 419 bp, Zea mays
  unsure at all n locations
  Clone ID: LIB3079-052-Q1-K1-F4
gggcattggacactggaggaacgttgtgttggtggtaactgaggtttgtgcttgtgtgtagatggagaggttaagcaccaaccagctctacagttctggtgttcctgtaaccgtaccaacatctctgccttgtataccagtctctctggatgagagcttcccgaggcttcccgatgcacagagtgttttgatggagagagaattgaggagcactccactaccacctcaccagacaactgttgctcctatccgtggtctgtttcactccaatactggatctgttggtcctttgtgctcaccttcgtctgtaaggttctcttcgcattcaaatcctgagcaataccccaaccacaattcatacaattctcaagtaccaagcactgcangttcctcaacgctngaatatgggtcacaatatg

SEQ ID NO: 73856 - DNA, 383 bp, Zea mays
  Clone ID: LIB3079-052-Q1-K1-B3
gcggggatgagctgaccagcctcaagtgtattatgtgaccaggatgaaggagggccagggcgacatcttctacatcactggtgagagcaagaaggctgtggagaactccccgttccttgagaagctgaagaagaggggctatgaggtgctgttcatggtggatgccattgacgagtattctattggacagctgaaggagtttgagggcaagaagctcgtctctgccaccaaggagggcctgaagctggacgagagtgaggatgagaagaagcgcaaggaggagctcaaggagaagtttgagggcctctgcaaggtcatcaaggaagtgctgggcgacaaggtggaaaaggtggtggtctccgaccgcgttgtggactccccct

SEQ ID NO: 73857 - DNA, 150 bp, Zea mays
  Clone ID: LIB3079-052-Q1-K1-B4
accattattaattttttccagtgcgagattttttacattatttcttatatccaataatcttttcaaaacttcccactcctctataaccttaataacaccacctatcatatcttttcatatttaatgccattgactactattctattagac

SEQ ID NO: 73858 - DNA, 300 bp, Zea mays
  Clone ID: LIB3079-052-Q1-K1-B5
gcagcgtggggatccgctggtggtgggccgcatcatcggcgacgtggtggacgcctgcgtgcgccgggtgccgctccgcgtcgcctacgccgcgcgcgaggtctccaacggctgcgagctcaggccctccgccatcgccgaccagccgcgcgtcgaggtcggcggacccgacatgcgcaccttctacaccctcgtgatggtagatcctgatgcgccgagccccagcgatcccaacctcagggagtacctgcactggctggtcactgatattccggcgacgactggagtatcttttgggac

SEQ ID NO: 73859 - DNA, 305 bp, Zea mays
  Clone ID: LIB3079-052-Q1-K1-B6
gcgggagcgtggggatccgctggtgttggtccgcatcatcggcgacgtggtggacgcctgcttgctttgaatgctcgctccgcgcttcctacgcctcgcgcgaggtctccaacggctgcgagctcaggccctccgtcatcgccagaccagactgacgtcaaggtctgctgacccgtcatgcgcaccttctacaccctcgtgatggtagatcctgatgcatctagccccagctatcccaaccttaaatagtacctgcactgacatgtcactgatattcctcagactactgtagtatctaatgggac

SEQ ID NO: 73860 - DNA, 308 bp, Zea mays
  Clone ID: LIB3079-052-Q1-K1-B7
ctccacagtcacaactacagttaggggtgttggtgatattggggatgttaaggttagagatctgcagtgtccacttaatagattaatagggaggcgagtatgcaaaatcggcagaagttctggccacacgactggaactgtgatggcttatgcccttgagtacaacgacgagaaaggaataagctttttcactgacctccttgtcgtcggtgagaaccgccaaacatttgatctagaaggtgacagtggaagcctcattatcctgactggccaggacagcgagaagccgcgtcccatcgggataatat

SEQ ID NO: 73861 - DNA, 269 bp, Zea mays
  Clone ID: LIB3079-052-Q1-K1-B8
cgcagctgggcggcaagcgcgtgggcatcatcggcctgggcaacatcggcacgctgggcgcgaagaggctggcagccttcggctgcgtcatctgctacagctccagaaagcccaaggaatccgtctcctacaggtacttccctagcgtccacgacctcgcgtcggaatcggacgtgctcgtcgtcgcgtgcgcgctgaccagggagacgcgccacatcgtgaacaaggacgtgctggcggcgctcggaaagacggggtcgtggtaacat

SEQ ID NO: 73862 - DNA, 422 bp, Zea mays
  Clone ID: LIB3079-052-Q1-K1-B9
gcaactccgcaagtccgcaacctcctcctttccaccccttctcacgcgattcaagcggttgccattcggagccctaatcctctctttccatactcgcggaagccaccaccaccggcaggggaagcggaaggggagcacctcgggccaggcaagatggtgctcgcgcagctgggcgggagcatctaccgggccctggcgcagatgagcaacgccacggtgatcgatgagaaggtgctcaacgactgcctcaacgagatctcgcgcgctctcctacaggccgatgtccagttcaagatggtccgagacatgcaggccaacatcaagcgcatcgtcaaccctcaggcgctagccagaagcaccaacaagcgccgtatcatgcagcaagcttgcttcacggaactctgcaacatgttaaatcccgg

SEQ ID NO: 73863 - DNA, 153 bp, Zea mays
  Clone ID: LIB3079-052-Q1-K1-C12
cccacgcgtccgctccgctgttgatatttcgtttggttctcctttccgtcttgtccggggccgaggccttcttcccctcgctccccagcttcagcaggcagatcagatccattcaaccacgaacaggaaagaaagtaagaagcctcgagggct

SEQ ID NO: 73864 - DNA, 414 bp, Zea mays
  unsure at all n locations
  Clone ID: LIB3079-052-Q1-K1-C2
cggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaaaggtggtgccaagaaggttgtcatttctgctcctagcaaggatgcccccatgttcgttgntggtgtcaacgagaaggagtacaagtctgacatcaacatttgctctaatgc

SEQ ID NO: 73865 - DNA, 273 bp, Zea mays
  Clone ID: LIB3079-052-Q1-K1-C3
agatcgcgagcggcctcccagcaacatcccgccaccacttcctcctcctcctccgctgtctgcggccgcgcgcgccgacgtttttttttttccaacggaggccgtcgcgcgctgcctttagtttcggacccatccatccatacatagccaacatcacctatagcaggcggagggacggaggaccgtccgtctcgttcactccgcgccgcgcgtggcccgatccagcccggccctcggatggtcgccgctggcacgtacagcgacgacaccagc

SEQ ID NO: 73866 - DNA, 205 bp, Zea mays
  Clone ID: LIB3079-052-Q1-K1-C4
aaaaaaaaaaaaaaaaaaaaaaaaaaataaataaaaaaaaaaaaaaaaaaaaaaaaaagaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaacataaaaataaataa

SEQ ID NO: 73867 - DNA, 381 bp, Zea mays
  Clone ID: LIB3079-052-Q1-K1-C5
aaaacccatgccaagcttctaccaagagggacccccaccaaaggttgaacttaagagaggtgcctccaactcgtgccaagtcaccaaaattgacacggagaaagagctgcagtgaaacccctcatacaccagagggaggaaatggcagtgcagtatgctgccggttgcatcgccacagcattgggaacgccagagatgttagcagcaaggcacaatgttctccaaagagcgcctcaaaggctggatcagctactagatccagggtcaccaaatccagggaagacctgaaagcttccgtgaagaaagtgggactgccaagcgccgcgaacttcgctgtacaaacctaactcatcaggcattcactcccatatgccatttttc

SEQ ID NO: 73868 - DNA, 381 bp, Zea mays
  Clone ID: LIB3079-052-Q1-K1-C7
cgtatatctctatagccaacacacacacaaatactctccattccattccatctgaaaggatagaataatgggcggtctctccaccaagcttttcgtggtcctcctcctgctcgtttgttacaccgggacgcaaggcgggccggtgactatggtgtcggcgaggaagtgcgagtcgcagagcttccgcttcaagggaccttgctcgagggacgccaactgcgcaaacgtctgcctgaccgaaggtttcaccggcggcgtgtgcaagggcctacgccaccgctgcttctgcaccagggactgctagtactgcctcgtctcgcctcgcctcggctcgtgtcctgcgtgtgcatagccgcagcggatcaagtaaacatgcatgca

SEQ ID NO: 73869 - DNA, 378 bp, Zea mays
  unsure at all n locations
  Clone ID: LIB3079-052-Q1-K1-C8
aatctcgtctcggtgccggtggttggttgttcaggatcgtcctcatggcttcgcttggcctccactaacaacgccctcctccttttcctccatcgcctagcgcaaattctccgtccaccgcttcgtccaaaagcgtctcctggtaccggcactcgctgctgcagaacgctttatggcctcgatagattaagatgtcattgccatgtccaagttgcttgttgcatgcatggcaagagctgaagaagccacaggcagcagctgctgcgccgtcggccgcgggcttgtcggctagcaaatccccgcagctctcaacgatgcagtcgtcgaagatgtgcgtggtcctcgggttggggccgcgcgagatgacgcangtgtagt

SEQ ID NO: 73870 - DNA, 434 bp, Zea mays
  Clone ID: LIB3079-052-Q1-K1-C9
cgcagctccatgtccaaaaggaagcaatgttgtcagcatgtagttcaaagacctggtggaggacagcaggcgaagtcgcttcttgggatatctggataataatattcttggaagctcgatgcagaaaaggacaaagtaaatacagcaagcggggctggccattaatcatgacagccgcaggggctggcgcgtggccgcactggaatcggaaatttggtgcaaattgggctcttcgaagatttgaccaattgagcccatgtcaccttggagtccaacatgcgctgaattcattcactaatttagtcaaaggcaggttttgtgaaatacgcccaattgccagtatggcgtcttcacattatgtcgaagaaggaaatcgattgagttatgtgtggtgaaagaaagtgggtagacaaatattactgactggtgaaagc

SEQ ID NO: 73871 - DNA, 300 bp, Zea mays
  Clone ID: LIB3079-052-Q1-K1-D10
cccacgcgtccgcttcactgtctgggatgtcgggggtcaggacaagatcagacctcgttggaggcattacttccagaacacccagggtcttatctttgttgtggacagcaatgaccgtgaccgtgttgttgaagccagagatgagctccacaggatgctgaacgaggatgaactacgtgatgctgtgctgcttggttttgccaacaagcaagatctttccaatgccatgaatgctgctgagattactgaccagcttggattacacttcctgcgccagcgacacttgtacattcagagcac

SEQ ID NO: 73872 - DNA, 429 bp, Zea mays
  Clone ID: LIB3079-052-Q1-K1-D11
cccacgcgtccgggcaagagaagtttggtgtcctcagggatggatactatatccatggccggtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagcttgtgctcttaaacctccggaagttaccatcgacatggctatgcagcagcagcatgaagctgagcttgctgcagcagctgcac

SEQ ID NO: 73873 - DNA, 376 bp, Zea mays
  Clone ID: LIB3079-052-Q1-K1-B2
cccacgcgtccgcccacgcgtccgggctactgtggcggcggcggctacggtggtgggggcggctgctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaagg

SEQ ID NO: 73874 - DNA, 419 bp, Zea mays
  unsure at all n locations
  Clone ID: LIB3079-052-Q1-K1-D2
attggaccccgcctgagggtgctggacagtttcatggtgtacccttggatgttaagggtgttcatttcaaaggttccagaaagcgattgatgcttgaggcatggaatttctacagctcaacctctaagctgtctgatatgctatgcctaatcttgagaagtggccggacgaaatatgacttctgaacttttgggttaaaactgacacatgttgatactgttcaaagctgttgtatgttcaagtatagtacaaaaaaatgctgaccatgaggctgtcattgcaagaattcagatcagcataaaaaattgctagtagcattcagtatgtaacaaaaacatgtgagaacccatacgagaaccacgcatggtgaccatcgncttgtgttcttttgtttatccctacctgtaaatatgtaatgt

SEQ ID NO: 73875 - DNA, 107 bp, Zea mays
  Clone ID: LIB3079-042-Q1-K1-E11
cccacgcgtccggtgatgttcccagctaatccaaaggtcccttcttcggatgcttgctgaggtgtcatcaagaaggcaaacgtttcttgcttgagctccaaggtcac

SEQ ID NO: 73876 - DNA, 101 bp, Zea mays
  Clone ID: LIB3079-042-Q1-K1-E12
cccacgcgtccggatacgctcatacatgatcatgtggcacactcatcacaggactatccatgcactacgagattccattaacatccttggcacattactgt

SEQ ID NO: 73877 - DNA, 623 bp, Zea mays
  unsure at all n locations
  Clone ID: LIB3079-042-Q1-K1-E2
ccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctnccctgcctgctgcgtgctatgtctgaatcgtgaacaaccgttgtcatttcatgtgtgtaccccgtgcaatgctttgtgcgcatggttgatttctctgtggcaaacttnccgtcctgcatggggttgtaagctgtctctaaatttcacggcaagtcgtgtgccttgaccttcatcttaaaggtgtgtcgtattccttcgctt

SEQ ID NO: 73878 - DNA, 456 bp, Zea mays
  Clone ID: LIB3079-042-Q1-K1-E4
cagacacaggaggacagatcgtctatatactggaccaagtccgtgcactagaaaaggagatggttctccgtttaaagaaacaagggcttgatgtttccccaaagattctcattgttactcggctgataccagatgcaaaaggaacatcatgcaatcagcggcttgagagaattagtggaacacagcatacttacatattacgagttcccttcagaaatgaaaatgggatacttaagaaatggatatcaagatttgatgtgtggccatatctggaaacatttgctgaggatgctgctggtgaaattgctgctgaattacaaggtactccagacttcataattggaaactacagtgatggaaatcttgtggcatcgttgctatcttacaagatgggaattacccagtgcaacattgctcatgctctggaaaagactaaatatccagattcagacatat

SEQ ID NO: 73879 - DNA, 661 bp, Zea mays
  Clone ID: LIB3079-042-Q1-K1-E5
gttcgaggagctcgccgccgtcgctaagcagcagcccgcggtgcccatggacgctggggccttctcgcgcgcctgctccaacgtctccgtcctcttcggctgcctcggcatcgctttcaagttcgcggagatggactacgtcgccaaggttgatgatttggtggaggcgtccaagtcaatttcaacattgccttctatggttgagcgagacattcagaccgacactgtcaggaaaccagggagccatacaaggaatctgcttagagtgaagcgcgggattgatatggttaaagtcctgtttgagcaaattcttgtcacagaaggcaactcactaagggatgcagcatcggtggcttatgctcaggtctttgctcctcaccatggatgggcaataaggaaagcagtttctgctggaatgtacgcccttccctcaaagtcccagctgttgaagaaattgaatgaagatgaggaatcagcaaaggttcaaatgcagaactttgtcaggtcatcaactccagtaatctgctatgttgatgaccgtttcacctcaaggaatttgggcatagatcggtgaagaaaaatatggatacgtttgtttgatgtactaatccagtcagatggtgtgctgagtgagctgggctcagaaaacctttttccggat

SEQ ID NO: 73880 - DNA, 161 bp, Zea mays
  Clone ID: LIB3079-042-Q1-K1-E6
aaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaacccacgctttcgcccacgcttccgcggacccctgggtttaaatcgcaa

SEQ ID NO: 73881 - DNA, 594 bp, Zea mays
  Clone ID: LIB3079-042-Q1-K1-E7
tgcagttttacaagaacctatgcagcagacttgacagcataatctggaggccaatcgaagtttctgcgaaatctaagctgctgaggacgaccacttgctagcccagcactgagctactgtaaatggcaaccaacaacaagagacgtggttcgtagccgttagaagagggggaaacttctgttaaatccagcgtatagctcgtggagctgggattcacgaggatttctgcatctcgctttctcaggtgatgcatgtaccatagctgtcttcgttagatcagacgaggcagctcaaagcaccaggtgtttgtatatatatattttttgtaacgctattgtagatagcctgtgtagctccagccgtgcagctgtatgtagcagaaacctgaatgtccgaaaacgcccctgaatgtcaggtagaatcgttgcttgcatccagttaacaagctggcctatgtggtcatgccaccatacagtagtacacatgcaccacaggatcagcaagaggatagagccgtagtagaatcatggaagcagatatgttgaacttttacaggttgcatctgaatttgatgaggttttaagttattatatt

SEQ ID NO: 73882 - DNA, 270 bp, Zea mays
  Clone ID: LIB3079-042-Q1-K1-E8
gtcagctgctggcgctgccgccactgcttgggcgggcggtacaacctgtgcgaggacatgaagttcttcgccaccccgccggtgcacggctcgctggcgaaccaggtggtgcacccggccgacctgtgcttcaagctccccgacggtgtgagcctggaggagggcgccatgtgcgagccgctgagcgtgggcgtgcacgcgtgccgccgcgcggtggtggggcccgagacgggcgtgctcgtggtggtcgccggcctcatcgttctggtg

SEQ ID NO: 73883 - DNA, 197 bp, Zea mays
  unsure at all n locations
  Clone ID: LIB3079-042-Q1-K1-E9
cctttttcaagcaacgcgagccatctatttcttttgtctagctatgttagtgatatcttgtgagagacctcaatgttaccaccgtatctttgtctttgttggatggagagatttaagcaccttaccacacctttgttctttgttggatggagagttttaagcatcacctgtttgaagttgaaaaccctaactcanaa

SEQ ID NO: 73884 - DNA, 366 bp, Zea mays
  Clone ID: LIB3079-042-Q1-K1-F1
gggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtggaagcagcaggggaagaaggcaaaggaggggagaagatgtagttcacccacttaaagtttctctggaagatctttacaatggcacctcaaagaagctctctctttcgcgcaatgtcatctgctccaagtgcaagggcaagggctcgaagtctggtgcctcaatgaggtgccctgg

SEQ ID NO: 73885 - DNA, 156 bp, Zea mays
  Clone ID: LIB3079-042-Q1-K1-F10
aaaaaaaaaaaaaaaataacaaaaaataaatataaaaaagaatcacaaatgaagtccgataatagaagctaaggtcagacctactcgagcatcctacataatatatattgtaaagtgacatccaaaactctattacactggcacgacattttacaa

SEQ ID NO: 73886 - DNA, 394 bp, Zea mays
  unsure at all n locations
  Clone ID: LIB3079-042-Q1-K1-F12
cggacgcgtgggtaaattctgattctgagggtgctggcactcgatcatacagctaccgcgtatgttgagctagttattgctagggtaaaattattttattgaattttaatttcttagccctgcgcaatctttaggttgttatgcaaactggtgatgctgagctggaaatgcgagggcgctgcagtgctggtcagaagtttcttgcttctcttataatcagactagcacttgcggaaactttctgcctgaactgcggtatattggctttggatgagccaactacgaatctagatgggccaaatgcagagagtcttgctgctgcgctgttgagaataatggaagccaggaaagggcangagaacttccagttgattgtaatcactcatgatgagag

SEQ ID NO: 73887 - DNA, 244 bp, Zea mays
  Clone ID: LIB3079-042-Q1-K1-F3
cccacgcgtccgcccacgcgtccgcccacgcgtccgtgtcagttcagttcagttcagtgtcgaatgaagtagtagtagctgttgtttgcattggatctgacaatgcatgctaataattatggtggtgtgatggtcttggtcggtacgtgcgtagtcgtctacgtacgccgtgtcaacgtcgtagatctctacgggaagatgataagactgtaacatgcagggcatgcatctatttatacttaac

SEQ ID NO: 73888 - DNA, 496 bp, Zea mays
  unsure at all n locations
  Clone ID: LIB3079-042-Q1-K1-F4
gggactactaccgcgcctgctgcggttagcccgatccttacatccccgaggggcccaagctgccgtgcgttggggacaaggaacctctctcctctttagcagctgagtttcagtctggcagccccattttacaagagaaaattaagttgcttggcgagcaatatggtgctttaagacgtacacgtggagatggaaactgcttttatcgaagctttatgttttcctacctggaacacattctagagacacaagacaaagctgaggctgatcgcatcatggtaaaaattgaggaatgcaagaaaacactcctctctcttggatatattgagttcacttttgaggacttcttttcgatattcattgaactgctggaaagtgttctgcanggacatgaaactcctatagggcctgaagagcttctagaaagaaccagagatccacaagtttctgattatgttgtcatgttctttaggtttgtcacttctggtgaaattca

SEQ ID NO: 73889 - DNA, 387 bp, Zea mays
  Clone ID: LIB3079-042-Q1-K1-F5
gtcgagcatcttcgacgccaaggccgggattgccctgaacgaccacttcatcaaggtcgtctcttggtacgagcgcgagtggggctacagcaaccgcgtcgtcgacctgatccgccacatgttcaagacccagtagagagagatatttctgcctccctatcgtgggtcgtccccaatggcctttggtcgcagaccatctttgctgcttgtctatgctgagaataaatgtgaacggtgcccctggacgctggatccatgctggttttggacacgttgtctttttgtgtttaacttatctgctaccgtcctgtaacgaattcactaagttctagttcttttgtgctttgttaagaatataaacaatgaggtttcaattttggtggcgcc

SEQ ID NO: 73890 - DNA, 478 bp, Zea mays
  Clone ID: LIB3079-042-Q1-K1-F6
acgacgtcacctccggccgcggcttctacggccccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagatcaagttccaggccaagtaccccgtcgtcgcccgactcgccgccgacgcctgaactcgtcagtctcggtctaaatttactctgtcctgcctcttgcggtgttcagtgctgtgcttgcttgcttgttgctagttgctttgctacccaataatctgaatggaaggacgtatgtgatgtgcctgctgaatagttcctagtccttgcatacactgctgtgctaccacatgacatgatgtactcgtgtgtgtgctttggttgttgtgtaattccatgaccatgatcagtaatctgaataaaaaatattggag

SEQ ID NO: 73891 - DNA, 465 bp, Zea mays
  Clone ID: LIB3079-042-Q1-K1-F7
gcaaaaaaaaaaaatgcctttttgaaaataaagatttcaacttaaaaaaaaggttttttccataaaatttttttttaaacaattaaattgtggtattaacaaaattttttgaaaccttttattcttttttaaaaaaaaccttgggatttatttcaaacaaggtaaaaaatcagggggtggaaaaaaccgtggaaaaaataaaattcttgtaaaaaaaaataggggggttaaccttttataaaacgctcagtaaaaaaatttgataaaaaaatttttttccaatttgggtttcttaaaaaaagttcttttaaagggatattttttaaaattaaaatttttttgaaaaaaaaattttacgggccctttttttttccagttttaaaaaaaaggcggggggggctcccaaaaaattttttggaaaaacccgccttttttttatctttaaatatttgaaccctttttttt

SEQ ID NO: 73892 - DNA, 401 bp, Zea mays
  Clone ID: LIB3079-042-Q1-K1-E10
cccacgcgtccggattgtttcatcaatcattatcttccacactcctgtccgcgctgtcaatgcactgggagctgccattgccatccttggcacattcctgtactctcaggcaaaggcgtgaggcgggccatgatgacgaacgtctgcagaatcagtagcaagcactaaatccaattttgcttgttccagtggcatgtagatatcgggttagttttccgtatgagagtttgtaataatggatgaatggctctgctgtttcgttcttgtttgttggccagactcaaatccataggccatgaactgcggtcgagtgtacctgaataatactgtacggaagattcgccgatgcttgttctttatgggtatatatataggccaagccggaattccggttttaatag

SEQ ID NO: 73893 - DNA, 328 bp, Zea mays
  Clone ID: LIB3079-042-Q1-K1-C6
tgcctgctcgagataacctgctgattggatgaatctattgcaaggatggttaccgagtactgatgctatttatgttgtataagatgatgtgcgctatgttgtctgatgtttttatatatattataatggtgacgaaaccgaggtaaaaaataatttatatatgtatactggtgtgattgccttgctaaaaaaaatttttggaccaaatggttaaatctttgacatagaacatgcataattcataatttgttcttgatcgttattggtctttttatatcatgatctatttggctgatattgattattttcttgatcttgtttattcttt

SEQ ID NO: 73894 - DNA, 65 bp, Zea mays
  Clone ID: LIB3079-042-Q1-K1-C7
gtactactaccaccaccatttgtttatctgatgaatgaacggtgacgatgatgacgatattgttt

SEQ ID NO: 73895 - DNA, 220 bp, Zea mays
  Clone ID: LIB3079-042-Q1-K1-C8
gaatctgctgtgtttgggcttttgcatggtcaggctattcagagttgtcatggacttagggttgtgttagtagattggttgcgctgaatctataataaaaacgaggtaaactaggacaatgatgatgtggccgtgtgtatttaatgtattctgttcacaattaaaaaaaaaaaaaaaaaaaaaaaaaaaaaaaaaaaaaagggcgttctaaatcgcggaa

SEQ ID NO: 73896 - DNA, 265 bp, Zea mays
  Clone ID: LIB3079-042-Q1-K1-C9
attcccggtcgaccacccttccgaaaaaaaaaacaacaaactaaaaatactaataaaaaacaacaaatactacactaaactacaaaaaaagggctgaatactctaaacgattcaaatttaaatctccttattttcgaatacttcatactttaatataggaacctaaatatagataactaccccatgcttacaaacgtttttattcaaaatacccacgtttacaaaaattatattttctctaattacttcactttttacaaaattt

SEQ ID NO: 73897 - DNA, 339 bp, Zea mays
  Clone ID: LIB3079-042-Q1-K1-D1
aaaaaaaaaaaaaaaaaaaaaaaaaaaattaaaaaaaaaaaaaaaaaaaaaaaaaaagggaaaaaaaaaaaaaaaaaaaaaaaaaaaaaaaaaaaaaaaaaaaaaaaaaaaaaaaaaaaaaaaaaaaaaaaaaaaaaaaaaaaaaattgggggggcctttttaagggaaccaattttattaaccctttttttaatattaaaagtttttttatagtggacccaaatttaaatttattgacctggttttaaaaaaaaaatttttggaaaaacctgggttttccaaaattaaattgtttggaaaaaaatacctttttaaaaagttgggatatttgcaaaaag

SEQ ID NO: 73898 - DNA, 276 bp, Zea mays
  unsure at all n locations
  Clone ID: LIB3079-042-Q1-K1-D10
gtcaccaaatcattccagtccctacatgaagcatacaaagggaaaattgttgggctggtaatatccacaaatgaggctccatcatccttaggatccataattgacgcaccatcttcactgcacatttcaagacggctagaagaagcaagcaagactacagacatagcctctgtcgtacttgttcgaaagagcttggcatgattacagggatcatnctgctngtttcaactctcataggggtttgcttgcttatgaacatgccacttaccagggaca

SEQ ID NO: 73899 - DNA, 278 bp, Zea mays
  Clone ID: LIB3079-042-Q1-K1-D11
gaaattaaaaagctgaagctcataccatattatttccctttgtttgttactgagaatgttctacagaaggaaaaggaccacattgagggctttgcacctgaggtagcttgggttactaaatctgggaaatctgacctggaagcaccgattgcaatccgccccacaagtgagactgtcatgtatccatacttctgcaaatggataagaagccaccgagacttaccctagatgtgtaatcaatggtgtaatgttgtttagatgggagttaacaatccaac

SEQ ID NO: 73900 - DNA, 264 bp, Zea mays
  Clone ID: LIB3079-042-Q1-K1-D12
gcagcggcctacgccgtcgtgctttcgaattacctcggcacggccagcctgcgcgtctgggagttcgccgggggcgcgtggcggcaggtggccgccatgccgtccgccatgtctcacggattccacggcacgcgccccgacatcaactgcgtcagccacggctaccgtctgatggtctgcgtcacatacgccgaggccaacgcctgcttcatgtgcgacgtggccagcaaccagtgtgaggagctgcccaagtacatcatatgc

SEQ ID NO: 73901 - DNA, 527 bp, Zea mays
  unsure at all n locations
  Clone ID: LIB3079-042-Q1-K1-D3
cgtggacaagacgcacgtggcgcacaccatcctgngcacgccggagttcatggcgccggagctgtacacggagacgtacacggagtcggtggacatctactcgtacggcatgtgcgtgctggagatggtcacgcgggaggtgccctacgccgagtgcggcagcgtcgtgcagatcttccacaacgtcacccggggcgtcccgcccgcggcgctcaagcggctcaaggacgccgagctgcggggcttcatcgagcgctgcatcggccagccccggaaccggccctcggccgctgacctcctgcaggaccccttcttcaacggcgtccgtggcggngacgacgacgacgacgccgcggcgctcgccgacgccttcagcgtcgtcgccgncgcgcccgtgccgcgccccaggagctacgtcgacgacctcgccgggctccggctggactgacctgaccgtccctcccagcgttctgcctttcatcagtaccgggattccggcgcgtgttagacgtgttttattagaagtg

SEQ ID NO: 73902 - DNA, 507 bp, Zea mays
  Clone ID: LIB3079-042-Q1-K1-D4
gggaagtactgtgatgtaacacttatgtcactggcatatgccgggacaggaaatgtgcttaagggtcagaaacttcttggcatttgctcacagcatcttgagaaaggtgaaacacaccaagggccagctgtcctagggattgctcttattgctatggctgaagaattaggagctgaaatggctgtacgttcacttgagcgtcttctgcagtatggcgagcagaatataagacgggcagttcctcttgctcttggtatactctgcatatctaatcccaaggtaaacgttatggacacactaagcagattgagtcatgatgcagacgccgatgtgtcgatggctgcaattatctcattgggtttgattggtgctggcacaaacaatgccagaatagctggcatgcttcgcaatctttcaagttattactaccaaagaatctgctcattctgtttgtgttaaaattgcccagggccttgttcaccttggaaagggctttgttgacccttt

SEQ ID NO: 73903 - DNA, 687 bp, Zea mays
  unsure at all n locations
  Clone ID: LIB3079-042-Q1-K1-D5
cccacgcgtccgggacaagaacgatactaggaagaagaagaagaaggcgccgtgggaagaagaagacaaggacgaaggcagcaaggtgactctttcagggctcctcaacttcatcgacgggctgtggtcggcttgcggcggcgagcgcatcatcgtgttcaccaccaaccacaaggacaagctggacccggcgctgatccggcggggcaggatggacatgcacatcgagatgtcctactgctgcttccagggcttcaaggtgctcgccaagaactacctgggcgtgcaggagcatgacggcgagctgttcggcgacatccgtcggctgctggaggaggtggacatgactccggcggacgtggcagagaacttgatgcctaggtccaagaccaaggacgccgatgcctgtctccggaggctcgtcaaagcgctcgaggaggccaaggaggcggcgttgttggcggccaaagccaaacaactggacgggatcaaggacgatgagggaaccgacgatgaagacgacagcgatgacgatggcagcgttaccagcagaggtcacccctccgacggtgacgaanagagtgccaaaaaagaggaaatgtaataaaaaagtttaaaacctataaaagcctgaaagctaggtgaggatacttgactngagcattcctttccaagctggtggtacct

SEQ ID NO: 73904 - DNA, 650 bp, Zea mays
  Clone ID: LIB3079-042-Q1-K1-D6
cccacgcgtccgtccaaatccgctcgtctcccctcgaagtcactccctccagccctcgccggctccgcgtcctccggctctcccacccgagccgagaccacccatccaagcgcgcgcagctccggaagcgacagggccggacgagcgcctcccaaatttagcagccgcggagcgcgtgggcgtgggtccgtaaggagggtcgatggggtacctgccgtccctgagcagcaaggcggcgcacttcgtgtccgacctcaccaccgtcatcctcagccccgtctccgagcgcgagacgtcccacctccccgaggttgacgaagtgctagaaaatttggacgatgataaagattccgagcacaattccgatagccttgatggccctgacacatcttcctttagagcattcttgatctcatttttgtcatcatcgagctctaataacgattcaatggagataattcctgagcagaatggggacatgggttaccctactttaacacccatggggaagggaagcaagggaagaacgggtctgttaagtagggggaagcattccatcggaaaaatcattaacaaggcggcaaggattagtggtttcaaacaaacaactgcagagcctaaaattgacagggaggcagtaactcatactg

SEQ ID NO: 73905 - DNA, 345 bp, Zea mays
  Clone ID: LIB3079-042-Q1-K1-D8
cccacgcgtccggcgcggtgcccgtgccggtgtcggcagacgcggcgcaagcgctggagggcgactgcgcggcgggccgcgtggagctacgcctcgtcgtcatgggccgggtcaagtacatgagcgggccattcaggaccggatggcgcgggctatacctgcgctgcgatgtcaccgtcggcctctgggtggacgccaccgcgggcgacgacggagccggggacgtgccactgctcgagtaccccaagtgctccgtcgacgcttgagttgatccttgatcggcgcaatgcatgagcgctcagatgatcagattttcagaattctggtggagaataaggaattggg

SEQ ID NO: 73906 - DNA, 235 bp, Zea mays
  Clone ID: LIB3079-042-Q1-K1-D9
gccgtggtttggaaaaatataatagtttttcccaagtgtttggctaccttgtaaaacctcgcttttgagtactataatttagtagttctatggtttagtagataccatggtatttatttttggagtatttaaaactccactccaatctaaaatttttttatctatgactggcttttggtatatatacattaaatatcatggtttaaaaaaaaactgctacctcaaaaggctacaa

SEQ ID NO: 73907 - DNA, 597 bp, Zea mays
  unsure at all n locations
  Clone ID: LIB3079-042-Q1-K1-E1
gagctccgcttgcttgaagtattttaccacaagatttataagatctttccacctcatgagaagatagagaacataaatgatcagtactggacattacgagctgaggagatcccagaggaagagaagaatcttggcccacatgatcgattgattcatgtttaccatttcatgaaagaccctaaccagaatcaacaaattcaaaattttggagatccttttttgatggttattcgggaaggtgagactgctgcagaggtaatggagcgcatccagagaaaacttagagttcctgatgatgagttctccaagtggaagcttgcattcatatccatgaaccggccagagtacctncaggacactgacgttgtatcagcacgntttcagcggagagatgtatatggtgcttggggacaataccttggcttggagcacactgatacaacatcgaaacggtctacacatccaatcagaatcggcacacctatgagaagcccgtaaaaattattaattgagaaaccttcatcaaggttcaatccattgtcaaaggcgtcgacagcagcttgcccaaggtgatacgacgctttaaacggaaaaatc

SEQ ID NO: 73908 - DNA, 700 bp, Zea mays
  unsure at all n locations
  Clone ID: LIB3079-042-Q1-K1-C5
cccacgcgtacgcccacgcgtccgaccgtatgagaggacctatgcatgggcaatacccagaactacaggagtactggaagcagtcccaaagttctacgcgtcctgccccaatgcataatgctgctgataaatggattactgagtttggcaagcaaaataataatccagaaaattgggcgaactctttcgaacaacaatatggccccaatgggtgggcctctgagtttgaacagcatcagtctcagatggccatgcgccagatgggaggagcgaacatggccaacctggctgctatggagcaatcccgagtgcttgcacaaactttagcaagtaataatgatcccaagtttcagaattctaagttcttccagtttgtttcaaagatgagccgaggtgaacttattatagaagataatcaagtaaaagaaggttcagcatcccaatccagtggctgggctgatgaatttcaaacaccgtacattgctaatgcaaactcatgggcagatcagtttgcacatgaagagctttcacaaggggcggataagtgggttagcgagttctctagtcaacctaatcatggtgcactaaatgagaactgggttgatgagttctcgaaataaatgttactgacgaatgggcagaggaattcagtggaggtggttntggcgaaagctctgctggatcatgggtagatgagttc

SEQ ID NO: 73909 - DNA, 170 bp, Zea mays
  Clone ID: LIB3079-042-Q1-K1-B12
gcgagagagatccggagcagccgcagtcccaccgaccccgccgccggtcgccctccatctgctcgccgctgcctctcgtttctcttttcaataatcaagatgagccgtgggggagtgcccgtggtgggcaaaggtctctggggtatccctttggaagccgtgaacccccc

SEQ ID NO: 73910 - DNA, 357 bp, Zea mays
  Clone ID: LIB3079-042-Q1-K1-B2
gcgttgcttccgctcctgttggtccgctacgcacgccggatttttgcatcgagcacggagatctacaacaaagacatggagctacgacgcgattcccaagtatgatggattccactattcatcaaccgaaattatggcgcgcttcaatcgtggctacgctgatggggaactgatccgttatggtgtgcttggatcgtggctgtgtggagatgtgtggaactcattggttataatggtgatgctgatggaactgattttgctcccgttggacggcctgattggttactttgccctgttgactgtttgagaacgtatccgccaggtttacttatacttactgctttttgacggtactgt

SEQ ID NO: 73911 - DNA, 500 bp, Zea mays
  Clone ID: LIB3079-042-Q1-K1-B3
gtggccgtttagtaacacttctgggtgggagggcagcagaggaagttgttttagcaggacgggtttccactggtgcacttgatgacataagacgtgctactgacatggcctacaaagctgtagcagaatacggtcttaatcagcgcatcgggccaatatcacttgctacactgtcaaatggtgggttagatgactctggtggttctccatggggaagagatcagggccatctagttgatctcgttcagagggaagtaaaagcgcttttacagacggcactggaagtagctctttcagttattcgtgctaatcctgcagttttggaaggcctcggagcatatttagaagagaatgaaaaggttgaaggcgaggaacttgaagagtggctaaagtcagttgttgcatcaaaagagttgacctcttttatcagaggacagcaagagcaagttcttcagctggaagcaggctcctagcgtcagggactcttaaataaatactta

SEQ ID NO: 73912 - DNA, 275 bp, Zea mays
  Clone ID: LIB3079-042-Q1-K1-B4
aaaaaaaaaaaataaaaaaaaaaaaaaaaaaaaaaaaaataaaaaaaaaaaaaaaaaaaataaaaagggaaaatataaaaaaaagaaaaaaaataaaacaaaatataaaatacctaaaaaaaagtggtgtaaaatattggtttaaagctatgttaaattatcatgataggatgttacaagatgaatactctatcatatcccttttaagaagaaactttatcttaaagttcatgtactacccatagaaatggatcctatagtaacacattgaacac

SEQ ID NO: 73913 - DNA, 691 bp, Zea mays
  unsure at all n locations
  Clone ID: LIB3079-042-Q1-K1-B5
tcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaantagatggtggtgatctgagtggtggtcttagtttatcat

SEQ ID NO: 73914 - DNA, 532 bp, Zea mays
  Clone ID: LIB3079-042-Q1-K1-B6
gccacacgtccgtgcacacgtactgtgagacctacttgatgaaccattatgtcaacgctacgatcagcactcattacatggctacgatcggcccggatttgctcacccatgacgctctgctcgtggacaggatttttactctgcaaatgtgggacactgttggccatgaatggtaccagagtctagacggtgcattctaccgctgtgctgattgttgtgtgctattctatgacgtccatgctatgatgatcatatgacgacctgaataactgtcgagaatagtatctagttcatgctagctccatcatatcctgataacatacctgatgttcaggtgggtaacaaagctgatgtatatggtgacaacagcacacgcgttatctgctaacaaggcgaacgcttggtgcgcttacacagggaacatcgactgctctgacacgtctgataccgaccgaacgatcgtggaagacgctttgcagagtgtcccgaagaatgctctgaataatgaccatgccgaagaactgtatgtgcc

SEQ ID NO: 73915 - DNA, 58 bp, Zea mays
  Clone ID: LIB3079-042-Q1-K1-B7
aaaaaaaaaaaaaaaagaaaaagacaactatagaaaaaaaaaataaaaggggacgggg

SEQ ID NO: 73916 - DNA, 692 bp, Zea mays
  Clone ID: LIB3079-042-Q1-K1-B8
gctgctaggtggttgctgcatactggtcttccctctttctcttgccacctcgggcatcctctctggcttagaaaaaaaatatgcgcttcatagtccatacctagatcttttggtgttcagttttggtttcaagccatggcgaattctcggattggacgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgttcaagacatggctttcactctccacaatacttggtggaagtgtgatctatggtttcacaga

SEQ ID NO: 73917 - DNA, 103 bp, Zea mays
  Clone ID: LIB3079-042-Q1-K1-B9
tttgcccggccggcttccaagccggccgaaggaacccgaaaaccaaggcaagaaccccggaagggctgagggaagggccgccgggcatggctcgccggccggc

SEQ ID NO: 73918 - DNA, 459 bp, Zea mays
  unsure at all n locations
  Clone ID: LIB3079-042-Q1-K1-C1
cgacgggccgctcgatctccacctctgaagtggctgcttgtgatctagatctgaaagctgcagtggttgacagctgagtgtgaaactgtgaatcgaagatgagcgtggtgggcttcgacctcggcaatgagagctgcatcgtggcggtcgcgcggcagcgcggcatcgacgtggacgaactgctggaagtcgcgaagatctacggcgtccatgtgatgccgaccttctgcttcatcaggaacggcgagacgctcgagagctttgctaccgtcgacgaggacgagctccgggacgccgtcaggaagtacgccgncgctggcactacgacggctcctgcctcggcgtccgcctaattcaggagatgtgatgtgtagcaaatagcgcgcgcgcaccagtcgtcaataaataaattaataaataaataaataaataaataaaggccaacgtacgacgacaaat

SEQ ID NO: 73919 - DNA, 305 bp, Zea mays
  Clone ID: LIB3079-042-Q1-K1-C10
cccacgcgtccgggacgccttccacggcgacaaggaccacggcggcgtccacgacggcaccaccgtcgtcctctgggagtgggccaagggcgacaaccagcgctggaagatcctgccctggtgaacgtgaacagagacgagctagatgaatccaaggaaccttacctagctgctgccgccgccgcctaattcgtcctcctccgctctagctgttatctgtctgtgtcttcgcgtcctcggttcctgaatggacgaataatatatagcatgcatgtacggctagcgaccatgtcttgatgacatct

SEQ ID NO: 73920 - DNA, 301 bp, Zea mays
  unsure at all n locations
  Clone ID: LIB3079-042-Q1-K1-C11
gagagcatcaacaacaagctgcagctgctgatgaagagcggcaagtacaccctgngctacaagaccgtcctcaagacgctgcgcaactccaagggaaagctgatcatcatcgcaaacaactgccctccacttaggaagtctgagattgagtactacgccatgctggccaaagttagtgtgcaccatttccacggaaacaatgttgatcttggcactgcctgcggcaagtactacagggtgtgctgcctcagtatcatcgacccaggtgactcggacatcatcagtaccaccccttgcaccc

SEQ ID NO: 73921 - DNA, 309 bp, Zea mays
  unsure at all n locations
  Clone ID: LIB3079-042-Q1-K1-C12
ggtgacctcggtggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgangggaagaggctgtactcgctggatgcgggctccatcatccactccctctgcttc

SEQ ID NO: 73922 - DNA, 466 bp, Zea mays
  Clone ID: LIB3079-042-Q1-K1-C2
cgaaaaacctcctctacagtcccatctaggcgcccctcctcggctccgatccagttgcgccggcggccatgtcgcagccggcggcgacggtggccgcggcggcgcagccgcagggtcgcggccccgcggggcgccagggcggcctggggcagagcatcgcaggcatcgtgcggatggcggtgttctggtactttgcgtccaagttcttcgggcccaagcgcccacccgcggaccccgggatgctcatgtccaacctcttccagaagggcgagccaatggatatgtggatgtatttgtcagagaacgagaagttcaacgattttgctaatgaggatgcacttatttggcacgaggcaaacataccatatgcagtctggggacctaccagtactagaacacggtcattaacgtactatccgtcagaggctctcaagcataatggctctttgtatgctcatgtttactt

SEQ ID NO: 73923 - DNA, 542 bp, Zea mays
  Clone ID: LIB3079-042-Q1-K1-C3
cccacgcgtccggttactacatataacatggttgcattcggtggtaaaaggtctgaagattcggagaagatcattgaagaaatccgaaacagagagtggggcttgcttctaatggatgaggtccatgttgtccctgcacatatgttcagaaaagtcatcagcattactaaatctcactgcaagctgggtcttactgctacccttgtgagagaggacgaacgtattactgacctgaattttctaattggaccaaaactgtatgaagcgaattggttggatttagtcaaaggtggatttattgcaaatgtgcagtgtgcagaagtatggtgtcctatgaccaaagagttctttgctgagtatttgaaaaaggaaaattcaaagaagaagcaggtactgtatgtcatgaatccgaacaagttcagggcttgtgaattcctgattcgattccatgagcaacaacgtggagacaagataattgtgtttgctgataaatctgttgcactaactacttatgcgatgaaactgcgcaagccaatgatttt

SEQ ID NO: 73924 - DNA, 526 bp, Zea mays
  unsure at all n locations
  Clone ID: LIB3079-042-Q1-K1-C4
ggagaagagctagaggggatgggtggcggcacggtggtgtgtgtcaccggcggcagcggctacctcgggagctggctcgtcaggaagctcctcggcagaggctgcgtcgtccacgccaccctgcggagcctcgcggacgagaagaagacggggctgctccgggcgctccccggcgcggcggagcggctgcggctgttcgaggcggacatgtacgacgccgacaccttcgagcccgccatcgccggctgccacttcgtcttcctcgtcgccacgcccctgacgcacgaccccaccagcaccaagtacaagaacacgacggaggcggcggtggacgcggcgcgcatcatcctccggcagtgcgcgctgtccggcacggtgaagcgcgtcatccacacgggctcggtcacggccgcgtcgccgctcaaggaggacggcagcgggtacaaagacttcgccgacgagtccaattggacgccgctcaacctctnctacgaattcaccaacgcttacctggacgactacgtgc

SEQ ID NO: 73925 - DNA, 253 bp, Zea mays
  Clone ID: LIB3079-042-Q1-K1-B11
gcggccacgcgtacgcgcccttgttctctgcgactctgcccggccggtctacgaggcgcgcggagggaacgggagagcaaggcgaggagcgcggaagggctgatggaaggggcggcggggcatggctcgccggccggcgtcgtgggagcagggcggcgacgagtacgactatctcttcaaggtcgtgctcatcggcgactctggcgtggggaagtccaacctgctctcccgcttcaccaagaacaccctttgc

SEQ ID NO: 73926 - DNA, 420 bp, Zea mays
  Clone ID: LIB3079-059-Q1-K1-G2
cccacgcgtccgcccacgcgtccgctcactagtactcagccgccgcaatcaggggggcagggagctcgagcgcgcgctccacctgcgccgacgcgatgcgggccaagtggaagaagaagaggatgcggaggctcaagaggaagcgccggaaaatgaggcagagatctaagtaggcgcatcttgtgaccgaggatggcgagcttctcctgcaccatggctgtgacgcgttgggatgattgtctccctttgtagacgtgctttgctgtagacgtaggcgatgtaaaccgtcctttttgattaattctagtatgttctgagactgggtttatattgtaatttgaggataattatatgatgctctaagtttattgatattcctgtcactcgaatatgttagatgtcctttcttcagcgttggtc

SEQ ID NO: 73927 - DNA, 299 bp, Zea mays
  Clone ID: LIB3079-059-Q1-K1-G3
ccgaatcgcaatttcgggctagacctacgcgtacacccacgcctacgtcatcgaccaccgggtcatcgacattcgtcacaaagccatttggaccgcggcacgttgtcctcgcgctcgtgtagcccactttgatgtcgtcttcctttggccgcatccgacatctcgccagttgcccctcatctccctaccgagcgctgctgtccatccttgtgcaacaaaaatcaccgctggctacattgttggctcactggtcggatcctttgccattgcatacctgtgtgacacatttatctctgaca

SEQ ID NO: 73928 - DNA, 399 bp, Zea mays
  unsure at all n locations
  Clone ID: LIB3079-059-Q1-K1-G4
cccacgcgtccgcccacgcgtccggagttccagaccaacctggtaccctacccgaggatcgacttcatgctttcttcgtacgctccagtcatctctgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctnctagcgttgtgcctggtggcgacctggccaaggtgcagcgtgccgtgtgcatgatc

SEQ ID NO: 73929 - DNA, 84 bp, Zea mays
  Clone ID: LIB3079-059-Q1-K1-G5
atcgaattgcaattcccacctacacgtacgcgtactcgtacgcctatgacatcgtccacttgcacatctactctcgcctctaat

SEQ ID NO: 73930 - DNA, 344 bp, Zea mays
  unsure at all n locations
  Clone ID: LIB3079-059-Q1-K1-G6
gaaattaaaaagctgaagctcaaaccatattatttccctttgtttgttactgagaatgttgtacagaatgaaaaggaccacattgagggctttgcacctgangtagcttgggttactaaatctgggaaatctgacctggaagcaccgattgcaatccgacccacaagtgagactgtcatgtatccatacttctncaaatggataagaagccaccgagacttacccttgaaggtgtaatcaatggtgtaatgttgttagatgggagtttagcaatccaactcctttcataaggagccgtgaatntctgtggcaagaggggcatactgcttttgcgactaaagaag

SEQ ID NO: 73931 - DNA, 249 bp, Zea mays
  Clone ID: LIB3079-059-Q1-K1-G8
aacaaaacagatgtggaacaagaagagagagcatgaagagcagcgtgaggcgaccagagaggagcgagtctatacttggagggatcagcttgaatcactgtatagatagaacggctacgactaaccaatctctgaaaactgaatactgaacatcggatcaaatctaatgtgcataatccactacagcgacactgactgtaatgtctacattgactgatcatctcatagcggccttgaatctgaccagat

SEQ ID NO: 73932 - DNA, 230 bp, Zea mays
  Clone ID: LIB3079-059-Q1-K1-H1
aatcattgcctttctcctacacatgatctatacgaatacccttccttaccatcactggcggtatcaccatatcgtactgtcatttcaatatgcaaacctataccaagaccctacacctatatactatcacactccatgtataacttctgacaccattaacactgtcatatctaagaatccctactatcatgacatacatcctgaatacccacatcttctattttaccact

SEQ ID NO: 73933 - DNA, 430 bp, Zea mays
  Clone ID: LIB3079-059-Q1-K1-H2
cggacgcgtgggcaaactacaaaatgaagtttgtttcttgtaccttgctagtatggcagggccaattctaaaagggaatttattactctattacaattacaaatgcgaggagcatatctggttgggaaatagactgatgatgactgcaactgcagggaccaggagcatggactgcacatcaaagatgtcatagatcgtctcaaactaccagatgatgtagtcagtgcggccatccaaggtcatgttgatgtgggcaacatttacaacacaattgatgacttccactacaaatctgtccggaatggatgaccacgttgcaagtccagcgttcaagctccgtgtaagtatggagcccgttcaaggaagaagaaaatgtaaccctctttaggatcgcctatattttgcagataggcttcatggtcaacagctt

SEQ ID NO: 73934 - DNA, 185 bp, Zea mays
  Clone ID: LIB3079-059-Q1-K1-H3
cggacgcgtgggcgaaccccgccaagaaccctagcacgggcaagccaaaacgaccgtggtggccttgcttcttatggctcgattgacttcttgcgcccatttctggaaacaagccattcccggagaacagggaaccacttgaaccccaagtggggtttccccggcccttttcggggttcccgctt

SEQ ID NO: 73935 - DNA, 196 bp, Zea mays
  Clone ID: LIB3079-059-Q1-K1-H5
acgattgattgagatttatctcaaaaaaaacaattcatatacaaataaataaaaaaaaacaaaagggggggtttctttctaacaggacctagctttcatacacaaacaggccgcccgttctataggattcaagcgtcacgtaacataccattcaacgtcctaacttttataaagtgtaacctaaataaaatccact

SEQ ID NO: 73936 - DNA, 284 bp, Zea mays
  Clone ID: LIB3079-059-Q1-K1-H6
aaggattgcatatattctctatgtgatatggacgcctacccttctgaagctttagtttcggtatcagcagaacgaaatgggatccccattggaaaaccgacacctgttgcaaacacctatgtcgttccaagctccatggagaagttggtcatgtatttaaagcagagatataaaagcatacctttgtacatcacagagaacggttatgcccaaatagccaatattagcactacagcagatgaaataattaatgatattgaaagatcaacttacattcgtgacta

SEQ ID NO: 73937 - DNA, 185 bp, Zea mays
  unsure at all n locations
  Clone ID: LIB3079-059-Q1-K1-H7
gcaacagcagctcgtcnagcgagtcgtcgccggccggccggtttatacccaggaaagccggaagaacacttctgcctcttcctccatatccaagaaccaaaggtagctagctagccgcgactcgttggctagacgattcaagcagcagcgcaggatggtggcgccggtggtgattgcgtcggccg

SEQ ID NO: 73938 - DNA, 113 bp, Zea mays
  Clone ID: LIB3079-059-Q1-K1-G11
tcttcctaaaaaaaaaaaaaaaaaaaaaaaaaaaataaataaaaaaaaataaaaaaaaaaccaaaaagacacactcaaacattcaaaataattatctcatatataatatcacc

SEQ ID NO: 73939 - DNA, 420 bp, Zea mays
  Clone ID: LIB3079-039-Q1-K1-B7
gagatgaacatgaacgaccattctatgtaactgacgatgaaaggatagttgagatacaaggcgatacagagaaagttctaaaagcactgcaagcagtttcaaatcatcttcggaagtttttggttgatcatagtgtacttccattatttgaaaagactaatactacagtgagccaagatcgcaatggtgatggttggagcgatatgtcacgtccttcaattggttctgcacaagtgaatcaactaccttcagtgttagatgactatattcttcaagtgaagagggatcctctgtaccttgaacgagaatctttggtagatcataacattcatcgctcaggcgtatcactttatgggcgtgatccagccttgtcaacactacgaccctctgcagtacatggtgctggctcactacttacac

SEQ ID NO: 73940 - DNA, 185 bp, Zea mays
  Clone ID: LIB3079-039-Q1-K1-B8
ggaagttcaatcaagcatcaacctttggagctgtgttagacatggttacagatagggttagcactgcttgtttgttggcccttctctcccagttttacagacctggtttagtcttcttgatattgcttggattggatattacgagccactggtttcaaatgtacagttctttcttgtcaggtaag

SEQ ID NO: 73941 - DNA, 368 bp, Zea mays
  Clone ID: LIB3079-039-Q1-K1-B9
acccgtccgctcacgcgttcgcccacgcgtccgcccacgcttccgctcatttggccagttcttggggggaggtttcccagctatgatcgttggggttctcacaaactctgctatcctccttttgtacttctggaaatacttgtcggtggagaaggatcatgagggtgcgcagcccacaggaccagacgtggttgccgacgatgaggttccttcccatcggttcacaccggctagaatgtcacatgtttcttctctgaatccacatgacatggattgcgtaagcgaaccgatcatcaagagcaacagtgtcactactactgggaatgagaacctgagaagcagaagcatcaattcttacgctgacattc

SEQ ID NO: 73942 - DNA, 61 bp, Zea mays
  Clone ID: LIB3079-039-Q1-K1-C1
ctcacgctatctctctcacgctcactttcctttcacggtgactgccaattcagtggggggg

SEQ ID NO: 73943 - DNA, 367 bp, Zea mays
  Clone ID: LIB3079-039-Q1-K1-C10
cacgttgactttttcaactgtctgcccctgatgtccgttggctccctacagaggccgggcgggccgcatcaccagggtcgcgccatgacacctgcctccttcgtctccgaccccgcgcccgttccctagccccctaagcctctctacctccggggccctgtcatcgcatgcgccgtcacgctggcctcgtttcttctcctcgccgccgactacgccaccaggcgagcacggtcctctccggccgctctactctcccacccagctgtttccaccaagttcttctccttcgacctgatgcgctagtaccctcactaccctgccggcttcacccaaggtatcttgtacgcgggaaatgacacccttttcg

SEQ ID NO: 73944 - DNA, 450 bp, Zea mays
  Clone ID: LIB3079-039-Q1-K1-C11
ctctatctctattcattccccgcctcatccctagccagccgtcatagctagggtctgcggcgacgtcgccaccatgcgctaacagctatcaggacggtatgccccactcccagctcgctgtgctgatcgactgacgcaccctccacagccatctcgccaagctcatcttccagctgctgatcctgatgctggcggctccatgtttggaggcattcggcccaccattgatcaccgtctggccattggcaccgatagagccttggcacacatggcttcacatgctttactaggtgctcggcccattcagcatgatactgtagcctaacaagctgctgctgctgaccctgtcttaccactgatgaatgctgatgcttgcagcattcatcctaagggttaccaagattgcctcaacaactatggcagcgagatcagcaggcgacagttatacct

SEQ ID NO: 73945 - DNA, 409 bp, Zea mays
  Clone ID: LIB3079-039-Q1-K1-C3
cagcagcttccaaggattattctggttgctttccatgattcttctagcatcctttgttgctcatgcacgcacaacaagtgggcacaccaaagaggacagcaatgctaggaacatgacgatgaccaagacgagggcatcgggcaacatacttgttagccgtaatgacgacgggccatgctatctagattccggtcttaatgagtacgtctgcagaaagactaataagtgctataagagcttggtgctctgcgtggcgagttgtcaaccatcatcatgaattcatgatactgcggagacatcatgatactgcggagacagacggcgagagatgaagctagctagatgctgtttcaccaaaatattatgtaacacccaaatctcccattttaagaaataaataagattttcg

SEQ ID NO: 73946 - DNA, 198 bp, Zea mays
  Clone ID: LIB3079-039-Q1-K1-C4
tttgaagatatgaaaaagcgttcccctatgattgatgcagcgggaccattaaatgaagttggggcatcattccgaagggtgatgggtggaacaggtggattcttgtttgccatactctgcaaggctgcgtttgcagccttaaagcaaagttcacttgtcattgcaattaaatgggctgttccttaaaaggcctccatt

SEQ ID NO: 73947 - DNA, 116 bp, Zea mays
  Clone ID: LIB3079-039-Q1-K1-C5
aaaaaaataaaaaaataaaaaaaaaaatttaaaaaataaaaaaaaattaaaatcggtgggaattaaaaattagatatggggggtcactttgtcggttccatctattcctttcccat

SEQ ID NO: 73948 - DNA, 173 bp, Zea mays
  Clone ID: LIB3079-039-Q1-K1-C6
cggaattgcatgctcgacccaagccacccgtccgtcgtcccatggatggaaaccaagcttgtgttcctcttccactctctcagaggagcaaaggcatcttcagcatgggcttctcggggagaaaggggcataatttctgacatacgctctcagggcgcaatcactggaaggtc

SEQ ID NO: 73949 - DNA, 451 bp, Zea mays
  Clone ID: LIB3079-039-Q1-K1-C9
gtcgtcgtgatggcccggttcgacgtcgacgccgtgctggccgccatcgagcggcagggcggcacgtacctcttgtgcgccccgccggcgatgatcgcgctcgccaagcacagcaggggcggcaggtacgacctcagctcgctcagatgcatcggctctggcgccgcgccgctcggcaaggacgtcatggtggctatggctgacaggttccccggtgtcgacattatccagggttatggtatgactgaaacctgcgggataatatccctggagtacgtacagaagggttgtgcccgtcagtttggttcgactggagcacttgtcacaggagttgaagcaaagatcgttaatgcaaagacaatgaagcatcttcctccgagccaactaggagaaatctgtgttcgaggaccgaacataatggaaggctatttcaacaatgtgcaagcgactg

SEQ ID NO: 73950 - DNA, 425 bp, Zea mays
  Clone ID: LIB3079-039-Q1-K1-D1
cacataatcatcttcattcactcactctcttcgatcactgtactgaagataccatgggcaagtcgaccgcgatgtttgtagccgccctggccctggtggtggtgatggcgacgactagcacaggctgtggcagggcggcagctgcgtgcgatcccaagccgctggtggtgtgcgatccggcgttcatggactgagcgataccctctgcagcatgctgttccaccctgcgtgcgcatgaggcatgcttgtgcgtgtacgccaaagaccccaagtttgcaaaatacatcatcaacttcaacaccgtctaaacctttaccttttgcggcattgtcattctcaaatgctaatctagcgctctgcgtcgtcgctttgctagctcttgctcttgtgtgtaacatattcagcttatgaataaattatgtgga

SEQ ID NO: 73951 - DNA, 287 bp, Zea mays
  unsure at all n locations
  Clone ID: LIB3079-039-Q1-K1-D10
taccacacctacgctaaccatcacgcactcccttctaccattcaacccttacactcagggcggaccaaccttaggtanccacatttcacaaccctaacttcatatactacctaattctcactttcaataacttcatcaatatcaccaccaaattcacctacatcaccctacaacaacatctcaactctctccaaacacaccttacatatcacacttgtccataatatcaatcttctatacaaataaccaacacttcacatcattcctcatcaaagaacaccacttac

SEQ ID NO: 73952 - DNA, 454 bp, Zea mays
  Clone ID: LIB3079-039-Q1-K1-D11
cccacgcgtccgtatagcttcccttcttccctcataccttccatcaatgatagcttgagtatgtgaaaacccaggggttcaggcctataggctccaacaagcaatctcatcaagcaacatacctttatcacccttgttgtttcaacaatcgccagtcctatcttcggtgcagtcattggtacaaaccatcagggcacagcagctgcagcaactcttgctacctgtgatcaaccaagtagctctggcaaacctttctccctactctcagcaacaacaatttcttacattcaaccaactgtctacactgaaccctgctgattatttgcatcaacaactattaccatttaaccagctagctactgcctactctcagcaacaacaacttcttccatttaaccaattggccatactgaaccccgatgattatttgcagcatcaaatactactaccattt

SEQ ID NO: 73953 - DNA, 310 bp, Zea mays
  Clone ID: LIB3079-039-Q1-K1-D12
aaaaaacaaaacaataacaaaaacaactaaatttatacctaacatcaatagataacaacagagggtaaacaccctaacggtacacggccatacgacaacaacaagccttctctcactgcaacataccttaatcacccttgccatctcaacaatcgtcatccctatctttcccgcacccattcttacataccatcacgtcacaacaactgcaacatctcgagctacctgcgatctaccaagtctctctggcaaatctctctacatactctgagcaacaacaaatttctaacattcacccaacttgctacac

SEQ ID NO: 73954 - DNA, 406 bp, Zea mays
  Clone ID: LIB3079-039-Q1-K1-D3
cacttgtacacgcctccgccacccgacaaactactcaataaccctagctaaacccccacgccgccgcggcgacctcctccgccggcgggatggacagcctcaggggagtcaagttgccgggcgtgccgaagggcgggagtgcgctcgtgaaggtggcgctgctcggcggcgcggggctctacgccgtcctcaacagcttctacaacgtctagggcggacaccgcgccatcgtcttcaaccgcctcgaggggatcaaggacaaggtgtaccccgaaggaactcacctgatgatcccgtggatcgaaaggccgatcatttacgacgtccgtgcccgacccaacctcgtctagagcactttcggtagccgagtccttcatatggtgagaattggtcttcgtgtccttac

SEQ ID NO: 73955 - DNA, 263 bp, Zea mays
  Clone ID: LIB3079-039-Q1-K1-D4
aaatggaacaaatcaccaccaccacaccagcaatcgcaagactcctttgagccgaaggcatattgggtgggatggaagaaacatgcgcaaggagcaacggacgttgctgatgagacaacgccagcacgtggtcatggtctgcatgtcgcgaccgggatgctcttcacgaggaagagcttgcttccagggacagccctaccggaaggtaccaagttctgcggccacggcttcctcgatcccgaaaggtttgaactacgagcgga

SEQ ID NO: 73956 - DNA, 404 bp, Zea mays
  Clone ID: LIB3079-039-Q1-K1-B6
gggatgttatgcatggcatatgttgttctgaagcaaaatccataatgcaaaatgctggtcttgatgaaatatatggcgactactcggtgagaagttccgaatggattaagcactactccttgccagattaccttgctaaggttgaggaaagtatggaaatggaaaccaagaggctggcttactatctggaaatttcaagtggggatagctacccgctctgtttgcaggctgttaatgctcctttgatggaaacatatgtcagctatgtgacagagaaacaaatcggtggtcagctgatgcttgaaacttacaagattgttgaagaggaactgctctgcagatgcagtaacttgacaactggttaaccgggcaacgccgcaacaatttcttggacttaatggaat

SEQ ID NO: 73957 - DNA, 259 bp, Zea mays
  Clone ID: LIB3079-039-Q1-K1-D6
cccacgcgtccgcggacgcgtgggcggtcggcctcctcttctcttcacccacacgctggtcatagagatgtcggctgcagaggcgaaggcggcggctgtcccggagtctgtgctgcggaagcgcaagcggtaggagcaatgggcagcggacaagaatgagaaggcgctcgcggacaggaagaatgcgctcgagagccgcatgatcatcttcgcccgtgccaagcagtacgccgaggggtaccacgcccaagagaaggag

SEQ ID NO: 73958 - DNA, 386 bp, Zea mays
  Clone ID: LIB3079-039-Q1-K1-D8
gcctccacagaactctccccgactctgccgtccactcccccgccgcagccgcgccgtgcgcctggacaggagggatagtacagcaccaggatgccggcgacgcctacgatcattggtgccctcctggggctgggcacccagatgtactcaaacgctcttcgcaagcttccctacatgcgccatccatgggagcatttgttggggatgggtctcggtgcagtgttcgtgaaccagctggtaaagtttgatgagaagctcaaggaggaccttatcaggatacttgagctcgccaggctagccatacgagcatgtgctacattgacgatgatgaatagatgcccatatctatttgccagcgacctggatttattttgcaacatgttgtt

SEQ ID NO: 73959 - DNA, 112 bp, Zea mays
  Clone ID: LIB3079-039-Q1-K1-D9
tggttaatcaaggtaagacatctcgtctaggttaccgggatacaaacggcacatgctggcgtggaagtaagcttgggggtgtaagctgcggtcctagccggtgacgatactc

SEQ ID NO: 73960 - DNA, 358 bp, Zea mays
  Clone ID: LIB3079-038-Q1-K1-H7
ctccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacaaacttctggggcatgaat

SEQ ID NO: 73961 - DNA, 290 bp, Zea mays
  Clone ID: LIB3079-038-Q1-K1-H8
tgtgctcctaccggtagagtgaagactttaatgacaagctaccgctggatagcagagaagtcaatccgatttttgaagaaggatccaaatatgggcgcaaaaaacttacaagaggagctagaggataaatataatgtgaagctaggatactcaacagtgtgggctggtagacagatggcggtggaacaaatattgggaacatgggaagaaagttttgcagatttgtatagggtcaaggctgagattgacggcaaaaatgcctggaagggttatcgatttagaggtgcagg

SEQ ID NO: 73962 - DNA, 394 bp, Zea mays
  Clone ID: LIB3079-039-Q1-K1-A1
gccgtttctgcaaggaggttgtcttgactgatcacaatgatgaagttctggagattgtgaagaaaaatatagagttgcagtcatgttctgagaatgcacatgcagtgttgacagccgagaaactagagtggggaaactcagatcatttaagcggtattattgaaaaacatcctggtggatttgatcttgttcttggagctgatatttgctttcagcaatctagcatttcctgcctctttgatactgtagagaggattgttcgtattcaagctggtaaatgcagattcatattggcttatgtatcccgaactaaagtcatggatgcactaatactcaaggaagctgaaaagcatggaatgcgtgttgaaaaaatgaaccggaacaagaacaacca

SEQ ID NO: 73963 - DNA, 321 bp, Zea mays
  Clone ID: LIB3079-039-Q1-K1-A10
gagcagcctgccgtacctaaaggcgtccatgaaggaagcgctgcggctgcacccaccggggcccctgctgctgccgcactactccaccgccgactgccagatcgacgggtaccacatccccgccaacacgcgcgtcctcgtgaacggctgggccatcggcagagacccggcggtctgggagaagcccgaggagttcatgcccgaaaaggtcatgcgggacggcttggacaaggtccaccacttccagcggcaagaattcaaggaccttgccgtccggtcttggcccccgatcttgcccggggccaaatttgcgcttgggac

SEQ ID NO: 73964 - DNA, 285 bp, Zea mays
  Clone ID: LIB3079-039-Q1-K1-A11
tttccgactcagacctacccgtccgctgacccattaaggttccatgtcggattccttcacactactatggtgcttcaccgagcgatgggattgatcaagtggctacaggtgaatatgcacagcctgctctagagatacatcatctgctgctattcaatgtctgaaatgctcttgtctgccctaggcatcgtcatctagacaaggaaacagtctaccgtaatatcatacaccgtaatacatatgttatgaagttacagcgtactgatactgaagatccattaaatg

SEQ ID NO: 73965 - DNA, 254 bp, Zea mays
  Clone ID: LIB3079-039-Q1-K1-A12
tgtgcagccttgactaccatatcgcattcatctttaatccgctgatgcattaacctgggatgggcttgattatctagctcttctgcaatatccacagcattatctatgtttatccaatccgctgctacatactcacaaacatgtacttcttaaacctacccagataacacactacctggaaaaactcctatcaaattatacatgtactgatgattctgtaccgattacacaatatcctcacactcactattcta

SEQ ID NO: 73966 - DNA, 427 bp, Zea mays
  Clone ID: LIB3079-039-Q1-K1-A3
cccacgcgtccgcccacgcgtccggtttgagctgttgtaccttcacccaatccacatatagcactacaaaatggtcactgggaaagtagcagtcgtcctcctagcctgctggacgctagttctctaccaaccagtgcttggccgtttaccgtgtaacaatgatcagaagagagagatcctgcgcgagtgtgatccactgaactcaacacctgactatactccatcccggcacggtgcgtgctgcgtggcggtgagaaaggtgccaggaaccaacatgctttgcattgcctccatactctcacttgctgacaaggccaaatacagtgtaaggaagattctaggatttagagatgcatgcgccccttcacatccacaccatcaggtagttaatacttcgtctatcacttgacagtccttagactacagt

SEQ ID NO: 73967 - DNA, 368 bp, Zea mays
  Clone ID: LIB3079-039-Q1-K1-A4
ggcagatgtggatctccaagggagagtatgacgaaactggtccgggcattgtccacatgaagtgcttctaagtttttttgggaaatttttccaaaaaaaaaaagaagtttctggggaagttcgacatggtacgtcaggcgttaccggctcattgtgaaccaatacatgaactgccatgataaggttataagcagaaataacagtagcactggctccaattcctgaagatgagtctggtgcgccctgctgtatgaaatggatcccactcgtttattcgtcaccgcgccgcactggtgtaacgtgttgcctcaaagtttgctttttacctggtccttttttaaaaataagtctggttttggttggctacc

SEQ ID NO: 73968 - DNA, 297 bp, Zea mays
  Clone ID: LIB3079-039-Q1-K1-A7
cccacgcgtccgctccgccccgctccactctcctcctcctcccgggccggccgactccgatggccgtcgtcgaggccgccgccgccgaccacgccgcgccgccgctccaggaggaggcaccgggcgcgggcgcgggcgctggcgccgacgccggggagcgcgagatgcgggatctggaggacctgctctccaagctcaaccccatggccgaggaagtcgtccctccgtccctcgccttccttgccgccctcacgcccgtgctcgtcttcctcgttggctacggctgctacccggtcg

SEQ ID NO: 73969 - DNA, 250 bp, Zea mays
  Clone ID: LIB3079-039-Q1-K1-A8
ccaatctcttggtcagcaacctgtgacattcttcagggaggttcttgctctttgtgatcatccgtgcctcttggaaaaagaggaaaccaaatcattgttcagtgctgatgcaatttctcgagcaaagcaaattcttgcaactattcctggaagggcaacaggtgcatatagtcacagttagggtatcaaaggactgcgtgatgcaatttgctgctggaattcatgtcatgtgattggattccctgcaaat

SEQ ID NO: 73970 - DNA, 299 bp, Zea mays
  Clone ID: LIB3079-039-Q1-K1-A9
acgacacactcgagaactccatttcgatctcatttgaaatcaacccatcctcgtttcctcggactagcagcctgtcaccctcatggccaagatcaagatcgggatcaatgggtttggcaggatcggaaggctggtggccagggtggtcctgcatagcgacgacatccagctcttcgacatgaacgaccccttcatcatcaccgattacatgatctacatgttcaagtatgacactgtgcacggacagtgtgagcaccatgaaggtcaggtgaaagactccaagacccttctctttggtg

SEQ ID NO: 73971 - DNA, 407 bp, Zea mays
  Clone ID: LIB3079-039-Q1-K1-B1
cccacgcgtccggagctttcccgtgaggaaaatgtgtacatggcgaagctcgctgaggaggctgagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaatgaggagggccgaggcaatgaggaccgagtaacactcatcaaggattatcgtggcaagattgaaactgagcttaccaagatctgtgatggcatccttaagctgcttgagacccatcttgtgccgtctttcacttgtctctgagtccaaagtcttctatctcaagatgaagggtgattactaca

SEQ ID NO: 73972 - DNA, 385 bp, Zea mays
  Clone ID: LIB3079-039-Q1-K1-B10
gaaaacgttttcatgttccaaaagacagctattcataaatgcaattcggagggtaaaggtgggatcatcactagagttgtggacagcatgattgacaatctacgccctacccgtgcagaggcaactgatgttgcaaatgctgtcctagatggcactgatggcattttgcttggtgcggagacacttcgagggctttatccttgtgatgcaagtagtactgcggggagaatatgtgcagaagcttagactgtgtataatcaagcgcttcaattgaagaaagttatgtggcatgtaaggtacccaatgccccaccaggaatctggggcatcaacaacggttggttctgtaatcaaagtgaaaactgctgccattggtgggttcacat

SEQ ID NO: 73973 - DNA, 330 bp, Zea mays
  Clone ID: LIB3079-039-Q1-K1-B11
ctctcggcgcatcatcagctgaggctgagctctctcattcaccgctggctcttgctggggtgttcataagtaactgcgcattgccttgcccccttgtcctgctccctactcccctccggatctacccggctgctccatttaattactgactcgtacccttccccgcattcgccttcttgtctcttccatcccacccgtatcagccaccggttcccaatgcccaggtaggcagcccagcactgtgtggtcgtctgatccgcggcggcgcgcccgtcgttacctacgcgaatggctcctccagcaggggcagggaacgcgaggaggccattg

SEQ ID NO: 73974 - DNA, 415 bp, Zea mays
  Clone ID: LIB3079-039-Q1-K1-B12
gtttgggatctggtatttctctggtcattgttaccaatatctgtgagaatatcatcgggaaggcatttagccccagaaccatgaacagtggtcgtggcgctgaatttgatggggctgtcatttcactgtttcatctgttgattacgagaaccgatcaattccgtgcttttcgttaggctttctaccgatagaaccttccaaatgtgaccaatttgcttgccactgtcttggtattactaataggtatctatttgcaaggcttccgtgctgagcttccagcgtgatcaaataatgctcgtagccagcaaggctcatttccaattaagctgttctacacttcaaacatgcccatcatccttcactctgcgctgattaccaacctctattttatatcccagcttctctacaggaagta

SEQ ID NO: 73975 - DNA, 433 bp, Zea mays
  Clone ID: LIB3079-039-Q1-K1-B2
atcaaacaaaacagcagggttatattgcctatcatctttcctgcactggagagaaatgccagtgggcactggaaccaagctgtgcaaagcctcactctaaacgtccgaaaactgttctctgacaatgaccctggactattcacggagagtctgcggaaatacgaggaagagaaagcgagagagaaggaggttaagtcgaagcaagaggccacatggagacgccttgaagagatggcatcagcgaaagcgacaagcggcgcggcagttctcgtctctcgacccttatcccggcagtcttcggctgtgtagcgaattttcatgtgggggtcgtgagaacattgtacaggattgagttgtatatacgaggtatattaaggtgggcaaatttgacaaatgatatcgtctgaaaaaccagtcagatgggttacagggc

SEQ ID NO: 73976 - DNA, 193 bp, Zea mays
  Clone ID: LIB3079-038-Q1-K1-H6
cccacacgttcggctaaaggctatagtttttttcaaaggtccaatactaattcctggactatagactgaagtatggctggagatcttccaagatctgtccagtacaaaggaagcgattaccggagcttacaccacagctgcctaagccattccagagtacagatggttttactatgatcctatataagatggc

SEQ ID NO: 73977 - DNA, 409 bp, Zea mays
  Clone ID: LIB3079-039-Q1-K1-B3
cccacgcgtccgggcgtggaggcagtacctgctccagctccagcaacatcctctccgcacaaagatgatcacggcggggtgcctcgccggcgtcagtgactccgtggcgcagaagctctctgggttccagaagattgagaaacgcagactcctgctcaagatgctctttggttttgcgtatggtggcccatttggacatttcttgcacaaaattttggattacatcttccaagggaagaaggataccaaaaccatagcaaagaaggtgttgctggagcaagtgacatcttctccctggaataacatattgttcttgttctattatggatatgttgttgagaggaggcctttgaaagaggtgacgaccagggtgaagaaacaatacccttctgggcaacttagcgcttgg

SEQ ID NO: 73978 - DNA, 167 bp, Zea mays
  Clone ID: LIB3079-039-Q1-K1-B4
ggagcgcacacacacacaaccagatctctccaatccacccgtcggcacctccgcttcaagatgcagatcgttgtgaaaaccttgacgggcaagacttattcacctctcgaggtgggagtcgttttgacaccattgacaacgttaaggccaagatccaggccaaggag

SEQ ID NO: 73979 - DNA, 68 bp, Zea mays
  Clone ID: LIB3079-039-Q1-K1-B5
aaaaaaaaaaaaaaataaaaaaataattataaaaaaaaaaaaaaaaaaaaaaataggagggataatat

SEQ ID NO: 73980 - DNA, 206 bp, Zea mays
  Clone ID: LIB3079-038-Q1-K1-G1
cccacgcgtacaaagtccacctccaagttcgccaccgtccgcatacatggcatcgcctggtccttcttgggcatgatctgcgcgctcgtctactgcaccgtcggcatctacggcgggcacatcaacccggcagtgaccttcaggctgttcctggcgaggaagttgtgcctcaccaacgcggtgctgtacatgatcatgcagtgcct

SEQ ID NO: 73981 - DNA, 275 bp, Zea mays
  Clone ID: LIB3079-038-Q1-K1-G11
ataggattccggtcctattgtgttggccttcgggatcggagaagctgcgacggcgggggcttgtgcagacccgcaaaactatgtcagctgggacgggatacatgccactgaagctgcaaatagtaggatagcgtatgctgtgatcagcggctcctattcgtacccacctttcgatctttcaaagctatgtagcccttaggcatcatcagtcgtgaaagggagtacagcatcaccatacaccgcatttctctgaaacaagcagccacatttctttc

SEQ ID NO: 73982 - DNA, 378 bp, Zea mays
  Clone ID: LIB3079-038-Q1-K1-G12
ccctcctagacgacagtttgaaacaactacagcggaggtactgaagaaggctgattttaggaatgttagattcctctgcaactttcttacggaagctggaattatcatcaagagaagccagacccgtataagtgcaaaagctcagcgtaagattgcaagagagatcaaaaccgcacgtgcgtttgggttaatgccttttacaacaatgggtagaagaccattcatttttggcagaagtgcggaggagcattattgggatgatggatatttcggctatgtgaagcagaaggatggtgagcctgttgagaatgaggatgctgagccaaatgtggaggctgtgtaaacattctgaagcatccttttgcaagcgcttcgttc

SEQ ID NO: 73983 - DNA, 358 bp, Zea mays
  Clone ID: LIB3079-038-Q1-K1-G2
ctctgcaaacgatttccactttttactcacgccgtcagctgatccttttcgccgtagtatccccgagcaaaagagaaaacccttttttttgtgcgctgtgctgtttcgccatatctgttcgtcccaccgaggcaccgactcaatccccattcttggcctctggcttcacaaaacaagaccggttcccgttccctagatctctgcgtagaggcggcgaggcacccgaatccggcaaaaaagggttcgcggtttgccttggttgggaggagcgcaggagcccggcgtcaaaacccaatcttggcgcccgggctgccgtgcgccatcgtcttctcccccctgtggtgtttagggagaggag

SEQ ID NO: 73984 - DNA, 197 bp, Zea mays
  Clone ID: LIB3079-038-Q1-K1-G3
gaagccgccgccgcttcaatgtccatattcaccgcaagagactgagatggggggttggggcattatccacaagaccaaggcctacttcaagcgttttcaagtgaagttcaagataaagcgcccctgccatacaaacttcaaggcccggattaagcttatttacccagaccaaaaccagttccatacaaccatattca

SEQ ID NO: 73985 - DNA, 372 bp, Zea mays
  unsure at all n locations
  Clone ID: LIB3079-038-Q1-K1-G4
cgaccattcgtgtacccgtgatactgggagttcaagacctccgctcatgtccgccgcagcggcgctctcagcccggccgcgaccgccaactcctgccgccatcatccattcactcttcgtctccctatccgacccgtccgcaatccgcctcctgcccgccccgctcctcgtcttctcccaactccgccgcctgctgccgcccgacgccgccacccaactcctcctgcacccaatcgcctcgctcctccacctgcaccgctccgacatgcgcataggcctccagcttcacgggctctccctgtccgccggcctctcctgctactcgcacctactgccccacctnctctccttctactcccaccacccgtcgct

SEQ ID NO: 73986 - DNA, 352 bp, Zea mays
  Clone ID: LIB3079-038-Q1-K1-G5
gaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacaaggccaggataagggttgttaaccaagacaaaaacaagtacaatacacccaaatacaaatttgttgtgcgatttaaccacaaggacatcacagcacaaatcatctctgctagtatagcaggtgatatggttcttgcttctgcttactcgcatgagttgccacgatatggtcttgaagttggtctgaccaactatgcagctgcctactgcact

SEQ ID NO: 73987 - DNA, 375 bp, Zea mays
  Clone ID: LIB3079-038-Q1-K1-G6
cccacgcgtaacggagacgcgatgggtgcgttcttccgctggcgggtgctattagtcgctgtgtacctacccgtgacacatatccctttttttggagcgctggactactcaggcaaatctggcatcgcgacctttggcagctgacttagtcccgattgttgggctgtaggaaacaaaacagaaccggttcgaggtccctagatctctgcgtagaggcggcgaggcacccgaatccggcaaaaaagggttcgcggtttgccttggttgggaggagcgcaggagcccggcgtcaaaacccaatcttggcgcccgggctgccgtgcgccatcgtcttctcccccctgtggtgtttagggagaggagaaggccggtgga

SEQ ID NO: 73988 - DNA, 355 bp, Zea mays
  Clone ID: LIB3079-038-Q1-K1-G7
cgtcaaatctacgacattcccagcaatgactatgctagtaattatacagaggaaacatgaatacaacttccagaaataggcaccagcaatactattgttcaaggtcatgttgatgtcaatgaacaccgatttgatggaccaagaacaatcgaagaaatcgttcctgttccattggatgagatacagatccatgatgatgtcccagggcaaccgggagcagccgatgagatagatgaggttccattttctgacgctccgatcattggtgctccattcagactgatctcatttgttgctaggtatgtcagcggcgctgatttggtcaaccaaaaataactgtctgcataccaggaat

SEQ ID NO: 73989 - DNA, 373 bp, Zea mays
  Clone ID: LIB3079-038-Q1-K1-G8
cgaccattcgtgtacccgtgatactgttagttcaagacctccgctcatgtccgccggagcggcgctctcagcccggccgcgaccgccaactcctgccgccatcatccattcactcttcgtctccctatccgacccgtccgcaatccgcctcctgcccgccccgctcctcgtcttctcccaactccgccgcctcctgccgcccgacgccgccacccaactcctcctccacccaatcgcctcgctcctccacctccaccgctccgacatccgcataggcctccagcttcacgggctctccctgtccgccggcctctcctgctactcgcacctcctgccccacctcctctccttctactcccaccacccgtcgctc

SEQ ID NO: 73990 - DNA, 442 bp, Zea mays
  Clone ID: LIB3079-038-Q1-K1-G9
ggagcgcaaccgcttcctggtgctgcggctgtacgaggcgctcaacgcccgcgacgcgcgccgggcgcaggagctgctggcgccggacctcgagtggtggttccatggccctcccgcgcgccagcacatgatgcgcctgctcaccggcgctctggaccaccgcggcttcgtcttctccccgcgctccgtcgacgccttcggctccaccgtcgtcgccgagggcgccgacgacgcgcgccagctctactgggtgcacgcctggaccgtggggccccatggtgtgatcacgcagctcagggagtacttcaacaccgacctcacgctcctctccggccagcctgacgtcggtgccgcatgcgctgcttcggctaagcagaaagacgctggccttctctcgtcgcccttcgtggcgggaccggcagcagggcccaagtgcctgtgg

SEQ ID NO: 73991 - DNA, 324 bp, Zea mays
  unsure at all n locations
  Clone ID: LIB3079-038-Q1-K1-H1
tgtgcttctaccggtagagtgaagaccataatgacaacataccgttggatagcagagaagtcaatcccatttttgaagaaggatccaaatatgggcgcaaaaaagttacaagaggagctagaggataaatataatgtgaagctaggatactcaacagtgtgggctggtagacagaaagcggtggaacaaatatttggaacatgggaagaaagttttgcagatttgtataggttcaaggcagagattgacgcaaaaatgcctggaagtgttgtcgatttagaggtgcangaggaagaggatggtgtgtattttcgcagattcttt

SEQ ID NO: 73992 - DNA, 369 bp, Zea mays
  Clone ID: LIB3079-038-Q1-K1-H10
cccacgcgtccgctcagaggtgggttggcttctcctcccccaccggttcgtgtggaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccattcccgccgcggccgtggaggcggcggtgg

SEQ ID NO: 73993 - DNA, 315 bp, Zea mays
  Clone ID: LIB3079-038-Q1-K1-H11
gcatttgcagccagtcgtcagccggcgatctttcaatcggactatgcagacgatgcaagtcctgctccgacaccggaccgacctcatgcggcaccgataccgccaggtgacagtcgtatctggatgaacagccatgacggcggaacgagtacgctgccccgagatgcagcgaccccctctgcgtcaagatgaaatgaatcaacgatacctcagacttggatcccctggtggcctgtctgggagatcttagttttaggcacataacgggtgtaaatcactggctaaataatgacaataatatttccagagttaaaa

SEQ ID NO: 73994 - DNA, 175 bp, Zea mays
  Clone ID: LIB3079-038-Q1-K1-H12
ctttcaatcggactatgcatacgatggaagttctgcttcgacaccgcggcgaccttatgcggcaccgataccgtcaggtgacagtcgtatctggatgaacagccatgactgcggaacgagtactctgtctcgaaatgcagcgaccccctctgcgtcaagatgaaatgaatcaact

SEQ ID NO: 73995 - DNA, 370 bp, Zea mays
  Clone ID: LIB3079-038-Q1-K1-H2
tgtgcttctaccggtagagtgaagactttaatgacaacataccgttggatagcagagaagtcaatcccatttttgaagaaggatccaaatatgggcgcaaaaaagttacaagaggagctagaggataaatataatgtgaagctaggatactcaacagtgtgggctggtagacagaaggcggtggaacaaatatttggaacatgggaagaaagttttgcagatttgtataggttcaaggcagagattgacgcaaaaatgcctggaagtgttgtcgatttagaggtgcaggaggaagaggatggtgtgtattttcgcagattcttttgttgtttcaaaccaaacattgatggttttctgaacggatgcagac

SEQ ID NO: 73996 - DNA, 357 bp, Zea mays
  Clone ID: LIB3079-038-Q1-K1-H3
tcacagtcatacttgaacagctaccttcttcttgaggagcttgccctggccatcgcggacatcactcaaacttttcaaggatggcacggttgtctgcaaaacatcctctctccattatctaaaaaatacttctattacatcaatgccccattcgtctttagcgcgcgcaacactgagtgcactgtcccgttcatgagacacgatgccagcattgtctacgaacgtgtgtaggcccaagcccctgatggtcgcctatctgatcttcaaggtgaccaagatcaagcttacaggaaaatcaagctccgtgcttaagatgtgcaaggcaggaatgtgctcacaaacttcttgggcatgaat

SEQ ID NO: 73997 - DNA, 439 bp, Zea mays
  Clone ID: LIB3079-038-Q1-K1-F9
tttgattttagtggaaatggagaaagtgaaggtgaatgccagtacggcaactacgggaaggaggctgctgacttgcactctgttgtcttgtatcttcgccaggagaagtacgacgtagcagcaattgttggtcacagcaaaggtggagatgtggtcgttctatatgcctctatctacaaggatgtccccatggtggttaacctctctggccggtttcatttggagaaaggcattgaggagcgcctaggcaaagagtttatggatagaataaacaaggaaggctacatcgatgccaaagacaaatcacgaaatgttttgtacaaagtaaccaacgagagcttgatggaacggcttgaccatgatttgcacgcaacgagcctttccatcagcaaagagtgcaggttctatacaattcacggttcagctgacgagatcatac

SEQ ID NO: 73998 - DNA, 244 bp, Zea mays
  Clone ID: LIB3079-038-Q1-K1-H4
cccacacgttcggctaaaggctataggtttcttcaaaggtccaatacaaattcctggactatagactgaagtatggcaggagatcttccaagatctctccagttcaaaggatgggattacgggagcttagaccacagctgcctaagccattccagagtacacaaaggcttacactgatcctataaaatatggcatattctatcccaccacattcaccaaaccttgtatgaaaaggctccacttt

SEQ ID NO: 73999 - DNA, 239 bp, Zea mays
  Clone ID: LIB3079-038-Q1-K1-H5
atttgaacgtgatttctgtcagctaatgttttattacatggatacatgtggcataatggcgccctcaccagaggagtacgcgattttgggactcaatcttctgaggctgttggctcagaatagaattgctgagttccatactgagctggatcttttacctgtcaaggcacctgtgctccactgcatcaagcatgctttatagcttgagcaatccttcatggtgggtgcctacaaccaat

SEQ ID NO: 74000 - DNA, 237 bp, Zea mays
  Clone ID: LIB3079-059-Q1-K1-C8
ctcagaactctcgtgctcacctcatccgttcgacatatccacacgaatcctctgattcatgtcagggtgttggcattgatcagacgcctgccatggcggatcagttcgtggattcggcgaacaatgtgatcattgaggaggtgaacaagggcctgaacccaggaatggtggttctgcttgtggttgcaagcttcctgctgctcttctttgtggggaactatgcgatgtatgtgtatg

SEQ ID NO: 74001 - DNA, 396 bp, Zea mays
  unsure at all n locations
  Clone ID: LIB3079-059-Q1-K1-C9
cccactcgtccgtcgatgtgttataatattggattgctactcttacccacttggatgggagcacaagattcaaaatcagcatcatcaagggaacagcgcaaagcagttctcaacatacaaagataatattactgattatagaagtgtgaatgatgttacaaaattgatgtcctccactactgaacttggatgaagttttgaagagagaatgcaaaacatattattctagggctgttgactcaattagctccatgttaaggcatgcttcagtgtcatcaatttcaagccttcttagtaaccttcgaagccatgaacaagtatcatcaatcttttggatgatacattcagacctncatgagcccaatgtaccccgagcatttgaatgtctntctacta

SEQ ID NO: 74002 - DNA, 259 bp, Zea mays
  Clone ID: LIB3079-059-Q1-K1-D1
cgagtacaccgtcgtggacgtgaaccaggtggtcaaggtcgaccccgccgtgccggccaagctcgcctgcctcctcagctgcggcgccggcaccggggtaggagcagcgtggaggtctgccaaggtggagccaggatccactgttgcaatctttggcctcggatctgtcggtttggcggtggtccaaggcgcgaaaatgtgtggcgcatccaagatcatcggcgttgatctcaaccctgacaaggaggaagtagggaga

SEQ ID NO: 74003 - DNA, 140 bp, Zea mays
  Clone ID: LIB3079-059-Q1-K1-D10
ttcagattatggtctgtccaagactggcccatctatggaccatactcatgtgagcgcgggtgtcaaaagcaggtatgggtaccttgatccctaattcttccgcatgcaggagctttcagtgaaatccgatgtctactcat

SEQ ID NO: 74004 - DNA, 170 bp, Zea mays
  Clone ID: LIB3079-059-Q1-K1-D12
cccacgcttccggtttggctggggcggcacatctgttaaaagataacgcaagtgtgctgagatgaactcaacgagaacagaaatctcgtgtgggacaaataggtaaatgctcgtgtgattctgatttccaggtcgaatacgagccgtgaaatcgtggactatcgttcctt

SEQ ID NO: 74005 - DNA, 240 bp, Zea mays
  unsure at all n locations
  Clone ID: LIB3079-059-Q1-K1-D2
cccacgcgtccggccggcgctccggaagcccgtcttcaccaaggtcgaccagctgaggccgggcactaacgggcacaccctcaccgtcaaggtcgtcagcgccacccccgtgccgggccgcgcgcgcccgggcgcacccgacgtcgcctcgtcccgcgcgccgcgcatcgncgagtgcctcgtccgagacgagaccggcgtcatcgtattcaccgaccgcaacgacccaagtgatttgct

SEQ ID NO: 74006 - DNA, 225 bp, Zea mays
  Clone ID: LIB3079-059-Q1-K1-D4
aacaaaaaacaaaacataaaaaaaatacacataacaaaaaaaaaatcaaatacaacacgcaaggtaaaataacaaaaacaaacacaaaaccataaaatctacataataacacttcaattcctaaaaaccaattcctactacacctactgcaccctcgtccatcccctttcttatcgcgaactccctcgacatagccaacaccagatccattgtctctattaacca

SEQ ID NO: 74007 - DNA, 169 bp, Zea mays
  Clone ID: LIB3079-059-Q1-K1-D6
cccacgcgtccgcccacgcgttcaggcttgttttgtttctccaaaaaaaaaaaaaaaaaaagaaaaggaaaaaaaaaaaaaaaaaaaaaaaaaaaaaaaaaaaaaaaaaaaaaaaaaaaaaaaaaaaaaaaaacaataaaaaaaaaaaacaaaaacttaaaaacaaaaa

SEQ ID NO: 74008 - DNA, 89 bp, Zea mays
  Clone ID: LIB3079-059-Q1-K1-D7
ctgattatgatagaattataaaaaatattgaaaggggggaagcaagaatatcccgcaagggtgagattatgaaggctattgggaagaag

SEQ ID NO: 74009 - DNA, 263 bp, Zea mays
  Clone ID: LIB3079-059-Q1-K1-D8
aaagaacaacataggttagaagttgaaaaattcaatatggccaaaataaagaggaagttctataatgaggaatgtgaccgctttatgctttgcatggtgcacaaacttggatatgggaactgggatgaactgaaagctgcctttccgtatgtctcccttattccgatttgattggtttggtaaatccaggactaacccagagttggctaagcggggtgatactcttatcagactggttgtaaagggaaatcaagaatatgatg

SEQ ID NO: 74010 - DNA, 136 bp, Zea mays
  unsure at all n locations
  Clone ID: LIB3079-059-Q1-K1-E1
tcgcccacgcgtncgtccacgcgtccggttggcttctcctccccctccggttcgggtgggggtgcgtgaggttctccggggttcgggttcgtgggtgagcggatcgagatggcggcgtccgatgttgagtaccgct

SEQ ID NO: 74011 - DNA, 420 bp, Zea mays
  Clone ID: LIB3079-059-Q1-K1-E11
cccacgcgtccgcaatggccaacagaactgtgattgtagacaataacacctggaacaagactcatatatcaacagttggtacagcaatgtcgtccccagaaaaagcagcttgggaaatcttcaattctttagatgtcaaatatgtgcttgttgtctttggaggacttgttggataccctatcgatgatatcaataagttcctttggatggtacgaataggaggtggtgtgttccctcacattaaggagccagattatcttatggatggtcaatatcgcgttgatgctcaagccactccaactatgctgaattgcctcatgtacaaactttgttactacaggtttgtggaaactgatggaaaaggctttgacagattaagaggatatgaaataggaaagaagcatttcaagctaacacatt

SEQ ID NO: 74012 - DNA, 81 bp, Zea mays
  Clone ID: LIB3079-059-Q1-K1-E2
cccacgcgtccgaaaaaaaataaataaaactaaaaaaacaaaacaaaataaaaaggagagggcgacacctactacgggacc

SEQ ID NO: 74013 - DNA, 413 bp, Zea mays
  unsure at all n locations
  Clone ID: LIB3079-059-Q1-K1-E4
cccacgcgtccgccgagatcgccggcgtggttgtctccttcgaccccaatccaatgccgggggactggaatggcgctggtgcacacaccaactacagcaccaagtcgatgaggagcgacggcgggtacgaggtgatcaagaaggcgatcggcaagctgggcctccggcaccgggagcacatcgccgcgtacggggacggcaacgagcgccgtctcaccggccgncacgagaccgtcgacatcaacaccttcgtctggggcgtcgcgaaccgcggggcgtcagtgcgggtgggccgcgacaccgagaaggaatgcaaaagctacttcgaggaccggaagccggcgtncaacatggacccgtacgtggtgacctcgctgatcgcggagacaaccatgctgtgggagcccagccac

SEQ ID NO: 74014 - DNA, 251 bp, Zea mays
  unsure at all n locations
  Clone ID: LIB3079-059-Q1-K1-E5
gagagccgaggagggaaacgaagaagcggccatggcgatgaagcggccggcgcgcagcgagccacagctgccacccgatgaggcggcacgtgtggaggccgaggttcggagctacttcgacagcgtcncgccaaggcgcccggccaagccgccgtgcatcgacccgtcggtggacaccttcgcggaacccgccgccgtcaacgccggggaccacaacttgccggagctccgcaagctgcgcgacctctagg

SEQ ID NO: 74015 - DNA, 217 bp, Zea mays
  Clone ID: LIB3079-059-Q1-K1-E6
cgcgtccggacagttccctaaccttcaatgcatcctccatggagccaaaccggtttgtggagaatttgcgaggtccagaaagtgacccctgaggtgattgctgagtacaccgttcgtacccttcagaggaccgtgcctgctgctgtgcctgctgttgtcttcctctctggtggacacagcgaggatgaggccacccgcaacctcaatgccatgaaca

SEQ ID NO: 74016 - DNA, 328 bp, Zea mays
  unsure at all n locations
  Clone ID: LIB3079-059-Q1-K1-E7
ttgcgcagtttcacagacagcatccattccacagtcaccagagcactagagcagagcaacaacgcgacaagagcagagtgagatcgtcgtcagcgagcccagcagatacgagagagaggatggcggacatcgcgttgctggtggcggagcagttcgagaagacggcaaggcgaggcgcccccggcggggacagcggcagcagcagcgggagcggcggcgagacaaggaacttcggggccgtggccaaggtgtggagctcgtgggtggagtccgccttcgncgccgcgtccggggtcagattcaccgtcgcggtgcagctgggagccca

SEQ ID NO: 74017 - DNA, 410 bp, Zea mays
  Clone ID: LIB3079-059-Q1-K1-C7
ggtgaagcagcctgtgcatctgttcatggtgcgaataggctaggcgcaaattcgcttctgggcatagttgtttttggcagagcttgtgcaaacagggtagcagatatttctaaaccaggtgagaagcagaaacctctggaaaaagatgctggagaaaagaccatagcctggttggacaagctgaggaatgcgaatgggtcattgccaacttccaagatccgtctcaacatgcagcgtgttatgcaaaataatgctgctgtattccgtacacaagaaacacttgaagaaagtgtgagctgatttagcaaacattggaaagtttcatgatgtgaagctcagtgaccagagtctcatttggactctgacctgatagagacccttgagctggaaaatcttttgataaatgcatg

SEQ ID NO: 74018 - DNA, 410 bp, Zea mays
  Clone ID: LIB3079-059-Q1-K1-E9
gtttgggatctggtatttctctgttcattgctaccaatatctgtgagaatatcatgtggaaagcatttagccccacaaccatcaacagtggtcgtggcgctgaattcgaaggggctgtcattgcactgatccatctgtcgattacgagaaccgataaagtccgtgctcttcgagaggctttctaccgccagaaccttccaaatgtgaccaatttgcttgccactgtcttggtattcctcatagttatctatttccaatgcttccgagttgagcttccagtgagatcaaagaatgctcgtggccagcaaggctcatatccaattaagctgttctacacttcaaacatgcccatcatccttcactctgcgctgattaccaacctctattttatatcccagcttctctacaag

SEQ ID NO: 74019 - DNA, 54 bp, Zea mays
  Clone ID: LIB3079-059-Q1-K1-F1
cccacgcgtccggcaggagcaggaggggttcgtcatcgcgtggtggccgcgccg

SEQ ID NO: 74020 - DNA, 137 bp, Zea mays
  Clone ID: LIB3079-059-Q1-K1-F4
gttggagcaaatgttgtttagcttttgtgaggaaagaggcggctgcggccgctgggattgggtagcatgagaagatccccttctgcactcatcgaacggccgtcgtcacctagatcaattgggagggttaagtggct

SEQ ID NO: 74021 - DNA, 317 bp, Zea mays
  Clone ID: LIB3079-059-Q1-K1-F5
ggcggacgcgtacgggtgacgtgcccgctgtgccgctcccacctgctgccgcgccggcgcgccggcctgcttgagatgggacggcttggcgacggctagtatagtcgcccgtccgtccgtacctggttgtttccttgccacgtgacgtgcgtgcccgtgcccgtgtgctgggctttcaggcgcgcggcactggtgccggatgggggcggaccaaccgtgaactgatcgcgattaggacgatggactaaccaccaacctgatgtcattaatgaatgcgcgcatagtaaatgaacctgcatagatgatgcttaactact

SEQ ID NO: 74022 - DNA, 160 bp, Zea mays
  Clone ID: LIB3079-059-Q1-K1-F6
ataccctatatctctatagccaacacacacacagatactctccattccattccatctcaggggatgggaataatggccggtctctccaccaagcttttcgtggtcctcctcctgctcgtttgttacaccggaacgcaaggcggtccggtgactatggtgt

SEQ ID NO: 74023 - DNA, 280 bp, Zea mays
  Clone ID: LIB3079-059-Q1-K1-F8
acgatctcgtctatgtcaaaatacctgtaggaaagcgctgcagatatgtccaatattctaacggggcaggagatcaggaggccatacaggtgctaaatggaagccagttgggaggtcatagcataaggctctcatggagccgtatccctgcaaacaagcagcctcagcaagagcagagccaatggagcggtggtggatattatgggtatccccaaggatactatccatatggctatgctcgaggcccctaagatcctgacatgtacgcctacacagcata

SEQ ID NO: 74024 - DNA, 181 bp, Zea mays
  Clone ID: LIB3079-059-Q1-K1-G1
tgcttcctgtgctgttactttcgtttcgacaaattgattatgctgtagcccttcgggtgaggtctagacatttcggtgtcttgaagcacattcttttttctgatgttggtaatgatttctgtaggctagtagtagccaatattatgtttggattatatccccctctaaaaaaaataatata

SEQ ID NO: 74025 - DNA, 395 bp, Zea mays
  Clone ID: LIB3079-059-Q1-K1-A7
ggcccacgcgtacggcgcggcgtgtggggggctggtctactaccactgcgcggtacggcgagccagcgcggtgtgccttgcagcagacgtgctcctcgtcctcctctgctcgctctccatcctcggcctcctcttccgccacctccacatctcggtgcctgtggatcctcttgaatggcagatctctcaggagatggcaaatagcatagttgcatctttagccaatacagtaggagctgctgagtctgtattaagggtggctgcaactggacatgacaagaagctgtttttcaaggtggtttctacattgtattttctagcagctttgggaagggtggtgtcaagcgctgcccgtgcgtatgctgccctatgcatcttctgcctctacatgtttg

SEQ ID NO: 74026 - DNA, 242 bp, Zea mays
  Clone ID: LIB3079-059-Q1-K1-A8
gcctgtactaactaacctagttgaccacgcttgtacattacacatggctcaaggacgcagcgtgattcaagcgtatcaacctgacattatccatcaacgatactgttcgtacgtttgacgaagctctacatcctgaatcccacttcatgccatgatgcatagggacgcaacttgatcgctatctaccactgcatgttcagcagcttgatgtcccttgccaaacagacaccaaagatgatgac

SEQ ID NO: 74027 - DNA, 438 bp, Zea mays
  Clone ID: LIB3079-059-Q1-K1-B1
gccgtttctgcaaggaggttgtcttgactgatcacaatgatgaagttctggagatgataaagaaaaatatagagttgcagtcatgttctgagaatgcacatgcagtgttgacagccgagaaactagagtggggaaactcagatcatttaagcggtattattgaaaaacatcctggtggatttgatcttgttcttggagctgatatttgcttccagcaatctagcatttcctgcctctttgatactgtagagaggattgttcgtattcaagctggtaaatgcagattcatattggcttatgtatcccgaactaaagtcatggatgcactagtactcaaggaagctgaaaagcatggaatgcgtgttgaagaaatgaacggaacaagaacaaccatctcgaatcttgaaggagtcatatttgacattaccctgaaatgac

SEQ ID NO: 74028 - DNA, 207 bp, Zea mays
  Clone ID: LIB3079-059-Q1-K1-B10
cgcagcagcagccatggttttgctcttgttgacgttgggcgctgaggcccagatctgggagctcgcggagcaagacctttaaggggtggtgctaccacagcaccaactgcatctccgtttgcatcaccgagggggagattagcggggtctggcagcatgggatttgcatgtgcacctatgagtgtctcacgggtaacgatacttgcc

SEQ ID NO: 74029 - DNA, 419 bp, Zea mays
  Clone ID: LIB3079-059-Q1-K1-B11
gagaaactagcatttgttgatgtttgaagtatatttatgtggatttgtgacttccttgatctcctctttcaaacaattggttcattattattattggtatggtggtgttatcgccccatttgcattaagctgctcactaagtcaaagtagtaaaaagccatggctgttgctacctagaagatgttgtgtatattcaaatcatagagcttgtgttttgggctggagatagcacaaaataactactaaaactatctattatcaagtgatccatttgcaattttttcaatctgacactcacagactcactgggtatatttcaaagctgggaagaagctaacgatataccatacttagactcactggttaaggttatgagtgcattggtttgtaaaaaaaatatttcatggtcaccacagtat

SEQ ID NO: 74030 - DNA, 207 bp, Zea mays
  Clone ID: LIB3079-059-Q1-K1-B12
ccctctcgtacctgagaagatactcttcgcggacaagcaatactggaccgctgcagaggctagcatctaacattattcgtattttatttttttctccagtcactggggctagatctacaaggcgattatatattatagatctaatctggctataatttacgtataaatccataaccaactagatcttcattctgtatttatgaggaa

SEQ ID NO: 74031 - DNA, 349 bp, Zea mays
  Clone ID: LIB3079-059-Q1-K1-B2
ggccgtccttacttatcttttcgaaagctcttaaaggttgaagagttatggagcgcgctggttaatgccaagggatgaactggcaatagacatatgggatgctgttgaggcacttgactatgtgctagagcctggatgcgactaggtgccataacgcatagggaaacaactggacgggtatataacactgcgtgtacaacaacttgatgtccgctgcgaaacaaagacaaaggataatggcttcgtaaatgatgtggcatctgtgcaatatcgtgcccttgccgataaggcatctgatgcttttacaagcttagtgacaccatggagcaaactcagtcatatggttttg

SEQ ID NO: 74032 - DNA, 395 bp, Zea mays
  Clone ID: LIB3079-059-Q1-K1-B3
gttggccttcttcagttctcccgctgctgctgccgctgccaccctccgtccgcgggcagatgccgccaccccaatcgatctgccggcctacagcatggcggcgggggcggcggcgagggcgaaggcagcgggagccctggcgctggcgctcgagctcgcgctagcaggggccaactccgatggcgacgcgctctcggcgctgcgccgcaacctcaaggaccccggcggcgtgctgcagagctgggaccccacgctcgtcaacccctgcacctggttccacgtcacctgcgaccgcgacaaccgcgtcacccggctagatcttggtatttgaacttatctggtcatcttgtgcctgagcttgggaaattggagcctctgcagtaccctggacttta

SEQ ID NO: 74033 - DNA, 333 bp, Zea mays
  Clone ID: LIB3079-059-Q1-K1-B5
cggacgcgtgggggcgtgtacaccaagaataagccggccaaccaaccgactcccccgaccgtgctgatcgatcgagggccccttgttctagccagttgtccccttccctctcgccggcgttgctcctgcctgctccaatggccgccgccttcacgaagacggcgaacatccccgcgacgatgcgggccgtgcagtacgactcctgcggcgggggcgccgctggactcaagcatgtggaagttccggtcccttcggcgaaaaagaacgagcttctgctgaagctggaggcagcaagcatcaacccagtggactgggaggtgcagaaaggcatgc

SEQ ID NO: 74034 - DNA, 107 bp, Zea mays
  Clone ID: LIB3079-059-Q1-K1-B6
ctcttatattattctttattacttttttaattattctatcgtctagttatatccaaattaattactcaaactaattaaccccttccttcttaatcattttcctcttt

SEQ ID NO: 74035 - DNA, 251 bp, Zea mays
  Clone ID: LIB3079-059-Q1-K1-B7
gttttcgaaatattctttttagaggggggaggcatggtgcagtaaaatgaaatagagagagattggagcaattctttgttatcttagcaacaccttttcttcttccgagagcactatgtacaaggtgacattataaaagattaagatagtgaaggccttattttcgcgaggctaatgtacattcatcttgcaagtgttgcaacttttttgaagtttgtttaagtaaaaaaagacatgaagtttgtttcgac

SEQ ID NO: 74036 - DNA, 294 bp, Zea mays
  Clone ID: LIB3079-059-Q1-K1-B8
tgcgaacctaacctgtgctccagtatgaactatggcacagtgcctggaagacactccatggcagaagagcggcagagttatttgaaaagattaggttaccctgaattgcactcttcaaatttctgtgaccttgatttgttgtcatcttcaggaaattcgtttgacgaggaagtttttgagaggtcattactgatcaattcacctatggatgtgatcagtcctgaatcatctatgtcatacagtgaacaacgacacactgatgagggaagagatgacacggatctttcccgtcta

SEQ ID NO: 74037 - DNA, 416 bp, Zea mays
  Clone ID: LIB3079-059-Q1-K1-B9
ggagatcgttcggcgtcacagacttcgtcaatccatcgcagctggacatgcgttgtagcgtagatttgatcgttgagatgaccggcggcggcgtggactacagcttcgagtgcatctgcgtgccgtcggtgatgaccgacgccttcagatgcaccaagatggggaagggcaagacgatcgtgctggtgctggagatggacagcgacgaggtgtgcctgccgtcgctggagctgctgctcgggaggtgcgtcatggggtcgctcttctgcggtctgaatcccaagacccacatacccgtcctcgccaagaaatgcatggtcaaagagctgcagctggactcgctggtcacgcatgagcttggactgcatgacatcaacatggccttcgacctgcttctgcaatggaaaagtctgcac

SEQ ID NO: 74038 - DNA, 270 bp, Zea mays
  Clone ID: LIB3079-059-Q1-K1-C1
aacaaaaacaataacaattaaaagctatcaatctaatactctaaagataaaaaaaggggcaaggggcaaaacatacctgcagactatcaataaaaaggcttgaagagtggaggctgatgcaaagggacatggatgagtggatgagacaccatcaactcccatctcatcttcaagaacgtgtgccgcggttcgttcaagtcaaatggcttgctacaagaggagtagaagaagaatccatcttgcaagctttgcctgctgatattcgtcagg

SEQ ID NO: 74039 - DNA, 163 bp, Zea mays
  Clone ID: LIB3079-059-Q1-K1-C10
gcaacacctgcagcaagtgaccgtggcacgggcagttgcagcagcagcagctgctggggggaacttggatctgaacccattcttagagtatggataccaaatgcttcttcactggcggccccttcgcaacgctagacatgaattgcttgcttcccggcagctt

SEQ ID NO: 74040 - DNA, 271 bp, Zea mays
  Clone ID: LIB3079-059-Q1-K1-C11
attcccatttctacccactcttccttagacactaatgttttccctaaaaaaatttaaaaaaaaaaaaaaaaaaaaaaaaaaaaagaaaaaattaaaaaaataaaaaataaaaataaaaaaaaaaaaaaaaaaaaaaataaaaaaaaaaatcaaaataaaaaaaaaacaaaaaaagacctcccattttaaaaaatccatattattttccccttccttccaacacttaacccttcatttaatctcccctaatttaatttactttccctatttt

SEQ ID NO: 74041 - DNA, 209 bp, Zea mays
  Clone ID: LIB3079-059-Q1-K1-C12
atccaggcccaggagcgcgagttctgtgcctgtgcctctgctccacctcccctgggggggcgccccaagaccacgtgcaccacttagcactcacgctgctcgctcgctcgctcgtacacgcgcccggttagagcagggaaggaaccgtgggagggatacggtcggacatgatgcacgccaagtcggagtcggacgtgacgatgcctggc

SEQ ID NO: 74042 - DNA, 211 bp, Zea mays
  Clone ID: LIB3079-059-Q1-K1-C2
gattttcctacatcaactccatcgtgtatccttggacatctattcccctcttggcggactagacattgcctgccatctgtttattgacagggaaatttatcactccagagctgaataatggtgccagcctgtggttcatgtcactttttatctgcatttttggttccaagcatcctagaaatgagatggagtggtgttggaattgatgact

SEQ ID NO: 74043 - DNA, 301 bp, Zea mays
  unsure at all n locations
  Clone ID: LIB3079-059-Q1-K1-A6
gcgccaagtactacgaggcaggtgcccgctttgccaagtggcgcgctgttctcaagattggccctagtgagccatcacagcttgccatcgacctgaacgctcagggtctggctcgctatgccatcatctgccaggagaatggtctggtgccaattgttgagcctgagatccttgttgatggccctcatgacattgatcgctgcgcttacgtcactgagaccgtccttgctgcctgctacaaggcgctcaacgagcaccatgtcctcctggagggtaccctnctgaagcccaacatggtgac

SEQ ID NO: 74044 - DNA, 137 bp, Zea mays
  Clone ID: LIB3079-059-Q1-K1-C4
cccacgcgtacggttttgtaacgtttgatatagttactgtccagctacatttgttagaggcgcatgttgacgtgggccatattagttgtggctacatattctactaagaagttctcaggactaatcatactttctct

SEQ ID NO: 74045 - DNA, 319 bp, Zea mays
  Clone ID: LIB3079-059-Q1-K1-C5
ccttcacaaaaaataaaataaaataaatgaataaacgcaacggatggaaggatatcttcaggtgatgtaacgggaggagatgtagggagagagagaaaccaccagaggcgagcgagcaggtgtgggcgtggcgtgggggaggcgccgaggcggtcgggcccgtagataagagtcgtctcacctcgtcgtcgcagactcgcatcgcacgagaggagaacgagaggggaagggctatagagagaaacaaaggtggtcgtagatgtgagccaccctctttgtatccctcgtcaacttcttctaccaacttctttttccttcc

SEQ ID NO: 74046 - DNA, 321 bp, Zea mays
  Clone ID: LIB3079-059-Q1-K1-C6
tgcatttgcgatagcaattggtgctatcagtctcatactctttgctcagttgattggcagagtgcggacatacctgcagtctatcagtaaaaggcttgaagagtggaggctgaggcaaagggacatggatgagtggatgagacaccatcaactcccatctcatcttcaagaacgtgtgcggcggttcgttcaagtcaaatggcttgctacaagaggagtagaagaagaattcattttggcaagctttgcctgctgaaattcgtcgggatgtgcagcgtcatctttgtttggacctcgttagacgtgtaccttttttctctg

SEQ ID NO: 74047 - DNA, 266 bp, Zea mays
  unsure at all n locations
  Clone ID: LIB3079-058-Q1-K1-F3
cgtgtccggacgggaataccnccacaaggtgcttaagcagatgaactcgagctgcancctcagcgggaggtagactgtaaccacaagaagtttgccatgaaattcggtttggtcgcagcagtttaggtactcaacttttctctagtccaatccaagggagtttgttttattctcaggtgaatctttccgtttgtaccgtcaggttgtgttgttcttttgaacatttgggcaatgataactaataattcaaggtcctttacaagtna

SEQ ID NO: 74048 - DNA, 372 bp, Zea mays
  Clone ID: LIB3079-058-Q1-K1-F4
gaacaaggcaaatgtatccatagatctccttgtagcggagcttaatgcctttttttgccgtttctaatatgcattggatgagcccgtaacgcaccgtagtagtatctaaagctggtgttctgagttggttggaccttcctgcagttttgggttctccttctgatgtggcaaggtttagctggtcgcacctacctaatgtatgcttagcaaacgaagtcccactaagcgctgtacataactgcccctccctgcatcaactcttatatatcatctggttaatcgctaaaaacagaacaagataagcaggatctttctgaacgctatgattatatacaggaagccatccatgctatttcagaggcacacaaagat

SEQ ID NO: 74049 - DNA, 220 bp, Zea mays
  unsure at all n locations
  Clone ID: LIB3079-058-Q1-K1-F6
cctgggtggacccacgcgtgcgggtatttctgctgaatataatgaaaatgacctgtgcacattgctttcatatttcaggcggcgtcntcagacacctggactttttctattgctttggttgtcacaaaaaatgccaagtgtcatttaaggtcttgtgaaaagggggagaactattgattccatttatttaacttacggggttgagcttactgtacaggtt

SEQ ID NO: 74050 - DNA, 360 bp, Zea mays
  unsure at all n locations
  Clone ID: LIB3079-058-Q1-K1-F7
ggacaggatcctcaccaccaacctgtggtcttctgagctctccaacctctcttccggcgcggtcctggctcaaaagatgtgctctttnaaccccatcttccccctctgggaagccaccggcgcgaatgtgactgaggtggcttacgccgtgggcaaggacactaggattggccccaagttcctgaacgccagtgttgggttcggtgggtcttgcttccaaaaggacattctgaacctggtgtacatctgcgagtgcaatggcctgcccgaggtggccaactactggaagcaagtgatcaagatcaacgactaccagaagagccggttcgtgaaccgcgtcgtgtcctccatgttcaacac

SEQ ID NO: 74051 - DNA, 56 bp, Zea mays
  Clone ID: LIB3079-058-Q1-K1-F8
gaatgccctcatctttgatcttggaggtggttcctttgatgtctccctcctcacca

SEQ ID NO: 74052 - DNA, 52 bp, Zea mays
  unsure at all n locations
  Clone ID: LIB3079-058-Q1-K1-F9
aaaggnnnnnnnttaccaaactaactaattctttagaaaaaaaacaacaaaa

SEQ ID NO: 74053 - DNA, 187 bp, Zea mays
  Clone ID: LIB3079-058-Q1-K1-G3
gagcttggtgctctgcgtggcgagttgtcaaccatcatcatgaattcatgatactggatgtacatcatgatactgcggagacagacagcgagagatgaggctagctagatgctgtttcaccaaaatattatgtaacacccaaatctcccattttaagaaataaataagattttcgaaaggcaaatgg

SEQ ID NO: 74054 - DNA, 356 bp, Zea mays
  Clone ID: LIB3079-058-Q1-K1-G4
gtccagcgcatatgatgatcagttcaagcagctcatttcggctggaaaagacccggggagggcttactgggaacttgttataaaagatatccaaaaatcctgccaacttttttaggccatctaccattaaacttattgggcttattggtattttttcctaaaagggtcttcttaggtggccaaagacacttaaaggacttgttaaaccggaaaatgggtacacaaaatggtcaaaccccccaaaggctacataaaaaacccaacttcctgaaaaaggggttctttcattcaagaaagtattcgttattgccttaaccgtcaacgcaaccctaattttttcaattgcaaaaaataag

SEQ ID NO: 74055 - DNA, 224 bp, Zea mays
  unsure at all n locations
  Clone ID: LIB3079-058-Q1-K1-G5
gtgttatccacttagcactanctgcttgaattactcttccggagccctaaaantcgggggggggcgcccttaacaggggccaaaagaaatttaagggggccatttgcaaaaccacctcaaagtcttgccagggggcttcgggatttcttcacccctaccactttagttgaatcacacccccaaactacttcaatggagtcttcacagggcctacttagtttcca

SEQ ID NO: 74056 - DNA, 427 bp, Zea mays
  Clone ID: LIB3079-058-Q1-K1-G6
atcagggagtacaagtcatatcttaataaccttaagggagcgctgaaaagggttactgggggtaatgcacaacagggggcgagggaagatttgttggagtcacgaatggcacatacattgggggtttctgctgatcaaaggtcaagattgctcatggcaaccgagagacagaaccaaacaactgataggctcagagatagccatagaactatgctggagactgaagaacttggtgtctctatcctgcatgacctgagtcaacagcgccagtctctcttgcatgctcatgatgtattggacgaggtggataacaacgtcggcaagagcaggaggaccattggaggcatgatgaggagaatggatagaaacaagtggatcatcggtctcatcatagcagttcttgtcttggctatcctcgtgattctgt

SEQ ID NO: 74057 - DNA, 250 bp, Zea mays
  unsure at all n locations
  Clone ID: LIB3079-058-Q1-K1-G7
gccacccccttccaannactacacnnaccctcccccggcgccgctgatcaacgcggcggagctggggtcctggtcgctgtaccgcgccgtgatcgccgagttcatcgccacgctgctgttcctgtacatcacgggggccaccgtgatcgggtacaagcaccagactgacgcgtcggcgtcgggcgccgacgcggcgtgcggcagcgtgggcgtgctgggcatcgcctgggcctttcgcggcatgatcttc

SEQ ID NO: 74058 - DNA, 255 bp, Zea mays
  unsure at all n locations
  Clone ID: LIB3079-058-Q1-K1-H1
cgcgtccggaccaatatactatcttcttctagctctatctaggctcgtctgctgcaagaangtaacagggcgggcttggatgttaattatgaggacctccccctnngcgccaacaagttctcggagcgccagcccatcggcacggcggcgcagggcacggacgacaaggactacaaggagcccccgccggcgccgctcttcgagcccggngagctcaagtcctggtccttctaccgcgccggcatcgccgagttc

SEQ ID NO: 74059 - DNA, 159 bp, Zea mays
  Clone ID: LIB3079-058-Q1-K1-H10
ctgcgccctggcagcgtctgccgacgcgacacacttcaaggtgggcgggcacagtgggtggagcgtgcctggcgccggcttctagccctacaacacctgggcggggcgactccggtttcagatcggcgaccagctgctgtttgtgtaccccaaggagac

SEQ ID NO: 74060 - DNA, 190 bp, Zea mays
  Clone ID: LIB3079-058-Q1-K1-H11
actggaggggtgaaagggctcttagggggacttttttcccaggagcactggacctgctaaggctgttggcaaagagcttcctgtccttaacggaaagttgactggaatgtttttccgggtcccaaccgtcaatgtttctgttgttgatttaactgttacgcttgaaaagtcagcaacctatgatgagatc

SEQ ID NO: 74061 - DNA, 57 bp, Zea mays
  Clone ID: LIB3079-058-Q1-K1-H2
gagacagtgaagaattctaacaccatctcatacatctgtgagttagaccacacacaa

SEQ ID NO: 74062 - DNA, 366 bp, Zea mays
  unsure at all n locations
  Clone ID: LIB3079-058-Q1-K1-H7
gacctttttatctacctccaacacgatcttatcatctcgactgctgaaaaaacacaacagggcggtttggaggggagggtggaggaccttcttctgnnccccaacaagttctcggagcgccagcccatcagcacagcggcgcagggcacggacgacaaggactacaaggagcccccgccggcgccgctcttatagcctcccgagcccaagccctggtccttctaccgcgccggcatcgccgagttcgtcgccacctttctcttattatacatctccatcctcaccgncatgggcgtctccaagtccacctccaagtgcgccaccgtcggcatccagggcatcgcctggtccttcngcggcatgatc

SEQ ID NO: 74063 - DNA, 334 bp, Zea mays
  unsure at all n locations
  Clone ID: LIB3079-058-Q1-K1-H8
tatttttcaatgtcacnaaccanagcacgaagattttctatatgcatcacaaaaagctaactgagctgcaatatatgtggagctttatcaaatcttcttancaggatcccatcatcttcacttaccaaatattatacccatgatcaaaaccatggccgaatctaacactaatgctgaccaaatagagactcttatcggtaataatcataacctgcctgagttacctgatcatgaatctatctgatacttctcttgcttgtctccaaccaaacatccttcagcaaaccaaggtggtgcttatacccactgcgttgatttccaacctctgcattaa

SEQ ID NO: 74064 - DNA, 310 bp, Zea mays
  unsure at all n locations
  Clone ID: LIB3079-058-Q1-K1-F1
ggctgggctggaatccaagcgattccaaggacggtgtggctggaccccancaggaagcaggtgctgcagtggcctatcgaggaggtggaagctctgagagaaaaaatcggtcactctcaaaaacagggtaatcaaggcaggacatcacgtctaggggaccgggatacaaacggaccaggctgacttggaggtgagcttcaaggtgtctccggcggccctggccggtgcctaaaccctggacccggcgctggcctacaacgcggagaaactgtgcggcgtgaaacccccggacctcaggggcggcgtgggg

SEQ ID NO: 74065 - DNA, 245 bp, Zea mays
  Clone ID: LIB3079-058-Q1-K1-H9
aggaggccggaggctcaatggcggatgaaaatcaggctggaaagaaagaggaggaggaatttagcacaggccctctgtcagtcctaatgatgagtgttaagaacaacacccaggtcctcatcaattgccgcaacaacaagaagctgcttggccgtgttcgtgcttttgatcgccactgtaacatggtgctcgagaacgtgcgtgagatgtggacagagatccccaagactggcaagggcaaaaag

SEQ ID NO: 74066 - DNA, 288 bp, Zea mays
  Clone ID: LIB3079-059-Q1-K1-A1
aattcccacctacacctacgcttccgctacatcgcatacaattgattaactgcgttccacacttaaaaacactaatactaggatagggcctaataaaccatcacaaattaccatcaacactaaacactcaaaatctagctaactatgccatcatctgccaggaaaaataaactaatgccaattgtttaacctgacatccttgttgatggccctcatgacattgaatcgttcgcttacgtcactgacaccgtccatgctgtctgctacaatgcgctcaacgagcaccat

SEQ ID NO: 74067 - DNA, 115 bp, Zea mays
  Clone ID: LIB3079-059-Q1-K1-A10
ggcatcatcaacacatacacacaccaatgttcacatgctcttgccatttattcggagggggcaattatccgatgaatggcaatcttctcttaatacctcgcgggacttgcatggc

SEQ ID NO: 74068 - DNA, 417 bp, Zea mays
  Clone ID: LIB3079-059-Q1-K1-A11
cccacgcgtccgcccacgcgtccgcttcgtagcgccggcgctccatcttccgctggctgccttagtcgcgctcggcacgcgggtgacggcggcagtggcggcactcaggatcgggctctcagcgacggcatcagcggtttcccctcccgcttctctccagtcgcctcgcgccctcgcctccggtcctacgcacaccatccggtgaccctccatatagggtgtgagactaccaaaactcgaaaatgaacaagggaaagatttttaagctagccaaaggattcagaggaagggcgaaaaattgcataaggatagcaagagagagggtggagaatgcgcttgcatattcatattaggatcgacgcaacaagaagagagacatgcggtctctttggattgagcgcatcaatgctggtacac

SEQ ID NO: 74069 - DNA, 255 bp, Zea mays
  Clone ID: LIB3079-059-Q1-K1-A12
ggagatcgttcggcgtcacagacttcgtcaatccatcgcagctggtcaagcgttcggggggagaggtgatcgctgagatgaccggcggcggcgtggactacagcttcgagtgcatcggcgtgccgtcggtgatgaccgacgccttcagatgcaccaagatggggatgggcaagacgatcgtgctggggctggtgagggacagcgacgatgtgtgcctgccgtcgctggagctgctgttcgggaggtgcgtcatgg

SEQ ID NO: 74070 - DNA, 134 bp, Zea mays
  Clone ID: LIB3079-059-Q1-K1-A3
aaaaaaaatcaaaaaacaaacaatctaaaatatacaaactaacaaacacaaaacatgcaacagcataaactaaaatataaaatcacctaaacaaaaataaactatccaaaattatacaaccataaatactataa

SEQ ID NO: 74071 - DNA, 107 bp, Zea mays
  Clone ID: LIB3079-059-Q1-K1-A4
gcaaagacgagccgacgtatctgatgatcgtagttctcttcatcatcctgaagggcgcagcgcgcttgatacctgttgacatgcatcatctgacggccttactggcc

SEQ ID NO: 74072 - DNA, 163 bp, Zea mays
  Clone ID: LIB3079-059-Q1-K1-A5
ttcccacctccacccacgctacctctacatcgcaagtggccgccctttttttttttttttttttactcttttttttttgtttttgcatttttttctttttcttcatatctatcaaccttatttatctatctaatcctaactcttatctatactattcaatcac

SEQ ID NO: 74073 - DNA, 221 bp, Zea mays
  Clone ID: LIB3079-037-Q1-K1-C11
aaaaattataacccttcctcaaacacatcacctaaaataactacgaaccaaaaatatatatgggcgctcttcacatccatggctacgaactcttccatcctaatcgctcactacactataactatacacaattccaatcccatgctcccaaccttcatcgccacctacacctaaacccctctcataacacacctatcactgcattcaacgaatacatattt

SEQ ID NO: 74074 - DNA, 362 bp, Zea mays
  unsure at all n locations
  Clone ID: LIB3079-037-Q1-K1-C12
cgtgaatgtgtctcatacatattcctctagggctcttgcaaaatccaatggtttatggattaggtggtgacctcccttcggttaaagatccgcgacaaagtttctaagttgagtttgatctttgaagtgcaaaattgttttgatcataccttgangacatcctaaaagcaggtttgggattcatataacgagtttttaatgagacaaacaagttctagggtcaaaggcaatatgaatgacatgttagattcaagtattcaacaggatctctaggagtagatcagtggggtaaactgtgttctgtanggtaatttcaggttcttaactaatatatcaaaacagtattagattgttaccgtcag

SEQ ID NO: 74075 - DNA, 338 bp, Zea mays
  unsure at all n locations
  Clone ID: LIB3079-037-Q1-K1-C2
gcgcgagcttcttgatgatgaggaggccgaggaggttgcattcctcgtcagcggcgtacagcagcgacgacacggactcgatggcgccgggcacgcccgcgacgcgaagggcgttgcgcttcttgctggcgagcttggacacgacgagcgccgcggacgcccgcgcgccgcgctcggcggcgcccttccagctgagcatgtccacgaggcgctccacgacggcgggcgacgtgccgacgcggcgcagcgcgccgtccccgagccgcgggctcgcggccacgttgacgaggatgcccacgccgatgcgctgctcgtcgtgggacccgncgacgatgagc

SEQ ID NO: 74076 - DNA, 449 bp, Zea mays
  Clone ID: LIB3079-037-Q1-K1-C3
cccacgcgtccgctctgttcctccaaatacaagggatgcattataccaaagtttgccaccaaccataaagtcatctctccgttctaagctacactcctttggagttaaggaagagcttactgtttctcaaatcaaggctgaaatggagaagaccctgcggtggcttgtccctattgcaagtaacaccaccaaggctcaccatggtttcggttgggttggagagtgggcaaatactgggtcagatgtgaactgcaagccaaatgggcagatagacctgatccgaattgagacactgtaccacgctgacaaggagaagactgaagcatatatcctcgagcttgttatttggcttcatcatcttatcagcctatccaaaactgcaaatggtgaaaggtctccaatcaagtctcctgttcggtctcctacacaaagaggggcctcaatcacat

SEQ ID NO: 74077 - DNA, 393 bp, Zea mays
  Clone ID: LIB3079-037-Q1-K1-C5
ggcgtccttgacgacgcgtcagccatattcttctagcacgttgacccggccctccgggtcgtcgtcgtttcgtccaggccagggcccttcgctgcgacgtccggtcggttcctggcgactgtcacctgtaaaggcgggcacgcctcgatgccccacgaatccatcgaccctgttgtaactgcagccactactgtcgtcagcctccataatatcatcttccgagaaatcgatcccctgcaggtcgcggttgtgtccgtcactcttctgaagggaggagaagcgtacaatgtcatcccagataatgtggcctttaacggcaccatgatgcgcatgactgatgaaggtctatcggatcttaagaacaggatcaaagatgatcgtccaatgacatgc

SEQ ID NO: 74078 - DNA, 357 bp, Zea mays
  Clone ID: LIB3079-037-Q1-K1-C6
cagaaacacaccaagcgaagcgcactagcaacgacctaacaacaatggctaccaagagatgagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtga

SEQ ID NO: 74079 - DNA, 480 bp, Zea mays
  Clone ID: LIB3079-037-Q1-K1-C7
cggacgcgtgggtgttccccgagaccaacactggcatcattgtccttgctgagggtcgcgtgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggg

SEQ ID NO: 74080 - DNA, 297 bp, Zea mays
  Clone ID: LIB3079-037-Q1-K1-C8
aattctggatgtccagggcgtgggtttgaaaaatttcagcaaaactgcacgtgaatgaatggagcgactgcagaaaattgacaatgataactacccagagactctataccaaatgtttattgtcaatgctggtccgggtttccggctactatggaacactgtgaagtcctttcttgatcccaaaactaccgccaagatacatgttcttgggaacaaataccaaagtaagctgcttgaaataattgacgccagtgaattgccggaattccttggtggcacttgtacctgtcctgaata

SEQ ID NO: 74081 - DNA, 403 bp, Zea mays
  Clone ID: LIB3079-037-Q1-K1-D1
ctatactctatgaagcaaggacaccaccggcatggcagccaagatgcttgcattgttcggtgtccgagctctttgtgcaagcgccactagtgcgacgcatattccagggcacttgccaccagtcatgccattgggtaccatgaacccatgcatgcacgtactgcatgatgcaacaggggctagccagctagatggcgtgtccgtacctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtctcaaatgatgatgccacaatgtcactgcgacgccgtctcgcagattatgctgcaacagca

SEQ ID NO: 74082 - DNA, 382 bp, Zea mays
  Clone ID: LIB3079-037-Q1-K1-D10
ctaggaggcacgctgcggcagggatggtgtactacgcgctggtggtgggcgcggagctggagggcctcaccaacctggagccccgccacggctgcgacgaccccaacttcccctactacctcaagctcaagtgcgagaactgctgcgaggtcaccgccaagtccacctacgtcaccctcagcgagcaagtctacctgcccaaaggacacggagccgctcacctcgtccagaagtgcaagctttgtgggagagatggaacaattgtgatgattcctggtcaggggacaccacttactattgagcagagccagaaagaggagaagacttgtttgatggtgtttgactgcagaggctatgaacctggtgagatttcctttggcac

SEQ ID NO: 74083 - DNA, 452 bp, Zea mays
  Clone ID: LIB3079-037-Q1-K1-D11
ggcatgcgaagctggcgtgcccgctctggcgcaccccggcgcccgacatcaagtccatgcgggatcgaccacgaggcgcgcgaccccaagctccccttcgagccggagaagctcctcaacctgcactcctccgcccccgctgctgccgccgccgccgccgctgccgccgccgctgccgaggccaccacctccaagcccaagcccggcgtccgcggcagcctcaagaagtaagcttgctgggcttggttggctcgcccgcctgcatggggcgcaattcccttcggtttcaatcccatccggcgacccgatctataatcaatcaaaccggcgccctacggcctggcagctgccgcagtcggcctgcggtgtactgttagtctgctgctgatttcccgtgttatactggtgggacatgtgtcctgtgatagatgtgtcaactatatatcaatctc

SEQ ID NO: 74084 - DNA, 373 bp, Zea mays
  Clone ID: LIB3079-037-Q1-K1-D12
accccaattccaatctacccggccgaaccggcctactggggctgcatggttcccggaccttgagccctgccataaccgggggagcacccgtcgtcgtcgtcatcgcccaccaccaccagtgctccttcattcgtctcgtcatccggggcagctgacgactcatcatcccacgctctgggcaagcgcccccgggaccgggagggtgacgatgggagaaactgctgcaacgccaaagtgtgggctcccaagagcatccggatagactacgtggacgatgttgccaggagctcaatctggtccctcgtcgggatcaaaggcgaccagacgaagcagcaggacgcatcatacgaccactccggtgggcacagcaagc

SEQ ID NO: 74085 - DNA, 383 bp, Zea mays
  unsure at all n locations
  Clone ID: LIB3079-037-Q1-K1-D2
ggcgcttcctggccgcctccgagccggccgtgtccgtgcagctcggcgaccacggccaccgctcggactcccacaccaaccaggcgctccttcgacccatgtcgttcgcggccaaggacgaggtgttctgcctgttccagggggtgctggacaacctgagtcgtctgagccagcagcactggctgtcaagcaagggcgccaacgaggtgctcctcgtcatcgaggcctacaagacgctgcgcgaccgcgcgccctacccggtcagcttcatgctcgcccagctcaccggctactacgccttcgtactcttcgacaagtccaccaactgcctgctagtcgcatccgaccccgagggcanggtgccgctcttctgcgggatcacc

SEQ ID NO: 74086 - DNA, 447 bp, Zea mays
  Clone ID: LIB3079-037-Q1-K1-D3
ggcgcgcacaacttcgccagccgctccagctgcttcaagtgctccgcctacaaggaggaggcgcgcggtgaacagtggcgctggcggctttgacggcgacatgtcacgctcacggggctacggcttcggcagcggtgctgctggtgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggtagcgctgccatgacctacgaaaactacttgcactgaggtgtaggatcgagcaagttaaaaagtctgcagcgccgaagaaaggcgacgacagaggagtcctcatcacgtcgtaacgtaagagagagagagagtagtggatttgcaacaaaaaaaaaaaaaga

SEQ ID NO: 74087 - DNA, 460 bp, Zea mays
  Clone ID: LIB3079-037-Q1-K1-D4
gatccgtgcgccctcatctgacacccggacgttcatgcgctgcgatgtgaattttgaccgggccgaccacggacggagcctgaacaccatgattggcagggcagcccacatcgagttccttgagaccgacatctacgccaagttcatcatgtggtccttccctgacctgttccgatgacagacaacgccgctcgtctctgtaatgtctctgtaatactgctgcataccaaacctacaaaccgatagcgcacactactgagtactgaccaggcaaggaaaagtaagcttgcataaaggctcccccagaatccaacaccgtcacaggcagagtagcgctgtaaagatcctagaagcaacggtttttccagcttgctagatctgattctgtataaatagttgattctttcgtcattccattcatagtgctgtagatgtgcacctttgctgggaatttataatc

SEQ ID NO: 74088 - DNA, 383 bp, Zea mays
  Clone ID: LIB3079-037-Q1-K1-D5
gcacggaggaggcgcgtgctctgctccactccacctccccccccccccccccctgggccagtgacgccgctcgttcgcgcagttttggtcttctggccagcagggcagggggggaacccgcgggagcgaggcgcgcgagcgagcgagcggagggaggaggaggatgatgcacgccaagtcggagtcggacgtgacgagcctggcggcgtcgtcgccgccgcggtcgccgaagcggggcgttgccgcggccggcaccggcggcggcggcggcggctactacgtgcagagcccgtcgcgggagtcgcacgacggcggcggcggcgggtacaagtcgtcgtcgatgcaggccacgccggtgtacaacaacagccccagcgagtcgc

SEQ ID NO: 74089 - DNA, 285 bp, Zea mays
  unsure at all n locations
  Clone ID: LIB3079-037-Q1-K1-C10
cccacgcatgcggatggaggcatcgtacttccaggatcaattgagactagaccacatgctggtgagattgttattgtctgcgaccggatatattttatacttaacctcatttacatcaatgattcggtttacacacaacttgtctactacacttatgctncgcacatacttgactttctatgacgcacgatcatgtcatttccaactaagatcacataattgctctttttgacagtgattatcttaacgatatgagctcactgcatgatctcattcttatcaaag

SEQ ID NO: 74090 - DNA, 472 bp, Zea mays
  Clone ID: LIB3079-037-Q1-K1-A5
accttctcatggcagtactactactggtacctcaccaacgatggcattgagcaccggcgcggcttcctcaacctgccatcagaggttgtgcctaataccctcaagaagtcttccaagcccccgtctcgccccttcggctctggcccacctggtgaccgccccaggggccctcctcgttatgaaggtgacaggcctaggtttggtgatagggatggttacagaggaggtccacgtggcgctccaggtgactttggtggtgataagggtggtgctcctgcagatttccaaccatcttttaggggtagcagacctggctttggccgcggtggcggcggtgctttcggtgctggtggatcttccatggagtgatgtgtcaacatgagctagcataacattcgtctttgaactatgagaacaatgagattttgctttggtttaccgagctgttgccgtgggttgacatggttttgtg

SEQ ID NO: 74091 - DNA, 465 bp, Zea mays
  Clone ID: LIB3079-037-Q1-K1-A6
ctcgtgctaaagtcataaggaaattggcagatgaggtgttctcaattgttggacgggatcgacttattgaggtggccattgccctagaaaaggcagcgctgtcagacgaatattttatcaagaggaagctgtatccaaatgtggatttctactctgggctaatttatagggcaatgggattccctacagaattttttcctgtgctgtttgctattcctcgcatgggtggctggctagcgcattggaaagagtcactcgatgatcctgacactaagattataaggccccaacaggtatacaccggcttctggcttaggcactatacccccgtcagagaacgagtgctatcaagccagagtgaggaacttggtcaggttgccacctcaaacgcaactaggcgccgacgtgctggttctgccctgtagaagctgcagcgtataaacgcaccggcatactcaataaaca

SEQ ID NO: 74092 - DNA, 81 bp, Zea mays
  Clone ID: LIB3079-037-Q1-K1-A7
aaaaaaaaatagaaatactacatactgaaatttaaacaacaataaaataaaaacacagaagaggggtcttcaactttacat

SEQ ID NO: 74093 - DNA, 423 bp, Zea mays
  Clone ID: LIB3079-037-Q1-K1-A8
cccacgcgtccggggtctcactgaatcaaccgcttcaattagttcaaggacttaatgaggggacattgttatcggagattgttggcttgcagaactatggtgctttcttggagaaggatggtgctggatttagaggtcaagtaaaactcactggcttgtcgaatggggatatcgaccttactaattctctttggacatatcagattggtttgaaaggtgagttttcaaggatctattctcctgagtatcaaggatctgctgagtggagtagcatgcagaatgatgacacagtttcacccttcacatggttcaagactatgtttgatgctccagaaggtaatggccctgttaccattgatcttgggagcatgggaaagggccaggcttgggtgaatgggcatctcattgggcgctattggtcac

SEQ ID NO: 74094 - DNA, 332 bp, Zea mays
  unsure at all n locations
  Clone ID: LIB3079-037-Q1-K1-B1
ggtctgaatttccggtcgaccgcactcgttcgactgcnctcttaccaagtcctcctttggttatggttccttagggttttgtgggggggggatggctgcggctgatgtggagtaccgttgcttcgtctgctggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaactgcaaggagctcgacggtcgtaacatcaccg

SEQ ID NO: 74095 - DNA, 267 bp, Zea mays
  unsure at all n locations
  Clone ID: LIB3079-037-Q1-K1-B10
gtgttctgctatactgcagcagcaaccaaccactgctgcattcggattatgcactgacatgcgggagcgccaatgagtggctgcgatggcctggtcggcacattagcgatggtcctccgngccgccgtaggaacggccgcaaccgatgctgccgaagccgaccagatcgctaatctacctgaacagccggcagctatacttttcatacactccgactacggcaacgcagacccagcgtccggtcggtgcctcttctactggttaatc

SEQ ID NO: 74096 - DNA, 218 bp, Zea mays
  Clone ID: LIB3079-037-Q1-K1-B11
gactactaagatacttgcttacacagactgctacggtttcagatagatctatcatctttcattggaaagggtatcattgactgggctcaggtgctctgaccagcttgtgcgctgtcataccatccagctgggatacactactcggatctgacgctgtcaacgtccacatgaacagtaactagtaaatgcacatacttaccaaacctttcatacactga

SEQ ID NO: 74097 - DNA, 410 bp, Zea mays
  unsure at all n locations
  Clone ID: LIB3079-037-Q1-K1-B12
gcatcctattgccctcgcgccaccgtcgccgtcgctgcaccaagccaccgccctgccgtcgggtgaggtaaacaccaaggcaccgtcatggggcgtatgcacagccgcgggaagggtatctcttcatcggcgctgccgtacaagaagactcctccgatctggctcaagacagctaccaccgangtggaggagatgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgcctgaaatcccggaggatctctacttnctcattaagaaggccgtggcgattaagaagcatcttgagaggaacaagaagga

SEQ ID NO: 74098 - DNA, 465 bp, Zea mays
  unsure at all n locations
  Clone ID: LIB3079-037-Q1-K1-B2
gaccttgcagtgatgagctggctaatcaaaagactacaaagagaaatgagccagccaagaggaggggtgtgggtcggcctccaaagagtgggcagaggattgctggggcacaggaaaatagccccatcaaaggcaggaaaagtagcgctggggcacaggtagatagccccagcaaaggcaggaagaggagtgtggaagcacatgatgatagctccagcaaagggggcaagaggagccggcggtgaagctaccatcagctcaatgccggtgaaactgtgtacagcttaaccatatatcataagctgttcccttccggtttggttacctgacaaaaaaaagttattgtcccagtattcaaactgatgtaacaggaagggttagttggttctgatgttgntttgtaaggagtaaggacaattagaagggaaccctcaattttatattgagaatattccgagtaggctt

SEQ ID NO: 74099 - DNA, 303 bp, Zea mays
  Clone ID: LIB3079-037-Q1-K1-B3
aaaaaaaatatgccatcccaattcatatagcctccaaatctacaaccccgtgactccaaaaaaacaacccttttataactccccttaatttaaataacattccctttttttaacatcccctaatctgaaaaatcccaggcttttcccaacttactcactttgaaacacactccattttccccacttctctccttttcaaaaatcccccttttctacctttttaaaaattactatcaacccaaaatgtaaactgttcccccccttatcgccccctattaaccccaacggaccttcctttttccc

SEQ ID NO: 74100 - DNA, 420 bp, Zea mays
  Clone ID: LIB3079-037-Q1-K1-B4
gtagcatactattctgccgcttttcttttgaagagaatgatgacagaggaaccagagatgtgccaacggatgcttcaaagcctcatctcaaaagctcaacagtgtaacaatgagaaacttctggagaacccataccttcagatgcgtgggatattgcagttatcaaatgacctaggagttcaatgataagatcgtgatgacatttcaatggataaagctctaagttagaatcattacttctggctgtgtttattgcagagaacctgaagatgttccgaactaagttttgcagatgctatgtgaatcatgtaaattattgctttggccagatgcatgtacagatccatgaatttctttattctttggtagactagtcacagtccaagggagtcacagattaacaaggatatctgatgatca

SEQ ID NO: 74101 - DNA, 442 bp, Zea mays
  Clone ID: LIB3079-037-Q1-K1-B6
gtccggcgaggcagacgagttcctctcgcccctctgctccagccgacaacctccacggcagcaagcctctcccatggcgcttgcagcaggacacagagccccccatggcgcccttcctctcctcggctccaagggtgtaggcgagctgcagctcctcctcttccccatgggcgcgtcccccctgcagccgagctcctgcacatggcgtccatccctggtctcccttgcgcaggggtagaggcagccatggccggacctctgctcggccaacagcttgggcgcctgaagttccctatgctcggcgccccttcctgcgcagcgccgcttgtccacccctaccccagcgccccctctctcccatggccgagcagcagctctgctcgccccccctcttttttccccttgtgcagcaacaccaacctgctcttttcctccacaaaac

SEQ ID NO: 74102 - DNA, 306 bp, Zea mays
  unsure at all n locations
  Clone ID: LIB3079-037-Q1-K1-B8
cttccttttgtggaccgtgcgtgtgtgtgttgtgcagggtcgaggcggcgtggcggtcggggccgggagcgatgatgggctggcggtgacggagcagcaggtggcgaagctgatggaggaggacatgggcaccgccatgcagtacctgcaagggaagggcctgtgcctcatgccggtctccctcgcctccgccatatcctccgcgacgtgccacatgcgacctccggtgggaggaccgggcctcggggtcgccgccgccgncgcgcaccacatggccgctatgcgngatgccgcccacgccatgaa

SEQ ID NO: 74103 - DNA, 422 bp, Zea mays
  unsure at all n locations
  Clone ID: LIB3079-037-Q1-K1-B9
gcctgctcccctactccggccgcagccgccgacgtcgccattcgcattctgcggcgccaagcgataggggtcagcgagtggctgggatggcgtcgtcggcgtccgcgccagcgtccacgggcccgcgctacgccccgccggatccgacgctgcccaagccgtggagggggctaatcgacggcaacacggggtacctctacttctggaacccggagacaaaggttacgcagtacgagcgtnccgtcgctgccgtgcccgccccccaatcgcagccgcttgtctactccaggcccgatgatgtgccgagaagcagcgcacctgccgagcagcgctcggaagctgcggtgagcccgccgcaatttgtgccctcctccgataacaggacaaggattgatcactcagagtcaagctctgcatctgga

SEQ ID NO: 74104 - DNA, 476 bp, Zea mays
  Clone ID: LIB3079-037-Q1-K1-C1
atggagcgccctcgatttagtgatcatcttgaagcaatcaagtttatctgcaaagatttttggtcagagctgttcaagaagcagattgacaatctgaaaacaaatcacaggggtacctttgtccttcaagataaccgttttcggtggcttactcgtgtttctctagatccacgtacagagaacacagattcaactgaaaatgattctgcagcattgggtgatactgcagcccaaacgactaccatgcttctgtatttcccatgcgggttgataagaggtgccttgaccaacttaggaatttcgtgttctgtctctgctgacatgtcaaaccttccagcatgttcgtttgtggtgcgcataaagacatgaactgtgaggaatgatacaagtacagtacgaagattcgacagtatctgcttgtggttcaagccgggttgaacattgaagatagcagagtttgggcatgcattagatgt

SEQ ID NO: 74105 - DNA, 409 bp, Zea mays
  Clone ID: LIB3079-037-Q1-K1-A4
aaaaaaaaaaaataaaacaaaaaaaaaaaatttaattaaaaaaaaaaaaaaaaaaaaaaaaagaaagaataaaaaaaaaaaaaaaaaaaaaaaaaaaaaaaaaaaaaaaaaaaaaaaaaaaaaaaaaataaaaaaaaatggccgccctttttaaagatcccaagtttatttccccggcctttcaattaaaaactttttttttggacacccctaatttaaattcattgaccgctttttaaaaacctttcacctttaaaaaccttggctttccccaattaaatccctttcaaaaaaattccctttttccaagttgccttaaatccaaaaagcccctcacctttaacctttccaaaaatttcccaaccttaaatggcaaatggaaccccccctttaacccttcttaaaaccc

SEQ ID NO: 74106 - DNA, 171 bp, Zea mays
  Clone ID: LIB3079-036-Q1-K1-G6
gagagatctagtagagaggctagctaggtggtcctcgaacgaagatgttggcggtgttcagcgggcaggtggtggaggtgccggcggagctggtggcggcgggcaaccggacgccgtcggccaagacgaaagcgttgcaactggtggggcgcttcctggccggcttcgaac

SEQ ID NO: 74107 - DNA, 459 bp, Zea mays
  Clone ID: LIB3079-036-Q1-K1-G9
atgagcatgagcccttgacaaccttgtacgatgctgttcagtccatcaaacctacagttctgattgggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgtaatatttgccagtggcagtccatttgaccctgtggagtacgatgggaaggtttttgtacctggacagtcgaacaacgcctacattttccctggatttggcctcggtcttgttatctctggagccatccgtgtccacgaggacatgcttcttgccgcctcggaagcactagctgctcaggccacacaggagaacttcgacaagggatcaatcttcccgcccttcaccaacattagaaagatct

SEQ ID NO: 74108 - DNA, 74 bp, Zea mays
  Clone ID: LIB3079-036-Q1-K1-H1
aaaaaaaaaaaaaaaaaaaaaaaaaaaaaatttaaaataaaaaaaaaaaaaaaaaaggacaggggatggtgact

SEQ ID NO: 74109 - DNA, 456 bp, Zea mays
  Clone ID: LIB3079-036-Q1-K1-H10
ccgcaacagaaaagttgttctgcgagctgggtgcccactaacgtctcaggcagaagcaaggcggcgttgccttcgcatgatcctgaaatggaggtagatccatggaatctgctcgaagatggcacaagctgcccctcaacagcatctggaagccatggcgcgagtggagtgacgggtgaccatgctaatctgaaagcgtgcagctggcttaagggtgctgtgagggtgaggaggacagaactgacctacattggctctttagacgatgacacctgacgtgtgtatgattattttggtgaattgtggaggaaattagtctcacctgttggcactggagtgaatggtggaaaccaaccatggcccttggctttaagatggttgttgttggtgtagaatacatacacatcgctgcccccgttttggtttggtttggtttggtttaaggcccttgtgggg

SEQ ID NO: 74110 - DNA, 462 bp, Zea mays
  Clone ID: LIB3079-036-Q1-K1-H11
caccatcgggacccatgataatgaagatgctgcaggaaccccatccttgcatgtagttcagaaagatgccatggccctgaaatccgccagccctaattctcaaaaggagcaggaaacatctttgaactctgaactacaaagtcaggattgtcctctggaacatggttttagtgcagatttggtgaactccaggactgaaaagggagtcaggactacaagttctgctagtgctgttaaatctgattacaacaccatgtttcatcctgctaatggtagaatcaatgtccttgatcattttagccgcagcaatttgaatgatggttcatcaattgtcgcagaaagtaagcaaaacaatgaagatggaagtctaagggaagtgaagaataaaaagaagaaacgaacgcaaggtactggtagcgttgaaccaaatgatgttatagaatctccttcctcagagatagc

SEQ ID NO: 74111 - DNA, 439 bp, Zea mays
  Clone ID: LIB3079-036-Q1-K1-H12
gcttattcagtccaaatgaaaagcacttgcctgcaatatctgatccagagatcgaagctgcattgaaggatttgttggctgctagttggaatgaacttccagattctctcgtagcggaagcaaagaaagcagtatctaaagcgaccgatgataatgctggtcaagaggctttgaaaaatgtatttggtgcagctgaggcatgtgaagaattcagtggaaccttggttaccctaagaatggctcttgatgatctgtgtggcctgactggcgaaaatgtgggtcccttacctggttatattgaagatgctgttaaagctgcatataatcgctacatgacatatctggagtcctttggccctgaggaaaattatctaagaaagaaagtggagactgagttgggcacaaaaatgatacaacctaaaatgagatgcaatggcat

SEQ ID NO: 74112 - DNA, 300 bp, Zea mays
  Clone ID: LIB3079-036-Q1-K1-H4
atcagtatcgattacttctgctgagtgctacattattctgacaaatccagaaatgtagggctgtgcagatttgtgttctttttccggatacctgaataccgaaagactgtacaactgtagtttctgattcctactccttgtcgctattcaatcgctaaaggatctgtccctggtggagaagaaccggcagattcaatgcaatgttcttgactgacgtcatggattttgttcttcaacctggtagctctgaagacgaattgaatagctgctagtttctgctaatcatctacagtcaagtgc

SEQ ID NO: 74113 - DNA, 424 bp, Zea mays
  Clone ID: LIB3079-036-Q1-K1-H5
ggcggcgtcggatgttgagtaccgctgcttcgtcggcggcctcgcctgggccacggacgggcactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgt

SEQ ID NO: 74114 - DNA, 262 bp, Zea mays
  Clone ID: LIB3079-036-Q1-K1-H6
gcggcccaacgtgaagctgttcaacgccgttgcggtggaggacctgatcgtgcggcgggggcgcgtcggcggcgtggtcaccaactgggcgctcgtgtccatgaaccacgacacgcagtcgtgcatggaccccaacgtgatggaggccaaggtggtggtcagctcctgcggccacgacgggcccttcggcgccaccggcgtcaagaggctccaggacatcggcatgatcagcgccgtgcccgggatgaaggcgctcgacatg

SEQ ID NO: 74115 - DNA, 118 bp, Zea mays
  Clone ID: LIB3079-036-Q1-K1-H7
acgacgcccaacgttaaactcacacaacttcgtttttttcgacgaccaaatcatccggggcgggcactttttccacatctacaacaacatttacctccacttcatgaaccacaacaca

SEQ ID NO: 74116 - DNA, 335 bp, Zea mays
  Clone ID: LIB3079-036-Q1-K1-H8
cccacgcgtccgcccacgcgtccgggtgccgatggtcgtcgagcttgagcacggcgaggagtccgccggcagccacgaccaccaccaccacctgcagccgcaggggtcggaggaggacaccgacgtggaggccgcctcccacgtgagccaggccgaggccgagccgccggtcagcagccagagccaggcgctggtggcggaccaggagggtgaggaggtcaggctggaactcacgctcggcttcgagccagtcgtcaggcagcagccgaggctgtcgtgctgcgactcgagcggcttgagcgccgcgtcgagcctcatcggcctgcggctgcagc

SEQ ID NO: 74117 - DNA, 443 bp, Zea mays
  Clone ID: LIB3079-036-Q1-K1-H9
aacattatcattattcaactatgagagaagattagaatgagaaaaggaaaaaaaaggcaaaggggataatgatctagagcgatgagcaagtgtcttcaatgaatgaagctttctctttattcgacacatactgtgactgtcggatcgcgccgtcggagctggggatcctgatgaggtctctgggagggaacccgactcatgcccatctcaaagccatcgtggccgaagagaacctcacggctcccttcgacttccaccgattcctcgatcttatggccaaacacatgaaaccctatcccttcgatcgccaactccgcgacgccttcaaggtcctcgacaaggactccaccgtcttcgtcgccgtctccgagcttcgtcacattctcaccaacatcggcgagaagctctagccctgctagttcgacgagtgtatccgtgtagtc

SEQ ID NO: 74118 - DNA, 458 bp, Zea mays
  Clone ID: LIB3079-037-Q1-K1-A1
aggctgtcgaaaaggtgcacgccatgatagacagggaagtagccgatggcatccaccctgagaacatatttgtttgtggattcagtcaaggaggtgctctgacattagctagcgttttgctttatccgaagaagttaggtggaggagcagtgttcagtgggtgggtgcctttcagttcatcagtcactgagaggatttcacctgaagcgaggaagaccccgtttctttggtcacatggaatggctgacaaagtagtattggttgaagctgggcaggctggtccaccgtttttgcaaagcgctggtgttaactgtgagttcaaggcatatccagatctgggtcattcgctttcccaagaagagctactttatcttgagtcgtggatcaagagtcgtctaaatgcctctcaagagaaggacggttaactgattccatcatgcttaagtggcatttattta

SEQ ID NO: 74119 - DNA, 170 bp, Zea mays
  Clone ID: LIB3079-037-Q1-K1-A10
aaaaaaaaaaacctaacaaacctaaaaacttttattattaaaaaaaactaaaactaaacaaattgaggactttacaatataggcactactatctcaacttactaccttatctacactaacatcatactttatatcactttcctactttttaacaccttcaacatactaaa

SEQ ID NO: 74120 - DNA, 66 bp, Zea mays
  Clone ID: LIB3079-037-Q1-K1-A2
cggacgcgtgggaaaaaaaaacaaaaaaaaacaaaaaaaaaaaacaaaaaaaaacaaaaagggaac

SEQ ID NO: 74121 - DNA, 146 bp, Zea mays
  Clone ID: LIB3079-036-Q1-K1-G5
catatcatacaaatcatacaacaattacatctcaaaaaaactacaacactaacaataacaaaaaaaacctctaaaaataattatgaactaatcataaaaaacaaaataatatataaccaaaaaatacaaaaataaagaaaatcccc

SEQ ID NO: 74122 - DNA, 201 bp, Zea mays
  Clone ID: LIB3079-056-Q1-K1-C10
gagaccgaatactcagtgaatgttgtgaagcatatttttgatcgacatgttgtgctccaagacaggctgaccaatacaattgctgaacaattgcttgaacaggttattgttttggttgatgcttctgaggctgacgaatttttagaagttgcttcaaagcctttagaatcattaccatatgattctcctgggcagaccttt

SEQ ID NO: 74123 - DNA, 312 bp, Zea mays
  Clone ID: LIB3079-056-Q1-K1-C11
gtggtgcaagttctgaaataaaagaatctgtttagtttcaaaaaaaaaaaaaaaaaaaaaagaaagatataaaaaaaaaaaaaaacaaaacaaaacaaaaaaaaaaaaaaaaaaaaaaaaaaaaaaaaaaaaaaaaaaaaaaaaaaaaaggccccccttttaaaaaaaccaaacttacctacccctacattcaaacttaaaaccttttaaaaagtgcacccaaaatcaaatcaactgcccttcttttaaaaacctcctaactggaaaaacctctccttacccaaactaaatccctttaaataaaatcccctt

SEQ ID NO: 74124 - DNA, 262 bp, Zea mays
  Clone ID: LIB3079-056-Q1-K1-C12
gcttctgtgctgctgaagacgctgttgctacctctcccaaatctgttttccactgctttggcgtgtagaacttggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttgggtattct

SEQ ID NO: 74125 - DNA, 261 bp, Zea mays
  Clone ID: LIB3079-056-Q1-K1-C2
atgcggccggatgcactgtaaagaggtctatactttactatgcctgtccaggttgctctagctttggacgcatgtaaacagcggggggtcttgctggcgctgcctatgatgatggaaattggtctagagagaggattcagaactgcattgagtgactttgtacttatgcagctccagttagcatctgtgttcttcacattctctcttgggaccaaaactcactactacggaaccacactgctacatgtaggagctgaatat

SEQ ID NO: 74126 - DNA, 361 bp, Zea mays
  Clone ID: LIB3079-056-Q1-K1-C4
gcgctgggatgtccaaggatggccagacccgttagcatgctctccttgctttcacacttggggtgaggcagatgatttgctgctgcaacaagatggatgctactacacccaagtattcaaaggcccgttatgatgagattgtgaaggaagtctcttcctacctgaagaaggttggatacaaccctgataagatccacttcgttccaatctctggttttgaaggtgacaacatgattgagaggtccaccaaccttgactggtacaagggcccaaccctacttgaggctctggacttgatcaatgagccaaagaggccttcagacaagcccctgcgtctcccccttcaggatgtgtacaagat

SEQ ID NO: 74127 - DNA, 426 bp, Zea mays
  unsure at all n locations
  Clone ID: LIB3079-056-Q1-K1-C5
gcattagccactggaaagaggtttatacacaacgagcctctccaggttgctctagcttcgcaggcttttgtgcagcttgggttcttgatggcgctgcctatgatgatggaaattggtctagagagaggattcagaactgcattgagtgactttgtacttatgcagctccagttagcatctgtgttcttcacattctctcttgggaccaaaactcactactacggaaccacactgctacatggaggagctgaatatagagctacagggcgtggatttgtggtgttccatgccaagtttgctgagaattatcgattgtattcgcgaagccattttgtgaagggcattgaactgatgattttgcttattgtgtatgaaatatntgggcagtcataccgaggagctattgcgtacattttcatcacattt

SEQ ID NO: 74128 - DNA, 278 bp, Zea mays
  Clone ID: LIB3079-056-Q1-K1-C6
ctactgctcacttaattcctcgatcgacccatgcgttcgtctactgcatccatccacacatccgtctacccttctctaaataaatttaacactaaatgtgaggcttataaaaaaactaatacaacaaaataaataactactacacacaaatattcaaaatcccaattatgataaaattgtaaaaagaagtctattactaccttaaaaaaagtttgatacaacccttaataagatccactttattccaatctattctttttaatgtgacaacattattt

SEQ ID NO: 74129 - DNA, 346 bp, Zea mays
  Clone ID: LIB3079-056-Q1-K1-C8
attccccgacccacccactcttccgcaacaaacactaaatacccataaaatctatttacaaaaaacaaaaaaaaacaccaaagaacgcttacataataaaattaaacaaccccctacctacttactaacctcacctcccaactttcaaccaccctacctaacactccacaccctacaacttaatcactttcctataaacttcccaaattcaatatcactctccttcttttcaaacttacctatcttcacaaaccctaacttatcccaactaaatcccataacactacatcccccttatcccacttttcctaatacccaaaatccccaaaccaatctccttttcaaa

SEQ ID NO: 74130 - DNA, 421 bp, Zea mays
  Clone ID: LIB3079-056-Q1-K1-C9
atttgctcttaacgaggcacagaaatcccttctgtcggatcacatatccctagagacttgagtaaggctcgcactgatatccatatattctgtacttaccaccacatcgcactattgttttgcttgctactagcgcacatgtaaaaaatattaaataaacaaagaagcttgcctgaactatttacatacactgtaaatacagtttttagtggtgtattttaattacttacacaaaccagtattcatctcaaaagccatgaacagctattcttatcccttccatttcattgaaaaatgaaggctttcgtagggatgaagaaacgcttcaaccttcaatatacctgaacaacctgccagacaagattccagagggtactcgtgtgctaagttgtgacccaatgctggccactggtgggacaat

SEQ ID NO: 74131 - DNA, 399 bp, Zea mays
  Clone ID: LIB3079-056-Q1-K1-D1
acggacgcgtccgccggcgtcgtgcgctcgctacccctctccctcgaggcctttgccggcgaagagcgcccaggcggccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgctgctggcagggagaagtttgcttcagtcccatgtggcggtggcggtgtggctgttgtggcagctgcccctgctgctggcggcgctcctgcagctgaggcgaagaaagaagagaaggtggaggagaaggaagaaagtgatgacgacat

SEQ ID NO: 74132 - DNA, 366 bp, Zea mays
  Clone ID: LIB3079-056-Q1-K1-D11
gttgttctttctgatggtgcagtcgtaacagtgaatggtgctagagctgtgagcctccgggtgcggcttgaattaccacttcctctcaaccgtaccacttacaagggtcgcctctcaagcctgatatccatcgcacaagccctgcgtggtgcagcccggtctaatcagaaacccctgctctctcttcgcgttgagggtccagtttccttgtcctcgactccttccatgtctcccaaggacaagctcaagctcaaacggttggccccaggccaagtggagctcttctcacaagcgggggcaatccctgctatcaccgaagacgaagatgaaccacataaccctggattgtggcctcttttgtctctg

SEQ ID NO: 74133 - DNA, 326 bp, Zea mays
  Clone ID: LIB3079-056-Q1-K1-D12
ttcccggggggacggactcgtccggaaggcgtatctgatgagaggagctttggttgtcattcacagccatggaatagaggctgggttcgcatcaatgctcagccctggcgcaaaggagttcagagtgacccacatggaactgatcaaaggaatcaaaggtcatggctaccatgatgaattgggcattcctattattgagaataccccttatgagtatgagctcactgactacctaagtgaggcgattgcagcatacccaaaggcaactgctgtgcttgtgacgaaccacgcaatatatatatggggggagccttcgatcaatgcct

SEQ ID NO: 74134 - DNA, 184 bp, Zea mays
  Clone ID: LIB3079-056-Q1-K1-D2
cctacctgcttgctgtcctcgctgggaactccatcccctctaccgaggacttgacagccattctggagtcagttgactgtgaagttgacaatgaaaagatggaactccttctgtcccaactgagcagtaaggacattaccgaactcattgcttctggcaagtagaagttagcttcattcccatg

SEQ ID NO: 74135 - DNA, 278 bp, Zea mays
  unsure at all n locations
  Clone ID: LIB3079-056-Q1-K1-D5
tcatcctcctgcgtcttcctctcgctacccctctctctcttctcctttcccgacaaacaactcccagtcgcccacctgnatgaagtttcctgctccctacctccttgctctcctctctggaaactccagcccctcttcccatgacttgacagccattctcaagtcagttcgctgtcaagttcacaattaaaacatgcaactccttctgtcccaacttatcagtaatcacattacctaactcattgcttctggcaatgaaaactttgcttcagtcccat

SEQ ID NO: 74136 - DNA, 452 bp, Zea mays
  unsure at all n locations
  Clone ID: LIB3079-056-Q1-K1-D9
ccgcgaccgggagagagtcagagagagacgcccgtctccagatcgtccggcggngatgggggctgcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgccgtcaaggttacatcaccctatggcaatactgtgcatcataatgaaaatgctacaacgggccagtttgcattcaccacttcagaagctggaaactaccttgcatgtttctggatagacagcgtggagaaaggatcaggaacatctctaaatcttgattggaagatagggattgctgcaaaagactgggatactattggta

SEQ ID NO: 74137 - DNA, 360 bp, Zea mays
  unsure at all n locations
  Clone ID: LIB3079-056-Q1-K1-E1
caacataggcttgaggtattccggtcaagggagactgggtggggagttcggtctttggggctcgttaangctggcacattcatttgtgagttcagcgggattatccttactcaccagcagtcagaggttgtggcagcaaacggcgattgcttggtgcgtccaagtaggtttcctccaaggtggttggattggggtgatatatctgatgtctaccctgattatgtggcgccagaccatccttctattcctgagttaaaatttgcaattgatgtgtcaagggcaaggaatgtggcatgctatttcagccacagttgcagtccaaacgtgtttgtccaagttgtgcctgttgatcattacaat

SEQ ID NO: 74138 - DNA, 454 bp, Zea mays
  Clone ID: LIB3079-056-Q1-K1-E10
cggacgcgtgggcggacgcgtgggctcaattcacgcatccgatttcgcttgcgccgcacgcgatgcttccttagattttttgtctttagcgtaataataattattaaaattaaaatctcgccaaacgtgcatttgtggagtggagacactagcagatgacctcattccaaatcaaacacttcggagcacaatcagcaatatgttgggaacacagacaagcagtggtggtagtggtacaacaagacacagaagttcgtcaggcagcaaccctaacccaaaatacagagccacactgcttctgttgcgtcagcaggggaggtgaagcagtctatagaccatcagctaccagcggtatctgcacctgattatgtgctccagggtgccacaggaagtgacctggtgaaccagcctctagagaaatagcagccactgctgaaatcctagcaaatatgaa

SEQ ID NO: 74139 - DNA, 423 bp, Zea mays
  unsure at all n locations
  Clone ID: LIB3079-056-Q1-K1-E11
ccgcctctcctgctctcgttcggttctggatggtggcatgcggagcccggattgtctgtctggtgttgctgccggcttgaagggagatcatcgtctctggtatcggctcacgcttgcgcggtccctcacctagagggccgcacggcagtggagcgacgttgctacgaggggccatgtggatgcgcaatggtcctcatgtgctggcgagtatgttgttctctggtggtgctagtcgtcgatcggctgttgtcgtcctagccgttatagcctgcgtcatgtttgtgtaatccgaccgggctgtgttgggccattggtattgatctacccttttgtaatctccgntctgctttgtgtaatcctactgcccattttgagccattgatctaatgaaatcangtggtgattgctcccncgttgaccgtt

SEQ ID NO: 74140 - DNA, 368 bp, Zea mays
  Clone ID: LIB3079-055-Q1-K1-H8
attgactccaccactggtggttttgaggctggtatctccaaggatggccagacccgtgagcatgctctccttgcgttcactcttggagtgaagcagatgatttgctgctgcaacaagatggatgcaacgactcccaaatactccaaggcgcgttatgatgagattgtgaaggaagtctcatcctacctcaagaaagttgggtacaaccctgataagattgcctttgtccccatctctggttttgaaggcgacaacatgattgagaagtccaccaaccttgactggtacaaaagcccgaccctgcttgaagctcttgaccagatcaccgagcccaagagaccttcggacaagcccctgcgtcttcccct

SEQ ID NO: 74141 - DNA, 260 bp, Zea mays
  unsure at all n locations
  Clone ID: LIB3079-056-Q1-K1-A1
ctactcactacccacaccactacattttcctacaaaaacgaccaatactatactaagcaaaacttaacaccatggaagaccnacccacccaccgtcatctccactctcatcttcctactccaccgccacgacctgagctctaccatcgctcactctctccactccacctacctatcctaccagtgaataaaccatgacatctttccccacgttcttctaccccctctactgccctcatcatcaccttcatctctaccacc

SEQ ID NO: 74142 - DNA, 273 bp, Zea mays
  Clone ID: LIB3079-056-Q1-K1-A2
ccggggggctacggcgacctccagcgcggtcggtggcatgcacggcgaggcgcagcagcaccgcaagtaattcgtcagtgaggacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccggcatcgcgctggcgctcatggcggccgtgttcgttacctccggcggcc

SEQ ID NO: 74143 - DNA, 320 bp, Zea mays
  Clone ID: LIB3079-056-Q1-K1-A5
tacctccagcgcttggtgttgcatgcacggcgaggcgcagcacgaacagatgcattgcgccgtggtgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccggcatcgcgctggcgctcatggcggccgggttcgtcacctccggcggcctcggcgtcgctgcgctgtccgtgttctcctggatgtacaagtacctgaccgtcaagcacccgt

SEQ ID NO: 74144 - DNA, 155 bp, Zea mays
  Clone ID: LIB3079-056-Q1-K1-A7
ccacgacacaaccaaccatcatctgaacaacaccgatgcagacctgcccaatcctcaccctcaccctgatcacgctcactacgaccaccaccacgctattcatctccaatcccaaacaatacactgcactcaacattaatccgactaccaaaaat

SEQ ID NO: 74145 - DNA, 373 bp, Zea mays
  Clone ID: LIB3079-056-Q1-K1-A8
cccggactcgctggcaccagagcagtgcatggctctcgagtcggtacttccgccaaagcggtcggttaagctgacagacatggagatagatgaatgcgaggagacaaccatgcatgatgtgaacaacatcgaggaagagatgcgcaggaagcaggctcatgctgctcaggaggcgtacgaggaggacgacgagatgcctggcggagcccaaagagtgcagtgcgctcaacagtaagcagactaccaaaatgggattcaaggcactttggttgctcttcaattatgcgagtgcgcctgtggactgtatggttctatggttttgctgtcgctgagctacaaagtaggaagctgatgcgcccctggctctgcaagc

SEQ ID NO: 74146 - DNA, 325 bp, Zea mays
  Clone ID: LIB3079-056-Q1-K1-A9
gtaggagatgatcttctcgttaccaaccccaccagggtcgccaaggccatcaatgagaaggcctgcgatgctctcctgttgaaggtgaaccaaatcgggtctgtgaccgagagtatcgaagctgtcaggatgtccaagcgcgccggatggcgagtgatggcaagccacaggagtggcgagacagaggacaccttcattgctgacctctcagttggcctgtctacgggccaaatcaagacggcagctccttgccggtctgagcgcctggccaaatacaaccagctgctcatgatcgaggaagagctccgtgatgtcgacgtctacg

SEQ ID NO: 74147 - DNA, 425 bp, Zea mays
  unsure at all n locations
  Clone ID: LIB3079-056-Q1-K1-B1
tccgccccgactcgctggcaccagagcagtgcaaggctctcgagtcggtacttccgccaaagcgttcggccaagctgacagacatggagatagatgaatgcaaggagacaaccatgcatgatgtgaacaacatcaaggaagagatgcgcaggaagcaggctcatgctgctcaggaggcgtacgaggaggacgacgagatgcctggcggagcccaaagagtgcagtgcgctcaacagtaagcagactaccaaaatgggattcaaggcactttggttgctcttcaattatgcgagtgcgcctgtggactgtatggttctatggttttgctgtcgctgagctacaaagtangaagctgatgcgcccctggctctgcaagcggnggaatgtatccttttttgctgcaactgaaaaatgctacccaggca

SEQ ID NO: 74148 - DNA, 363 bp, Zea mays
  Clone ID: LIB3079-056-Q1-K1-B10
cgtcggtctggacaccgagctctacgcccatgaggctcaggtacgggaagccctcattggggtagtggacactgcggacaccgctatctacagcatcgagaacagtcttggagagtacagggacaagatcccgggagatgttgcatctgagaacgaggcagtcatcgctgaccttcgccaggagataggcctcggatgacatcgagaagatcaaggtcaagcttgatgctgccaacaaggctcgctcgaagattggtcagcacatgtcaagtggtggctctggcgactcacagtcagcatctggacctcagggtggccgtgaccagtcgccggaggcagagtatgaagaggttgaaaagtgag

SEQ ID NO: 74149 - DNA, 439 bp, Zea mays
  Clone ID: LIB3079-056-Q1-K1-B11
ccacgtggcacggactcggagctcttcctatattgctactgctattgctattgctatacggcaagggccgcagcggcaggccacgcatctctctcccttccttctccccgttctccgtgcaatctcggccgtttccgctcccgccatcgccatggaggaggccaaggttgtggagtccaaggacgggacgatctcagttgcttcagcatttgctggtcatcaggaagctgtgcaagacagggaccacaaatttttatcaaaggcagtggaggaagcataccgaggagttgactgcggcgatggaggaccatttggtgcagttgttgtccataatgatgaagtaatagttagctgccataacatggttttgaagaacactgatccaactgcgcatgctgaagtaactgcgataagaaaggcttgccaaaagcttgggaaa

SEQ ID NO: 74150 - DNA, 401 bp, Zea mays
  Clone ID: LIB3079-056-Q1-K1-B12
gttcactgagcaaggaccatctatgacagttggttcaagtcaagagggtttgattttttggcatgtatggttccacagaagagcctgagaatgcattatcgaatctcaatggagctatgagttctgaaacccttttttcttccccttgctgctcgcggcatagcatttggaaattgaagtacaatttgtctttcaggatatactgaattgatttatcattgtcctgcaggacttggatgatagatccgtgttacgataccagcatcaaagccgcctagaagcaatactgaactttcacttgagatgtgagtaaagttgtgtgggggccttcgtcctccgaaggtcctcaaaaacatgatttgacaatgttttccaagtggattatgtgaacaggtaccttc

SEQ ID NO: 74151 - DNA, 434 bp, Zea mays
  unsure at all n locations
  Clone ID: LIB3079-056-Q1-K1-B2
cttattagtacttgtccctgctattctcttggccatgcaagaagagaaaagagccagaggagcatctgctgttgaaccggtgcaacatgtaccaagagcgggcagcgagatcaatgttgctgggccaagtgtgggcagtgagactaatgttgatggactaatgttggatcaagaggcttgtgaagttcagtctccaccttctgttacgtcagtatatagaagtgggaaaaagcggaagaaaagtcaagttgcaagtgttctggatgactatttggagcacaagaagaagcaaacacagaagattatggaggtgttacttgagaagaagagtcgtgaagaggagtactctatcgagaggtgtctcgacacagttgatgttatggaggacttgacggatgangagaaggcccttgcagcanangtgttcaagaatg

SEQ ID NO: 74152 - DNA, 251 bp, Zea mays
  Clone ID: LIB3079-056-Q1-K1-B5
ccccgactcgctttcaccatacccctacctaaattaaaaaaaaaaaaaaaaaaaaaaaaacgaaacgaaaaatttaaaaatttgaaaaacccacccaatctaacacacaaccatacattacaagaacaacatctactaaaataacctccataaacaacacccatcccacttaaaaatcctacctacacgaccactaaaacactctcaccacccaaacaatccacatcactcaacattaaacacactaccaa

SEQ ID NO: 74153 - DNA, 434 bp, Zea mays; identical to SEQ ID NO: 74151
  unsure at all n locations
  Clone ID: LIB3079-056-Q1-K1-B6

SEQ ID NO: 74154 - DNA, 365 bp, Zea mays
  Clone ID: LIB3079-056-Q1-K1-B7
cgcgtcggattgttagtacttgtacctgctatttctcttgccatgcaagatgagaaaagagcggtatgatcatttgctggtgaaccggtgcaacatgtaccaagagcgggcagcgagatcaatgttgctgggccaagtgtgggcagtgagactaatgttgatggactaatgttggatcaagaggcttgtgaagttcagtctccaccttctgttacgtcagtatatagaagtgggaaaaagcggaagaaaagtcaagttgcaagtgttctggatgactatttggagcacaagaagaagcaaacacagaagattatggaggtgttacttgagaagaagagtcgtgaagaggagtactctatcgagag

SEQ ID NO: 74155 - DNA, 289 bp, Zea mays
  Clone ID: LIB3079-056-Q1-K1-B8
gtacttgtccctgctattttcttttccatgcaagaagagaaaagagccggaggagtatatactgttgtaggggtgcaccatgtaccaagagcgggcagcgagatcaatgttgctgggccaagtgtgggcagtgagactaatgttgatggactaatgttggatcaagaggcttgtgaagttcagtctccaccttctgttacgtcagtatatagaagtgggaaaaagcggaagaaaagtcaagttgcaagtgttctggatgactatttggagcacaagaagaagcatacac

SEQ ID NO: 74156 - DNA, 98 bp, Zea mays
  Clone ID: LIB3079-055-Q1-K1-H6
aattccaatttccacctagaccgcactcgtccgaaagaaatcaaaaagaataaaactttacaaatcaaaaaaaaaacttaaacaaaaaaagggaaggt

SEQ ID NO: 74157 - DNA, 421 bp, Zea mays
  Clone ID: LIB3079-056-Q1-K1-B9
cgggaagggcaagggaggacgccgccgccacaggctcggcggcagcgagtccggcggcggggagggcgggagctggtggaccgagaggctgcgtgcggcgcacaaccgcctggccccggtgtcgctgttccagaagcccatcgtgaaggtgaagctcgacgacctgatggccgccacgcaggacttcagcagcagccacatcgtggtcgccgggagctcgcgggcggggacggcctaccgcgccgtgctacgggacgggtccgcgctgacggtcaagcgcctgcactcgtgcccgctctcggagaaggcgttcagggcggagatgtgtcggatcgggcagctgcggcatcccaacatcgtgccgctgctgggcttctgcgtcgtggaggacgagaggctgctggtgtataagcatatggag

SEQ ID NO: 74158 - DNA, 385 bp, Zea mays
  Clone ID: LIB3079-055-Q1-K1-F9
agtaacagtgcatgcattccaaaccaggtcctttgagcaatgtgaggaactgttgttacagagtacaatacatccaaagcacactatccttgaattacagagctcaaaccacctgaacttgttattgtggacttttttcatctcatcgctggttctccctcctgcgtgcgtagcgggtcctgtcattgtacctaggcctgtctgcagccctctgtggcacgggctcgacccttctctgcctctcaagaggcctctgaacaatctcaccgttgacaagcagttcagctccgtagtccttgtactcaaggtcaacatacgaatccggtagcacaaagagaacaccaaggagcccctcgagcttgttagatgtctcctcatcgatctc

SEQ ID NO: 74159 - DNA, 160 bp, Zea mays
  Clone ID: LIB3079-055-Q1-K1-G1
agcggaccagccgctgaaagaaaagggttcctggcccaactcgcatccgtgtcaccgcgtgcgcgggtcgaatcatccttcttccgtcaccatacatactgtagacagtcgaacaatcgccggctagacgcccctcttctggacgccgcacgccttgacg

SEQ ID NO: 74160 - DNA, 440 bp, Zea mays
  Clone ID: LIB3079-055-Q1-K1-G11
ttcaaatctgtgtttgacgtcaagaatgaattcaagtcaatgtttctgagctttggcagtggcaagaatgccgccatggagatcccacctgaaaactacctcattgtcacaaaaaatggaaatgtgtgcctgggcattcttgatggaacggctgccaagctgagtttcaacgtaattggagacatcacgatgcaggatcagatggtgatctatgacaacgagaaatcgcagctgggatgggcgcgtggggcatgcactaggagcgccaagtctattctgtcttcctttccctgagctcagttctatgtacttctgatagagtttaagaaaatcactatatcaaacctcctcgcaatgcatgaatttcctaactgaagagggagggagagagagagagagaatgttcctgtttatgtagagatggagtccaaaatttgtgt

SEQ ID NO: 74161 - DNA, 446 bp, Zea mays
  Clone ID: LIB3079-055-Q1-K1-G12
tgaactcttctcaccttaccttctattctcaaggaaacctttatccatggcccgaggtatgatactgctcctgcttgtgacccccctcgccatctccatggcactgccatcactatcaacgagaatcgaagggagtgtcataggggagagatccaacttgttctcacagctgcactccgataattctagccctacagaaaacaaactccaaccaggtgaaaagtcctttgcatcggaggcatatgcggtgaactggaacgaaccaccagaccaacaatcgcaagactccctcgagcagctagagccgtatcgagtgatatggaaacaaccagtgcaaggtgaaaagtccttcgtatccgaggcatatccggcgaaatggaacaaaccaccatcaccaagcatgcaatcgcaagactccttcgagccagaggcatatcgggtgaaat

SEQ ID NO: 74162 - DNA, 255 bp, Zea mays
  Clone ID: LIB3079-055-Q1-K1-G3
gttctgcccttttcaactgtctaaagacggtgtcgagatgcagttcgcgacaaatcatctaggacactttctgcttaccaatctcctccttgataccatgaaggccactgccaagtctacgggcattgagggccgcattgtgaacctgtcatcagtcgcccaccaccatacgtatccgaagggaattgacttcgataacctcaacgatgagaaaatatacaacgacaaaatggcttatggacagtctaaagctgc

SEQ ID NO: 74163 - DNA, 218 bp, Zea mays
  Clone ID: LIB3079-055-Q1-K1-G4
atccttaaacccaagaattcaccttcgtcgcccataacgccataccttttgtgctatccagattaccaccaaaactgaaccttgaaccctatctcgaatggtatcaacgactcattcttaaattacgaaagcttcaatcacaaaatgttctactgctcccaacataaatataataccacatgttatattgaaacatatatatccatcatccatatacc

SEQ ID NO: 74164 - DNA, 431 bp, Zea mays
  Clone ID: LIB3079-055-Q1-K1-G5
gcaaatctttgggcaatcattatggatgcaggaactggcttctcagctcaagtttaggatgtatcttcacactttcttcataaggagtggatcatggaacaatgggataaaagtttctacatcagttctgttgctggctccaacaatggaagttctattgtagtgatgtcaaaaggcacaccatatacacagcaatcttataaagtcagtgattcctttccatttaagtggataaacaagaaatggaaagaaggttttcatgtgactgcaatggcaacatcaagcaatcgatgggctatagtcatgtcccgcaatgcttgattttctgaacaagttgtggaattggacttcttgtacccgaacgaaggcattcataaacgcttggacaatggctttcgtattactggaatggcttgcaccattgatcaatc

SEQ ID NO: 74165 - DNA, 348 bp, Zea mays
  Clone ID: LIB3079-055-Q1-K1-G6
gttgtagatcgcgacggccgccctttttttttttttttcaaatgggaccaatatgggtggcaaatatcaaccagacagaatcaccactcacgatcacgacgagatagcagagtactatctacaagggggggatgagatcacacaaccgacaccgcgacatggtatagaaacccttcctgcaccaaggaaaccagatccgaccaaaatgcgacgacgacacgacagcaccgaacaaatctcactactactagtactactggatagcactccaataaatagatctaggcggcagctgcggcagcgggggaagtactgctaggtagcctgcaagcacgaagccccatcggc

SEQ ID NO: 74166 - DNA, 404 bp, Zea mays
  Clone ID: LIB3079-055-Q1-K1-G7
gtcggcgatggtggaactggtaaaactacatttgtgaagaggcatctcactggagagttggagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcataaggacctgtgcagggtctgtgaaaacatccccattgtcctctgcggtaataaagttgatgtgaagaacaagcaggtcaaagccaagccagttactttccacaggaagaagaatctgcagtactattaaatttc

SEQ ID NO: 74167 - DNA, 394 bp, Zea mays
  unsure at all n locations
  Clone ID: LIB3079-055-Q1-K1-G8
tctgccgcaggactggtcactcggcacgcatgcagaggcagcacagcagcagccggctcgatccatcctctttcccctcctcgcttcgcttcctcggcggattcctcctccctcggccgtccccgtcccctttttcggcgcgcgagctcgcccgagatggcaaacgcgagatcgggtgtcgctgtgaatgacgagtgcatgctcaagttcggcgagctgcagtcgaagaggctgcaccgcttcctaactntcaagatggacgacaagttcaaggagatcgttgtggaccaggtcggggatcgcgctaccagctacgaggacttcacaaacagccctcccgagaatgactgccgatacgcgatctatgatttcgactttgtcactgcagaagatg

SEQ ID NO: 74168 - DNA, 327 bp, Zea mays
  Clone ID: LIB3079-055-Q1-K1-G9
ctctgaagacctaccagatgttgatatttctgttgtcggtgtcaccagcttcagtggaccggaaggcccctttgatgtggatgtttttgactctagtgtagattacataaagttaatgaagacaatttttgacttcgaagcaataaaaaagctgctgacctccccaaagtttacattctgttatgatgcactccatggtgttgcgggagcttatgccaaacacatctttgtggaagagcttggtgctgatgaaagctcactgttgaattgtgtcccgaaagaggactttggaggtggtcatccggatcctaaccttacctatgcaaa

SEQ ID NO: 74169 - DNA, 398 bp, Zea mays
  unsure at all n locations
  Clone ID: LIB3079-055-Q1-K1-H1
gagaaattgtacagtctgaccatgatgacccaccacagaagatgggaaatccttcagtgggggtgactgangaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaaaaaaccagctgctgccattcgtgatgccaatgctgctctaaaaaatcaaccaaaactcttcaaaaaggtaaaaaactctggaatggcatattccatgcttggcaaatgggaagaaacttctcatgatctggacacaggatctaacatggattaccaccaagagatc

SEQ ID NO: 74170 - DNA, 218 bp, Zea mays
  Clone ID: LIB3079-055-Q1-K1-H10
aaaaaaaaaaaaaaaaaaaaaaaataaaaatataaaaaaaaaaaaaaaaaaaaaaaagggagtgaatatttttaaattaaaaaaaacaaacaaaaaaaaaaaaaaaatgttctaaaattttataatgaaacataatattttattccttcttccaaagtttatatcatcttatcttaaaaataaatttaaattaattaacttgactctcttttaaattt

SEQ ID NO: 74171 - DNA, 365 bp, Zea mays
  Clone ID: LIB3079-055-Q1-K1-H11
ggaaaaaaaaatctcatcgactctatcctgagtcctgactcctgacatctccgagcgtgagcgtccccgtccccggcgccgtacctctcgctattgtcctcggtgccgcaccttctacatctctgtctcaccgctttagcacgtacaccacgcccgcctgcgctagatcccatctgaagccagcggacatcatacccttgagcgctagctgggctgcatctctaacctccacaggcagcaagcgagcgtggttagcgccgcagtggtttcaccgaccttaaatcgggccgtaagctcgaggactgtcactaatttcttgagcttaaagtgtcagaggggttaataccgcagtgtatgagggtgac

SEQ ID NO: 74172 - DNA, 396 bp, Zea mays
  Clone ID: LIB3079-055-Q1-K1-H3
acagtacttgaagccgatattgttgttgtcggtgttggaggcagaccattgactactctcgtcaagggtcaagttgctgaggagaagggtggaatcaagactgacgcttcctttgaaacaagcgttcctggagtatatgccattggtgatgtggctaccttcctttggaagatgtccattgaagttaggagagtggaccatgttgaccattctagaaagtctgcaaagcaggctgtaaaggcgatcaagggcaaaaagtccggtgaaccagttccggagtatgactacctgccatacttttactcccgatcattcaacctggcgtggcaattttacggggacaacgtgggcaaaaccatcctgtttggagacagtgaccccaccttcagcaagccc

SEQ ID NO: 74173 - DNA, 349 bp, Zea mays
  Clone ID: LIB3079-055-Q1-K1-H4
ggcagaattaagtcaaaatgaatttgtcttgacaaacgagaggttccttgtcccagagatgcttgttcatcccattgatcttggcataaatcaagctgggcttgctgagtgtatagttcgtgctgtacaagcttgccatccatatcttcaacctgtgctttttgagagcatcatcttgacaggtggaagcacactgttccccagattcaccgaaagattggagagggaacttcggcctcttgtccctgacgactacaaggttaagataactcgtcaagagaagtatgtctctcgcaccccctcttgcatgcccaaatttattggtggaaaatgctgaaaaatgaatcat

SEQ ID NO: 74174 - DNA, 152 bp, Zea mays
  Clone ID: LIB3079-055-Q1-K1-H5
gcactcttcctaaaaaaaaaacaaaaaaataaaaaacttatttaaaaaacaaaccattaaactactatgtttagttgttcaatttaactttatgacaaaccccccaatcaatacttacacattcctttaaaacaatcccttcctacaatata

SEQ ID NO: 74175 - DNA, 416 bp, Zea mays
  Clone ID: LIB3079-055-Q1-K1-F7
ggggcttggtgtgtctggccaaggcatgcttgatccaattccagttaaggtactacccccgaagcaatcacttgatcatgcacttgcttcaagcgaggctgacggaggcagtgggaaaaagcgcagtaggggtgggaaaaggaagcgtgagaagaagtttgcagaacaggccatggctgctaaagctgaagaagctgagagatctgtctttaattttatcaacagccatctagtaagccaagaaagttcgaccaccaaagttagaaagggttcatcagttgagaccaatggactcgctaagaaagaagaccgaagatccttggttgcataccgtgaagaagtgaaagaacttaagattccagttgagaaactggaagagatgaagaaccgttactgcaaagacaaggcattctttg

SEQ ID NO: 74176 - DNA, 368 bp, Zea mays
  Clone ID: LIB3079-041-Q1-K1-C3
cccacgcgtccgggctcaccccatcatcagcacgcgaaaatctcccgatcccagctagtcttcgccgagaagatgttcgctcaccgtaagggcgtgaagggcctgggcaagggcggaccgaaccgccaccggaaggcgctccgctacaacatcgagcggatcacgaagccggcgatccagctgctggcgcgcaggggctgcgtcaaccgcatctccgggctcatctacgacgagacccgcggcgtactcaagatcttcctggagaacgtgatccgcgacgccggcacctacaccgagcacgcgcgccgcaagaccgtcacagacatggacgtcgactacgcgctcaagcgtccaggccgcaccctcta

SEQ ID NO: 74177 - DNA, 418 bp, Zea mays
  Clone ID: LIB3079-041-Q1-K1-C4
ctagcctacacacaccgagcgccgtctaaactgacagcaggtcagcagcctagcgaagccaagacatccgccgatctcagatggccgggagaagggtgcgcggcaagagtgccgtggccgtggcggccgtcgcgctgctggcgctgctcttcgcggcgagcgaggccgacgggacgtgcaacgtcgaccggggcacggtgctgaggcagtgcgcgtcctgctcgagcggcgcgccgagccaggggtgctgcgacgcgctgaggaacgccgacttcggctgcctctgcagcaactactggaacaagctcaagaacacgccatacgccagctgcgccaaggccatcccttccgcgtgcaacctcccatacgccaagtgccagtagatggagacatggagtgcgtgacccggacagcgaac

SEQ ID NO: 74178 - DNA, 425 bp, Zea mays
  Clone ID: LIB3079-041-Q1-K1-C5
agcgacttgagaatcgaggagcatattcagaggaatttggtgtgattgccagttacgaaaggtcagggtagaatagctcagcctggattcaaaaatcctcgatgggtggatggtgagctgttggtactcaatggcaagagtacaattccacaccttggaggcgcagagctcggtttcctgtatagtgtacctgagcagagttttctggttctcttcgatcggcttaatcttcccgagtgatgagactcctaaagggagcagactcctcacatgtagattgcatgaacgcgcagaggccggccacagctccaagtgaccgaaacaggtctggggggccgtttccccatcgtcttctgccctctgggcttcctgccaatcctttcttcgcacctactttttaggagctcatgtgcttaactcgtttc

SEQ ID NO: 74179 - DNA, 376 bp, Zea mays
  Clone ID: LIB3079-041-Q1-K1-C7
cccacgcgtccgggctcaccccaccatcagcacgcgaaaatctcccgatcccctctagtctccgcggcgaagatgtcggcgcgcggcaagggcgggaagggcctgggcaagggcggagcgaaacgccaccggaaggtgctccgcgacaacatccaggggatcacgaagccggcgatccggcggctggcgcgcaggggcggcgtcaagcgcatctccgggctcatctacgacgagacccgcggcgtcctcaagatcttcctggagaacgtgatccgcgacgccgtcacctacaccgagcacgcgcgccgcacgaccgtcacagtcctggacgtcgcatacgcgctcaagcgccagggccgaaccctctacggcttcg

SEQ ID NO: 74180 - DNA, 283 bp, Zea mays
  Clone ID: LIB3079-041-Q1-K1-C8
cccacgcgtccgcccacgcgtccgtttacacactaatccaactcaacacatgtggattggggtcaatactaaattacccaaacaaagcctaacagggaagtcaccagtggcaaattatgtactgatatttataataatatactcaatcctgatgggttgtgcccaataacatacaaaggtggataattgaggtcactggtgcggcgagacaccctatacgtctgcgagacctaccagctgcaggttgacttacgtgagcattatcctatggatgcacctcatg

SEQ ID NO: 74181 - DNA, 328 bp, Zea mays
  Clone ID: LIB3079-041-Q1-K1-D1
aacacgcgtccgcccacgcgtccgtcttaacccaagccctcaccatgacaagctggggctttccttgccgaaaggcgctcagcaagatcgctggcaatacgctgcagatggaactcgtcaagtggcaactcaacatccctgctggattcaagcacatggtctccaataacctacaaacgtgggtaattgaggtcactggagcagccggcacggtttacgccacccagacctaccagttgcatgtagacctgcctgagcattatcctatggaagcaccacacgtcatcttgctcaatccagtaccaatgcatccacacatttacagcaa

SEQ ID NO: 74182 - DNA, 422 bp, Zea mays
  Clone ID: LIB3079-041-Q1-K1-D10
cgcacgcggagaaaattccgaagcggaagaagttgaaccgacaggtgagagagaaagagataggagagacgaggccacgactccacgggggaggcagggagagaaggtgagagaagatgcgttgcgccgccgccgcgcttgcggtcgccctcatcgctgtcgttgccggcgcaaccgcgccggggtcgccggccgcgggcacgtgcgcgcggaggggtgcgctaccgttcctcgacgccgtcggatcccgctgccccttcgtccggatcgagccgtccccgcctctcgaggtgagaggagaggctgtggatactgagttgaaccttcgaaggaggggtgcttcatactccattctcttctatgctgcatggtgtcctttttcgagcaaatttcgaccgatatttgaaactgtcagcactatg

SEQ ID NO: 74183 - DNA, 427 bp, Zea mays
  unsure at all n locations
  Clone ID: LIB3079-041-Q1-K1-D11
accgcatcggaactaggaaggcgaagccgaaggcgcggcgcggcgcggcacggatcgagcgatggcggtggcccctcctacggcggcggcgctggagcagctaagcagcagcaagatgttcgacggcttcaatctccgcttccgccaccagagcgccacccttggctgcgccatgactttctccatctacctgcccccgtccccggcgtccaaccttcccgtgctgtactggctctcgggtctcacctgcaccgacgagaatttcatcataaagtccggcgcccagcgcgccgccgctgcccacggcatcgccctcgtggcacctgacacctncccacgtgggttaaatattgaaggagagtcagacagctatgattttggtgtgggtgccgggttttatttgaatgccacaaatgaaaagtggaaa

SEQ ID NO: 74184 - DNA, 419 bp, Zea mays
  Clone ID: LIB3079-041-Q1-K1-D12
ccttaacatccttgttgcaagcggcgccagcttgctcgcgctctctcgcagctgctacgctaaagcaagtctagtctctagaggaggaggcggagggggaggccatgggcaaggacgacgtggtccagagcggcgcgggcggcggggagttcgccgccaaggactacacggacccgtcgacggcgccgctggtggacgcggcggagctgggttcgtggtcgctgtaccgcgcggtgatcgcggagttcatcgcgacgctgctgttcctgtacgtgacggtggcgacggtgatcgggtacaagcaccagacggacgcgtctgcgtcggtggccggggctgacgcagcgtgcggcagcgtgggcgtgctgggcatcgcgtgggccttcggcggcatgatcttcgtgctggtctactgcacc

SEQ ID NO: 74185 - DNA, 344 bp, Zea mays
  Clone ID: LIB3079-041-Q1-K1-D2
cacacaacaaccacactcttgcaccgagctagcagccaagatggcgaccaaacacctggctctttgcctccttgttctctttagcataggcatgggcatggccaccgctgctgcaaaccgcaaactgggttatggccccgggggaggaggtggcggtggtggtagcggtggcggtggaggcggtggttacggaggaccaggctatgggtccggatcagggtatggtgagggcggtggcagcggaggtgctgctggagggtatggacatggtggtggcggcggcggcggtggtggtgagggtgcgggagctggtggctctgggtatgggtccgggcaaggatctg

SEQ ID NO: 74186 - DNA, 431 bp, Zea mays
  unsure at all n locations
  Clone ID: LIB3079-041-Q1-K1-D3
cgcacgcgtgcggctcccctatcccctgcctgctgtgttcactaacccacctccgccccccgttccgggtccccctccccgtcagaaggttccccagatttatagcccggagtagcggcggcgacggggcatgcgctcggagcccaaaccaggttacaacgagagcaaggccatccctgattccctgatgccttcttccttgagaaggcctccgcggaggcgttcatggagcgagtcgagtcggtagtgggcgaggtattcaacatcgtcaggcagtggcaaactcagcagcagaagcaggtccaggagttccaggcactacacgacacacacttggctccagatgagcattcatagtatntcgtcttccatgtcaattaacctataaactctttaataatggacgtctcgatgatgtggtatcatccatg

SEQ ID NO: 74187 - DNA, 424 bp, Zea mays
  Clone ID: LIB3079-041-Q1-K1-D4
cacacgcgtgcggctctcctataccctgcttgctgtgttcactaacacaactcagctggctgttccggttcccgctctctgtaacatggttatgcacatgtatagccctgattcgcggcggagactgggcatgcgctcggagcccagaccaggttacaacgagagcaaggccatccctgattccctgatgccttcttccttgagaaggcctccgctgaggcgttcatggagcgagtcgagtcggtagtgggcgaggtattcaacatcgtcaggcagtggcaaactcagcagcagaagcaggtccaggagttccaggcactacacgacacacacttggctccagatgagcattcatagtatttcgtcttccatgtcaataaccctataaactctttaataattgacctctcgatgatgtgttatc

SEQ ID NO: 74188 - DNA, 425 bp, Zea mays
  unsure at all n locations
  Clone ID: LIB3079-041-Q1-K1-D7
ggggccgttcgggctgtgggtgctggctctccgccaaccgcaaggagagaaccgccgtgttcttcagggtgttcaagcccgccgccggcagcgacaagcccgtggtgctcatgtgcaccgaccctaccaagtcgtccctgaacccgaacctgtaccgcccgacatttgcaggatttgtcgacacggacatctcgaacggcaagatatccctgagaagcctgatcgaccggtcggtcgttgagagcttcggagccgggggcaagacctgcatcctctccagggtctacccgtcgctggccatcggcaaggacgctcgcctctacgtgttcaacaacgggagggcgcacgtcaaggtgtcccgtctcaccgcgtgngagatgaagaagccggtcatgaacggngcctgaagatcttgaattaatata

SEQ ID NO: 74189 - DNA, 189 bp, Zea mays
  Clone ID: LIB3079-041-Q1-K1-D8
cccacgcgtccgaataaatgaaatctgcaaatccatcatttgttagcaatcttctatctaaatttccggtgggttttgtttcctacatcagaaaaaacttgattccatacgctgtaccgaccttggaaaaaaactgttcgacttcagaggataattgtaaaatggctattaatgtgaacaagtccatgc

SEQ ID NO: 74190 - DNA, 430 bp, Zea mays
  Clone ID: LIB3079-041-Q1-K1-D9
tccacaagcacctgctatagttgtgtggtgcaaacaccaaaatgttgcctgccaaagtgtcatttgttttcctgatagtgtactgcgcagtaacattttcgctaggtcagatagctgttggcgaggcatgcacagtggatcagagggacaagatcacaacggactgcagagagttcatcaagctgaaaggccccgtcacagccccgtcgtacaccgacgactgctgcgtcgccataagagcggtgcccaatctcgacatggagtgcatcattcgcctgctctccaataaacagaagaagaagtacgacgtggacaagatccggcggctcggcagcgtcctctgcaatccacatccggtgatgacgtaaaatggggtgtggcagtagtttctgatggagtgcatcgcgtcaacaatatggagcttgaacta

SEQ ID NO: 74191 - DNA, 420 bp, Zea mays
  unsure at all n locations
  Clone ID: LIB3079-041-Q1-K1-E1
ttntcacaatgattctacattgtcatttttccagctatttatcatcggctcttgtgaaggtgcgtggcctatgttgggtgtataaagagtctaacttaatatatccgttctttgcagtcgcacacttcatgtgacgactggtatattatgctaatatatacgtcttcctctcacacgccatttctcccttttgacatattgaagtaaaacctgctagccacttggaggatccacagattatatgatgcgctataaaagtactctccgtgttgaaatgtttagtctccatcctcggtgcataacacggttttgctggacagtactgtgcggaagagtacaatagacataagcgatggtattccaagcagatggcttttgggtatttcatagtctgacaaatttcattttcctgttaataaa

SEQ ID NO: 74192 - DNA, 427 bp, Zea mays
  Clone ID: LIB3079-041-Q1-K1-C2
ttcacctccaacaaaacacatcctaatcgactcgcgaccccgtttcccggagagccgcgacggtgcgacgccgaactccctaaccctaagtccctaagcgtaggcggcggggggcggcggtgcgaggcaagctgcacagcaacacgggccacgggcgcggcctccgcctccgcctccacgcttctgctgctaggctgcaagggcggcggcgcggcgcggtgggcggcggacagctggccaggtccagcccagtagtccaggtgacgaggtccgcactccgcaacggttctggcgttctgcagctgaggatagacgagagaagaagtgaggaattataatagtgatttacaaggcaacttgaaagacagcagggttgcatcccacaatgtcagctcccaacagtgatagcaacatgcagcagctagtc

SEQ ID NO: 74193 - DNA, 411 bp, Zea mays
  Clone ID: LIB3079-041-Q1-K1-A7
actggatgtaatagtaatagtagcattttgcctagaatccgctagccatatccagggagtaattacactcgtactaggtgcctgtgacctgaaggtgtccgcctgcctagacacaatcaggatatttgatgcatccaactatctacattcaacgggagtggggcttatgcagacgggctaatcatggtcgagttatacatttagacaggtgatctcacagtgacatctcttgaaacttgagaggcttcatatgggccatgtaacacatgtctaagcggaaatggaccacttcgctttaggcgatagtgcttacatagttaagcccaataagatactcatgacagatagtccaaatatctgattcagggcatccttacacgccgtgacatgaacacgttacttgttctcaag

SEQ ID NO: 74194 - DNA, 191 bp, Zea mays
  Clone ID: LIB3079-041-Q1-K1-A8
gtcctgccacagcaagggctgctcgcatttgtaaattggccgttaaaatagacaatcttgacctgcattagatgatatgatgatgatatgaggaataggagaggcactcaagtacttgtttgccatctatgccaatgttttacctatatgtctgtatcaatgtttcagttaactgagatgagattatgctt

SEQ ID NO: 74195 - DNA, 221 bp, Zea mays
  Clone ID: LIB3079-041-Q1-K1-A9
cccacgcgtccgaaaaaaaaaaataaataaaaaaaaaaaaaaaaaaaaaaaaaagggggggaagatataaaagaaaaaagaaaaaagtacgctagcattcgtggtactaggttttctatagtgtgacttaaattgtatttgttggctgtatttttacatcgttgagactgggagaaaccctgtttgtaccaattttattggaattgcactacatgggacct

SEQ ID NO: 74196 - DNA, 355 bp, Zea mays
  Clone ID: LIB3079-041-Q1-K1-B1
gcggctggctgtaggagagaaaatatcatttagcctataatcctggagaaataccagagggtattctctaatcgttctgggaacaaatagactgaatatatgctcttgcctagacacaataagggtgttgaaaactttgaactatttactattatcgggagagggtcatttggagaggggcgtctcattggagagtaaacatctaataagtgtgtctcacagtgtaatctctagaaacctgtgatgcttcgtatgggccatgtagtacatgtcaaagctgaaatggaccattttgcttaaggcgatagtgcttacctagtttaagctctattattcttctcaagaccaatagttc

SEQ ID NO: 74197 - DNA, 397 bp, Zea mays
  unsure at all n locations
  Clone ID: LIB3079-041-Q1-K1-B11
cccacgcgtccgctgcttcgtactgtactactccagggaggatgctgaagatgctgtgaaatacatcagtggaacgatgcttgacgatcgtccaatccgtgttgatttcgattggggctttgaagaaggcaggcaatggggccgtggacgaagtggtggacaagtgagagatgagtaccgtacagattatgatcctggtagaggtggttacggtaagatggttcagagggaactagaagcacaaagagaactagttgactatggtggatctttccaaccaaatgcaccancttcctatgagagaggtgagcggaagagaggatacggggactctcattggaatgacagangagattaccagcggaaacgctaccggagcagcgatgaccggtcagca

SEQ ID NO: 74198 - DNA, 424 bp, Zea mays
  Clone ID: LIB3079-041-Q1-K1-B12
ggcttctagcctctgtccaagccggcagtccgccacccgcgaggccgcgaccggcgaccgcccgcccctgacgtggtgactgcgtcctcctccgctctccgtgcgccaccctgaagcggtgaggcgaggacctccaggcaccgccctccctggttcggcggctccctcgaggccttcctgcccaccggttcagcagctcccgatccgcacggccaaaggccgattcgcgctcctccagccttcctccgcgtccaacagcaagtgaaaaacttcaacccaagaatggcgatgtcttggacaagagggttaaagcatggtgttgttccgaggcatgccgctcaattggtagagagcagaagccttgcaattgcaagcaaggcgaagaagggtggaaaggctgatgctggcaaaactcctgctctca

SEQ ID NO: 74199 - DNA, 422 bp, Zea mays
  Clone ID: LIB3079-041-Q1-K1-B2
caggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgcttgtgccggccgccatcgcgctggcgctcatggcggccgggttcgtcacctccggcggcctcggcgtcgctgcgctgtccgtgttctcctggatgtacaagtacctgacgggcaagcaccc

SEQ ID NO: 74200 - DNA, 393 bp, Zea mays
  Clone ID: LIB3079-041-Q1-K1-B3
gacagagacttcatctaccattcagttagctatgttataataaatggatgatccctgttgaacgaaccatgtctcgctgtccttttcgttagctggggtggtgtgtccctggtctcatcccaatactgaatctgtagcgtttcttggtcgtgcaggatcatttcaagaagaagcccagcttcccgataaccctcaagtacatcgacccgacctacattatccgtgccctccggtcgaatgcttctgacaacgtctactgcactcttgtggcccacagcgccctccatggcgccatggcggggtacaccggcttcactgtcgctccggtcaacggcaggcacgcctacatcccgttctataggatcaccgagaagcataacaaggtggtgatca

SEQ ID NO: 74201 - DNA, 427 bp, Zea mays
  Clone ID: LIB3079-041-Q1-K1-B4
gaaccgcacaggggggacacccggactcagagagagagagaggggcattcgcccgtgcgaattctctcgcctcgggctgctcctcacctgcctgctcggctgctcgccagaccaaccacagccgtcggcgctgcagaccgcggcgggcaggatcagcggtgcgtagcctgcccatttcgcgaggaccatataattccaagaccctgatgatggccacaactgcttatatcgatgattcctgctcggaggttattgatcccccgaagactgaggtgctggatgctgctgaactccctggtgaccatactcagaacccaccaaaaccgaatgttcgggtgtctagcagcgtgcgtgaacttctggaatgtccagtctgtatgagtgccatgtatcctgctattcatcagtgctctaatggtcatacatt

SEQ ID NO: 74202 - DNA, 430 bp, Zea mays
  unsure at all n locations
  Clone ID: LIB3079-041-Q1-K1-B5
gctggatgttggagagaaaattacaagatgccgaagttcctgtagaagagcaaaataatattcttaagcatttggagaaaaaagagactgaatatatgcgcttgcagagacacaagatgggagttgaagattttgaacttctgactattattgggagaggtgcatttggagaggtgcgtctttgtagagagaagacatctaagaatgtttacgcaatgaaaaaactcaagaaatctgaaatgcttcgtaggggccaggtagaacatgtcaaagctgaaaggaaccttcttgctgaagttgatagtgcttacatagttaagctctattattctttccaagacgaagagttcttatatctcatcatggaataccttcctggcggngacatgatgactntacttatgcgcaaggacatactaacagaagatga

SEQ ID NO: 74203 - DNA, 326 bp, Zea mays
  Clone ID: LIB3079-041-Q1-K1-B6
gcggctggtatgttggagagaaaaccacttgttgacgtagctcgtgttgatgagctacctgggattattaagcatttggtgagacaagagactgaatatagctactggcacatacacagcaggggcagcgtacactgtgaagtgcagactatgattaagcgaggtgccatgataacggtgcttaatgggcataaaggtcacaaccttcagtgggtacacgctggtgctgctcaggctgatcctggtccgtaccgtgatcgcgctcacaggtgtcacacctgtgctggtgatcttcagcccagtgcttgtgcctgacatcatttagc

SEQ ID NO: 74204 - DNA, 420 bp, Zea mays
  Clone ID: LIB3079-041-Q1-K1-B7
gccgctggcgctgcagggtgccgtgccgcaagtccggcggggtgcggttcaccatcaacggcttccggtacttcaacctggtgctgatcacgaacgtggccggcgcgggggacgtggtgcgcgcgagcgtcaaggcggccagcaccgggtggctgcccatgtccaggaactggggccagaactggcagtccaacgccatcctcgtcggccaggcgctctccttccgcgtcaccgccagcgaccgccgcacctccacctcctggaacgccgccccgagcacctggcagttcggccagaccttcgagggcaagaacttcagggtctgatgcatgggatgggatgcgatgggatgggacttgggagaagaagccaaaactcttttctttctttctttctttcttcttatacgtgattattact

SEQ ID NO: 74205 - DNA, 395 bp, Zea mays
  unsure at all n locations
  Clone ID: LIB3079-041-Q1-K1-B8
gctgcagtggcctatcgaggaggtggaggcgctgagagaaaagtcggtcactctcaagaacaggttaatcaaggcaggacatcacgtcgaggtgaccgggatacaaacggcacaggctgacgtggaggtgagcttcgaggtgtcgccggcggccctggccggtgccgagacgctggacccggcgctggcctacgacgcggagaagctgtgcggcgtgaagcgcgcggacgtgaggggcggcgtggggccgttcgggctgtgggtgctggcctncggcaaccgcaaggagagaaccgacgtgttcttcagggtgttcaagcccgtcgncggcagcgacaagcccgtggtgctcatgtgcaccgaccctaccaagtcgtccctgaacccgaacctgt

SEQ ID NO: 74206 - DNA, 429 bp, Zea mays
  Clone ID: LIB3079-041-Q1-K1-B9
agcactcattccagatttataccgtggaaaagttgctctcgatgttgctgaggcacaacatctgatggagggtctcgactggcagggtgcagtcaaggatatccaggcttcagttaaatggctgaagtcaaatggatcacccaaggttggtgttactggctattgcatgggaggtgctttatcaattgcaagtggagttttagtcccagaggttgatgctgttgttgctttctatgggacaccatcttctgagcttgctgatccttctaaggctaaggctcctatacaggctcatttcggggagcatgacagttttgttggtttttcagatgtcactgcagccaagtccctggaggagaagctcaaatcttccgggataccatatgaagttcacatataccctggatgttcgcatgccttcatgaacac

SEQ ID NO: 74207 - DNA, 315 bp, Zea mays
  Clone ID: LIB3079-041-Q1-K1-C1
ctgccagcgacttgagaatccaggaccatattcttaggaatatggagtgattgtcactgcgaaacttaccatggaatagcgcaccctgcattcaaaaatcctctatggcccgatggtgatctgtaggcactcaatggcgcgagtacaattccacaccttagcagctcacagctatggttcctgtaatagggtaccttaacatacttttctgcgtcccttccatcggcttactcttacccagcgacgacactcctaaagggatcagacttactacatctcgattgcctgaacgctcagacgcccgtcacaagtcca

SEQ ID NO: 74208 - DNA, 268 bp, Zea mays
  Clone ID: LIB3079-041-Q1-K1-C10
cccacgcgttcgccgctggctagctagctagttgagtcatttagcggcgatgattgagtaataatgtgtcacgcatcaccatgggtggcagtgtcagtgtgagcaatgacctgaatgaacaattgaaatgaaaagaaaaaaagtactccatctgttccaaattaaaaaaaaaaaaaaaaaaaaaaaaaaaactggaaaaaccaagaaaaaacccaaataaataaacttgcaaaataataacccctttaaacagctggcgtaatcccaa

SEQ ID NO: 74209 - DNA, 429 bp, Zea mays
  Clone ID: LIB3079-041-Q1-K1-C11
gtcatcggccccgctgggagcggcaagtcaacttattgctccagtttatacgaccattgccagaccgtgggaaggacaattcatattgtcaatcttgatccagctgctgagcacttcgactatcctgtagatatggatatcagagagctgatttcattggatgatgttatggaggagattgggttggggccaaatggcggtctcatctactgcatggagcaccttgaagacagcttggatgattggtttgatgaacagctagagaactacctagatgatgattatcttgcgtttgattgccctggccagattgaactcttcacacatgttccagttctgcggaactttgtcgagcacctgaaacgaaaaaatttcaacgtttgcgcttgttaccttcttgattcacagtttgtcagcgatgtaacaaaa

SEQ ID NO: 74210 - DNA, 300 bp, Zea mays
  Clone ID: LIB3079-041-Q1-K1-C12
gtaccattgcacctatcatgttggttgcagggttagcgatagatttcattgtcttttggagattgcaatctatatatctagactaggaactaacatgtactagattgtattgtcatagctgcttctgtgttggaggacgtttgtggatctagagggtgatctgttgatcacaatgccaactctatggtgtttacaagaaaactaatctactgcatggaacaccttgaatacagcttggatgataggtttgatgaacagctatagaactacctagatgatgattatctagagtacgattgc

SEQ ID NO: 74211 - DNA, 389 bp, Zea mays
  Clone ID: LIB3079-040-Q1-K1-G8
cccacgcgtccgcccacgcgtccggagagcgctgatgttataattctggacgacaacttctccacgattgtaactgttgccaagtggggacgatctgtttacatcaatattcaaaagtttgtgcagtttcagctgactgtcaatgtagtggcactgctagtgaacttctcttcagcctgctttacaggaaatgcaccactaacagctgttcagcttctttgggttaacatgatcatggacacccttggcgcgcttgccttagccacggagccacctaatgatgacttgatgaagagagagccagtaggaaggacagggaaattcattacaaatgtgatgtggaagaacattcttggtcagtctttctaccagttctttgtgatgtggta

SEQ ID NO: 74212 - DNA, 368 bp, Zea mays
  Clone ID: LIB3079-040-Q1-K1-G9
ctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactggtgtcacttgcattttaccttttccatcgcttgttattgtgagtggtcctatatc

SEQ ID NO: 74213 - DNA, 353 bp, Zea mays
  Clone ID: LIB3079-040-Q1-K1-H1
tgcattcgcgatagcaattggtgctatcagtctcatactctttgctcagttgattggcaaaatgcagacatacctgcagtctatcagtaaaaggcttgaagagtggaggctgaggcaaagggacatggatgagtggatgagacaccatcaactcccatctcatcttcaagaacgtgtgcggcggttcgttcaagtcaaatggcttgctacaagaggagtagaagaagaatccatcttgcaagctttgcctgctgatattcgtcgggatgtgcagcgtcatctttgattggacctcgttagacgtgtaccttttatctctgagatggataaccaacttctcgatgccatctgtg

SEQ ID NO: 74214 - DNA, 333 bp, Zea mays
  Clone ID: LIB3079-040-Q1-K1-H10
tcgtcaagccgagaacggtgtcaaggctgcatcagctggcgcagacggagccagccgacttgagctccaggaaagtagcacgggcaacaactgccacgacctatccttcaaaacgatcctcgagacgacgactacgaccatcgcagcggacgcgtgcgatgaagggaacgaccaagacgagtgcgtgcatacgcagctggttgttgacgcgcaccgtcgctacttctactcgcagcacaagggcgagccgcgaccgacagcgacgatgacggtgcatgccgccgctgcatgaaatgatgagcggcagacgagtgattaaatgatggaccatcc

SEQ ID NO: 74215 - DNA, 353 bp, Zea mays
  Clone ID: LIB3079-040-Q1-K1-H2
tgcattagcgattgcgaacgcagctctcgttcgcatactcatggctcaactggttggcaaaatgcacacatacctgcagtttatgagtaaacggcttgcagagtgatggctgaggcaaagggacatggatgagtggatgagacaccgtcaactcacatctcatcttcaagaacgtgtgcggccgttcgttcaagtcaaatggctcgctacaagaggagtacaagaagaatccatcttgcaagctttgcctgctgatattactcacgatgtgcagcgtcatcttatgttggacctcggtagacgtgtaccttttatctctgagatggataaacaacttctcgatgccatctgtg

SEQ ID NO: 74216 - DNA, 346 bp, Zea mays
  Clone ID: LIB3079-040-Q1-K1-H3
atgaacggctcgaccgacgcactccgtgcattcggcctcagctatcggggctgtgggctatgacaagcgcgttgagatcacagtctgtgaggaacctgactttgtggacctccatggcaggcttttgcatggcctgttcaggtcccagaacgactatgatctggatgttacacggtgcactatcatgtacgagctataccacaatgatgttgactactaagttctatgcgagtgaagcttgtgcatctatgctctgaagattgtcgtcagcacctgcggcagtaccaagctgctggtgacaatttcaaggatgctagaacttgcttaaaagcgtgctatgcctctt

SEQ ID NO: 74217 - DNA, 418 bp, Zea mays
  Clone ID: LIB3079-040-Q1-K1-H6
aaggacgctctgcacgtactattcatcttccattgttgctttgctttgctttgcttaccggcaaccatggccagcactcgtgcagcagcaactctccttttgctcctcgcgctcgccggcacctcgtcggcgcagctgtccacgggcttctactcctactcgtgccccggcgtgtacggcgccgtcaagtcggtgatgcagtccgccatcgccagggagaagcgcatgggggcctccatcctccgcctcttcttccacgactgcttcgtccagggctgcgacgcgtcgctgctgctggacgacacgcccagcttccagggcgagaagatggccaaccctaacaacggctccgtcaggggattcgaggtcatcgacgccgtcaagtccgccgtcgaaaagctgtgccccggcgtcgtct

SEQ ID NO: 74218 - DNA, 362 bp, Zea mays
  Clone ID: LIB3079-040-Q1-K1-H7
cccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgttcatctatcctctgaagattgtcatcaagacctgtggcactaccaagctcctgctcacaattccaaggatcctagagcttgctgaagagctgtctatgcctcttgctgctgtgaagtactcccgcgggacgttcatctttcctggcgcac

SEQ ID NO: 74219 - DNA, 438 bp, Zea mays
  Clone ID: LIB3079-040-Q1-K1-H8
aatcgttgagaaatgctcgaactatgcgatcttgagaagcagcattatatatgggccacaaacaatctctcctgtggcaaaatcccttccgattcagtggatggatggtgttctttcacaaggccaacaggttgagttcttcagtgatgaattccggtgccctgtctatgtcaaagatatggtggacgtaattttgtcactaacaaagacttggttcccagatgatggcaaaaaagtccaggtcctcctgaatgtcggtggtccagatagggtatcaagactgcagatggctgagtctgttgctgttgtccgtggatataaccccagtataatcaaatctgcgtctgcatcatcggttaatcgcggagtagcttctccaccagacatatccatggacatcaccaagctaacccagatccttggtatcaagccaatatc

SEQ ID NO: 74220 - DNA, 177 bp, Zea mays
  Clone ID: LIB3079-040-Q1-K1-H9
ggcttgccttctatgggttggccggctcgatcaatccccatattctgagttaatgtcatccgcgcattgtgagaagctagctgatgagctcacccatcaattctgtagccttctgggccagtcgagggagagcccgatgagtgttgcagtgtcagcttgttttcaaggactaccaac

SEQ ID NO: 74221 - DNA, 355 bp, Zea mays
  Clone ID: LIB3079-041-Q1-K1-A1
gctctgccgcggggtgctcttcgtcccggggctcatgggcgaggacagcccgatgttcgatttcgaggagggcctggaggaagggcggttgtccgaggactgtgacgacggatttggattgcctgggctgaaggcttcagggttggcacagacaccggtggccgagaagaaggtattccctgtgaggttggggaagttcaagaatgtcggaacccatggtgcggtggaaggtggccatgccaatgccaatgccaatgccaatgctaatcccagggtgttgactagggatgaaggggagagtagcagcagcaggttggatggaaggagatgcttctccatgggcacctatcagtat

SEQ ID NO: 74222 - DNA, 261 bp, Zea mays
  Clone ID: LIB3079-041-Q1-K1-A10
ctttaatcgatgctggaaagcccatgcatctcgctgcgttgtcctctctatatatttaagaccttcaaggtgtcaattaaacatagagttttcgtttttcgctttcaaaaaaaaaaaaaaaaaaaaaaaaaaaaaaaaagacaaaaaataataaaagatccaagctaacaagctcttacatgacgacgtcatatctcatgaggtaatgccacctaaaatcaattcaatggtcccatttatacaacgttgggactgcgaaaa

SEQ ID NO: 74223 - DNA, 370 bp, Zea mays
  Clone ID: LIB3079-041-Q1-K1-A11
gcattctcgagcatagcttctctgcctctctctcccctcctctcctctcgtccactcctttgtccaaagcttcgagatggctcagcagcagaaggtggtggtcagggttccaaccatgacagatgacaagatcaagcagaaggccatcgaagctgttgcggacatttacggtattgactccatagcagcggatctgaaggagaacaagatgaccatcataggcgagatggatgcagtagcgattgccaagaagttaaagaagattggaaagattgacattgtgtctgttggacctgcaaaagaagaaaagaaggaagaaaagaaagaggagaaaaaggaagaaaagaaagaagagaagaaagaggagaag

SEQ ID NO: 74224 - DNA, 289 bp, Zea mays
  unsure at all n locations
  Clone ID: LIB3079-041-Q1-K1-A12
cgacgagacccccgagctgatgccgctgagccacgtgctggccaccaagctgggcgcgcgcctcaccgaggtgcgcaagaacggcacctgcgcctggctgaggcccgacggcaagacccaggtgacggtggagtacgtgaacgagggcggcgccatggtgcccgtccgcgtgcacaccgtgctcatctncacccagcacgacgagaccgtcaccaacgacgagatcgccgncgacctcaaggagcacgtcatcaagcccgtgatccctgagaagtacctcgacgagaag

SEQ ID NO: 74225 - DNA, 307 bp, Zea mays
  Clone ID: LIB3079-041-Q1-K1-A2
aaatagatcttatagtccccatggctgttgcatgcatgtaagatgaaaaagtattatagggcttaataaaaaggaagtaactacgattttgagtgtccaaaaaatatacacagatccattcgaaataatgaatcaattgctgatgctagctaaagtaaggccttttggtcaagataagcagcttatgaactggaatcaccatcttattgactgatttgctccccctttattaaaacagccttgctggtattgaatcgctctgcctgcgaatccaatcgctttcgactatcgaatttgctttcagcat

SEQ ID NO: 74226 - DNA, 376 bp, Zea mays
  Clone ID: LIB3079-041-Q1-K1-A3
attggttataatagtagtagtagaagagaaaatagaaaaggcaagccattccagccaccaaaaacacttgtactatgttcctgtgaccttttggaggctttcaacctgtcaggaatcaggatatttgatgcatccaattatctaaatccaacaaatcttggtattatgcttactgtataatcatggtcgtattattttttagtctgttgatatttcactggcataaattgtttcttctgtgctttcatatccactatgtaacccatgttttattgtttgtagagaactacaatttatgctcaagtcaatgctgctcttcgcaaaataagagacacatcagagtttgtccaatcttttgcatcagagcatcttaaga

SEQ ID NO: 74227 - DNA, 336 bp, Zea mays
  Clone ID: LIB3079-041-Q1-K1-A4
ggacgcacaccagcacctgccctcctcgccgtcgccgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaaccctaggcagttcaaggtgccggactggttcctcaacaggaag

SEQ ID NO: 74228 - DNA, 422 bp, Zea mays
  Clone ID: LIB3079-041-Q1-K1-A5
ggaagtccttcagctgaacgtcgggttaatctgtcaagcattagggctcctaagttgggcaatgctcgtacagatgtgaagcctgaccattttgctcgtgaagctaaggagttcttacgcacgaggttgattggcaaacaagtggctgttgaaatggaatactctcgaaagatcagcactgtagatggacagagtgctgctccaacagcaaacatggctgatacaagagttttagattatgggtcagtttttctgggttcaccatcacagactgatggagatgacacatcttctgctccgagctctgctagccagcctggagttaatgttgctgagcttttgctctcacgaggctttgctaaaacatctaaacacagggattatgaggaaaggtcacactattatgatgctttattagcagc

SEQ ID NO: 74229 - DNA, 322 bp, Zea mays
  Clone ID: LIB3079-040-Q1-K1-G7
aaaaaaaaaaaaaaaaaaaaaaaaaatataaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaataaaaaaaaaataaaaaaaaaaaaaaaaaaataaaaaaaaataaataaaaaaaaaggggggcgggatctttgtagtgatataggttagattctctatgactaggagtattattcttttttgagggcctccctaaatgagatagttggtgatgtgaactatcagtgtgagtttggaaaaccctgggtgtgccccttttt

SEQ ID NO: 74230 - DNA, 399 bp, Zea mays
  Clone ID: LIB3079-040-Q1-K1-F12
ccgcggcaggaggcgccggccagcagcgccagaacaaagcttcggcgggcaagaaggtaaagaagggcggtggcagcggcgggagatggccggcggtcaagcccaagaaggatctccagatcaatcgcctcaagggcacccacctgctcaccattccagacttcttcacttctgcggaggcgaacgctttcattgatatcgctgagtcgatgggcttcacgcaccacagctgtttggggccactaacgggtgaggcttacatagacaactaacggatatctgtgacagatccattgcttggtcaagccatttgggaatcaggaataaacaggattcttacagacatcagcgtatctggcaaattagcatcaggactgaatccaaatatcaggttctaca

SEQ ID NO: 74231 - DNA, 337 bp, Zea mays
  Clone ID: LIB3079-040-Q1-K1-F2
cggatcaacgcttattctaccctactatactgttggatgttctttggaagtccagctcaggaggtaaaggatgcaggtcacgaagagcatcctatatgatataaatggagtagcctgtgagcagggagctcacgtcgcatcaggcaataactatatctagggtcatctatacacatccatgtgggaaggattgcgaggcatggctgaaatggatggtgcatgtactagctcgtagcagagcaaggcacggagattatgagagctacaatgtgcttctcagattgacgatgcacagttgactgaggtgaaagagatagcgatgaccagattggaaaga

SEQ ID NO: 74232 - DNA, 222 bp, Zea mays
  Clone ID: LIB3079-040-Q1-K1-F3
aaaaaaaacaataattataccctactttatcatagaaaagatgaaataagaaaaaaaaaagaatataaaaaaaagaaaataataaaaaaagataacatataaaataataaaaaaatttaaaaagttaaataaatttaatttgatgtcagtcgatttctaactgaacgtgctgtcaaaacccttcccttgcttaacttatttggcttacttttgttatggctt

SEQ ID NO: 74233 - DNA, 433 bp, Zea mays
  unsure at all n locations
  Clone ID: LIB3079-040-Q1-K1-F4
gtcatcggccccgctgggagcggcaagtcaacttattgctccagtttatacgaccattgccagaccgtgggaaggacaattcatattgtcaatcttgatccagctgctgagcacttcgactatcctgtagatatggatatcagagagctgatttcattggatgatgttatggaggagattgggttggggccaaatggcggtctcatctactgcatggagcaccttgaagacagcttggatgattggtttgatgaacagctagagaactacctagatgatgattatcttgtgtttgattgccctggccagatngaactcttcacacatgttccagttctgcggaaacttgtcgagcacctganacgaaaaaatttcaacgtttgcgctgtttaccttcttgattcacagtttgtcagcgatgtaacaaaataca

SEQ ID NO: 74234 - DNA, 332 bp, Zea mays
  Clone ID: LIB3079-040-Q1-K1-F5
tcggctggaccgacgcatgcgtccaggcctacgagaaatcctggggctttttaaaagttcaaggaaatcaacactgctggggcagctttggctgatgatgcagaacgatcaatctatgataaatatggagaagcaggtctgaaaggtgctggcatgggcacaggagattactcaaacccgcttgatctattctagtccctggttgaaggattccgtggtatgggtggaatgggtggcggtcttgctgtccgtaacagaccaatgcaaggtgatgacgagagctacactctggtactcaatttcaaggatgcggtgtttggtgtggagaaaag

SEQ ID NO: 74235 - DNA, 395 bp, Zea mays
  Clone ID: LIB3079-040-Q1-K1-F6
ggaaggacgggtgggcttcatatacaaggccaacaacagaacattcagtttggccgttctattcggatcaccctcttactggtgctgagtatctttctgattgtgccatttctcgcctcggcatgacaaggcatgtattgcttcaccggtgaggaacattggggcagcttaccatggtcctgctcgtactacatacagatcatgactggtggtgttctctcgccggcaaatgcagcaaaccaaccatgtctttcctgtgtggtgtggctgctgcatatgtgacaggaaaagaagcacggcggtgaaggtttcaactgtgcaatgcgtgatgctccgataccatgaactcctcaccgggcgcataaccatgctaagatttatcagggttatgataa

SEQ ID NO: 74236 - DNA, 335 bp, Zea mays
  Clone ID: LIB3079-040-Q1-K1-F7
cccacgcgtccgcccacgcgtccgctcaaatactgatctcactgatccagtatggctatggcaaaggcaggcgcgccgagggtctcggcggcccagctggtgactctcgggctatcactcctctgcgctgtcgccggcccggccgccgcgcagaactgcggctgccagccaaacgtatgctgcagcaagtttggctactgcggcacgaccgacgagtactgcggcgacgggtgccagtcgggcccgtgccgctcgggcggcggcggcagcagtggcggcggtggtgcgaacgtggctagcgtcgtcaccggctccttcttcaacggcatcaagag

SEQ ID NO: 74237 - DNA, 413 bp, Zea mays
  Clone ID: LIB3079-040-Q1-K1-F8
cccacgcgtccgcagcaattatcttcgtcggtaagatcggtcattccgcaataggacgatttcaggttcatggatggaattcaaacttgtggggtccctaaatgatttgaaaatgatggtattccatcagcaagcagcccatgcatggacaaacttgcgtgtttcaaagctgcgttacaaggcaatacttcttattacaatactgtaattcagaagacacaaaacacgccacgaaaccacgcgcgtcacgctcatctggaagttgatgcaacgaacctaatgacgtaactgacgccctaccatgcacaacggaaattgagccaggtatgaatctcactgtagctagctctgattggtcagtttattgagacgatccggacgctgctattgacaaactgtcatggggactactg

SEQ ID NO: 74238 - DNA, 428 bp, Zea mays
  Clone ID: LIB3079-040-Q1-K1-F9
gtctctctactttctagtattaattatcaataagttggtttggaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaggggagaaaattttaagggatccaaaattaacaaaccaaaaaaagggggggattatttttaatatagggccccttaaatccatttaatggaccgaatttttaaaccttggggactggaaaacccttgaggttccccactttatacactcttgggcattggaaaattttggaagttgggtaaataccaaaagggccctaaccaaccgcttttccaaacggttgaaaacccaaaagggcaaatggaaccccccttgaaaaggggctttaaccccgaaggttatggggga

SEQ ID NO: 74239 - DNA, 338 bp, Zea mays
  Clone ID: LIB3079-040-Q1-K1-G1
ggttgacatcaaaccattcgcagcagtcttaatgaagttattgcatagtgcagttctggaggaaaggagttctgccgctaaaaaggccttcgcgtcctcttgtgctactgttttgaaatacgctagtcctccccaggctcagaagcttatcgaagatactacgtctctgcattcaggtgggaaaaacgatcagttgtctggtgcaattcttattaaagcctacttgagcaatgcatcggatattcttggtggatataatgcggtggttatccctgtaatttttgtgtcgagatttgatgatgataaagacaccagtgctttatatgaagaactttggg

SEQ ID NO: 74240 - DNA, 357 bp, Zea mays
  Clone ID: LIB3079-040-Q1-K1-G10
gcgctcctggtgttttggatgcaattgctccacagttcatgacaagaaaaatttgggctgttgcgttaccccgtgaagtgcgaactccaaccaggcctcttaagttagagatagctatatatcctgaattacaggcttctaaaccacgttctgtacttaaactatggaaatgtcaaattgagcaaccaaagcttaatcaggctgacccttccattatgatttttgacaaaggaacaaagactagatacaagatcttaccggcctatgaaggtgacaaacagcagcttcaatggttttataatgcatgttggggcatggcccaggttttgaacacggttccagtagcaccagcaaatt

SEQ ID NO: 74241 - DNA, 422 bp, Zea mays
  Clone ID: LIB3079-040-Q1-K1-G11
caattacatctatcccactagtagcatactgcgtccttcctgctatctgtttactcaccaacaaatttattattcctgcgattagcaattatgctggggcgttcttcatcctgctttttgcttccatcttcgccactggtattttggagcttcgatggagtggtgttggcattgaggattggtggagaaatgagcagttttgggtcattggtggcacctctgcacatctctttgctgtgttccaaggtctcttaaaagtgctagcagggatcgacacaaacttcacggtcacatcaaaggcaaccgatgatgatggtgactttgctgagctgtatgtgttcaagtggacaactcttctgatcccccccaccactgtgcttgtgattaacctggttggtatagtggctggagtgtcgtatgct

SEQ ID NO: 74242 - DNA, 140 bp, Zea mays
  Clone ID: LIB3079-040-Q1-K1-G12
cccacgcgtccggaagagcggtaagtataggacagtgactaagctaatacttgtgtctggacctcgctagtggccggtcgaccctggctaggatgcacactcacgcgatgcggtatttgcccacgcgtccgaaactatga

SEQ ID NO: 74243 - DNA, 434 bp, Zea mays
  unsure at all n locations
  Clone ID: LIB3079-040-Q1-K1-G2
cccacgcgtccgaaacaaacaatgtgaatggttcagcgacagatcaggacaatcagtttttgccatgtaacattacgaagcttttatcaaagctacgacttctgcatgaatttcaagacagcagtgagcagacggatcttccttgtcctactgctggatcaccgacattgcggatgtcagcgctcagtgaattgcagaacagtctttcaaactgatgcgctaccatttcgtattggaaaacaaggacaagcggttcggcccagaagtgttttagtactcgagctgcatgcaggcccatttagcacgatctggctatgacttcctacatggcccagaagccgtcgtctactgatcgctccagcttcttcttccttcgtcgccgctgggctggtaacattcattcgcggaccatnctgcctcgatcgaagttagcg

SEQ ID NO: 74244 - DNA, 391 bp, Zea mays
  Clone ID: LIB3079-040-Q1-K1-G3
caagattctactcaaagtccaccgcatactagtggcaactcagattcaacatcaacacaatcattgtcaagctcaaatggagacgctcagtgccgaactgataagattgtcttcaagctttttgacaaagttcccagtgatttacccccagttttgcggtcacagattcttggttggttgtcaagtagccctactgatatagagagccatattagacctgggtgtattattctaacaatatatctacggttagttgagtctgcatggcaagagctttctgagaatatgagcctgcacctggataagcttttgagtagctccactgacaacttttgggcatctggcttggtatttgtgatggttcggcgtcgcttagcttttatgctcaatg

SEQ ID NO: 74245 - DNA, 369 bp, Zea mays
  Clone ID: LIB3079-040-Q1-K1-G5
cccacgcgtccggatcatttgctcgttgattttcatcttctttgcagccaaaagctgaaaaaaactgcagaagttaaaaggcaaacacaattgataagtgccacggaagttggtagagccgatacaaccaaggaaaatgaggagaagagcagcagtgttccagaaatactcaacgcagcatgtagtaacaaggagaaacccaacaaaatcgcaacagacggatgatgccttggctagttgactgggaaaatgagatagcttctggaacggacttcaacttgaattcctgaaatcataagttcgatgtgcgcaatgtcaagaaaccacaattggtcatgggttctctggcattttctcatggaagtgaag

SEQ ID NO: 74246 - DNA, 423 bp, Zea mays
  Clone ID: LIB3079-040-Q1-K1-G6
caggtcattcagctccaaggtgaccagcgcaagaatgttgctactttcctagttcaggtattcagaatcttcagacctggccagctgaatactgttttaccataccgatagatgttcaatctgttaatactgatcgtgcaattattacttgtcttggtaggctgggattgcgaagaaagagaacatcaagattcacgggttctaagggacctgtaaatgcttgtgccctatattgtgtgcctccacatattggggagcttgaagcatcgacagttactagtcattgcttacttatataagaacataagtagtatttgctattgtcaagtgtgccttgcttgatgcaagttgtgttttcgtatcattattattatgcacggtcatcgtacgtgtatggcttgtatgggttattgccaacttaat

SEQ ID NO: 74247 - DNA, 428 bp, Zea mays
  Clone ID: LIB3079-040-Q1-K1-F10
tcgcccacgcgtacgaccacgcgtccggtcatatctagctagtagctccctgaaaagttcactagagaagcatttgagggaggagccatgtctgaggagaagcaccaccaccacctgttccaccaccgcaaggcagaggaggaggaaggcgcctccggcgaggtcgactacgagaagaaggagaagcaccacaagcacatggagcagctcggccagctcggcgccatcgccgccggcgcgtacgctctggtgagaccgaaaaaacccaacctccatccctttggtcgcctgatcgatgcatgccatggtccagctcttgatctgtgtgtgtctgtgcgtgtgcatcgacgtgtggctgcagcacgagaagcacaaggccaagaaggacccggagaacgagcacggtcaccgggtcaaggaggaggtgg

SEQ ID NO: 74248 - DNA, 206 bp, Zea mays
  Clone ID: LIB3079-040-Q1-K1-D4
cccacgcgtccgaaaaaaaaaaaaaataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaatataaacaaattaataaaaaactttaaaaatacaaaattaa

SEQ ID NO: 74249 - DNA, 356 bp, Zea mays
  Clone ID: LIB3079-040-Q1-K1-D5
ggcttggtggtgcatgtgcaaggggttagcagagctgaactcaaacaaaattcaaattactctggtgctctcctcataaaccgcacagcaagtcctcttgcttggtttatggagtgcaaggaccggaccaagcggagttctgtgatgttgccatacacttttctgccaacaatggcaacaaggaaactgagggatgcagcaaacaagatgaaagagatacttggtgactatgatgctattcatgtgagacgaggtgacctactgaagaataggaaagatagatttggagttgagcgaagtcttcatcctcatcttgacagagatactcgccctgagtttatcaagaaaagaatcgc

SEQ ID NO: 74250 - DNA, 440 bp, Zea mays
  unsure at all n locations
  Clone ID: LIB3079-040-Q1-K1-D6
ccgccgctccactccaagtcacacggaggcagccatcgtagcctcgcccgactccgcttcccctgttctttgggcatggagctgatcacaaatgtcaccgagtacgagaagctcgcgaaggagaggctgccgaagatggtgtacgactactacgcctccggcgcagaagatcagtggacgctcaaggagaaccgggaggccttctccagaattctgtttaggccacgggtactgatcgacgtctcccgtatcgacatggccacaaacattctgggcttcagcatttccatgcctatcatgatcgctccttcagccatgcagaanatggctcatcctgatggagagcttgccacggcaagagctgcagcttccgcaggaacaataatgacattgtcctcatggtctacttccagcgttgaagaggtcaactcagttgggcc

SEQ ID NO: 74251 - DNA, 368 bp, Zea mays
  Clone ID: LIB3079-040-Q1-K1-D7
cccacgcgtccgcgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctaccgcggtcggcgcgaagt

SEQ ID NO: 74252 - DNA, 278 bp, Zea mays
  Clone ID: LIB3079-040-Q1-K1-D8
gtaagaggctgccagttctaaactgtgctgtggctatggccctatttctattcatttttaactaaaatttatttagggtcttatcattttgttaagaatcatttggatggtgacccattaccatctctagttgtggctcgttattgcatagaagctagccgacagtggaagatcggctttgtacagggatgttcgaaacttcgaatcaggttatttgtggtgtatatataatgccaaattaccaatcacaagaagtaaaaaaaaagtcattcactgtc

SEQ ID NO: 74253 - DNA, 340 bp, Zea mays
  Clone ID: LIB3079-040-Q1-K1-D9
gtccccgagctttttatagaggtcttgttccatctttgcttggtatcgtaccttatgctggaattgatcttgctgtatatgagactttgaaagatgtgtcgaagacatatatactgaaggacagtgatcctggtcctctagtacagcttggttgtgggacggtctctggagccctaggggcaacatgtgtttaccctttacaggttatcagaacaagactgcaagctcaacaagccaattcagaatctgcctatagaggaatgtctgatgtcttttggagaaccctacatcatgagggtgtttctggattctacaagggaattctaccaaatctccttaa

SEQ ID NO: 74254 - DNA, 365 bp, Zea mays
  Clone ID: LIB3079-040-Q1-K1-E1
tttgagcattcagaaacacaccaagcgaagcgcactagcaacgacctaacaacaatggctaccaagatattagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggt

SEQ ID NO: 74255 - DNA, 421 bp, Zea mays
  Clone ID: LIB3079-040-Q1-K1-E10
tgtagaagccctttggaatcccttcttcaagttattggtatcttcaattatgactgggtatactctgcgaaatgctgaatacaggctttcttttgaaagaaatctagaactgcctgaagaaggtgtagaatgcctaaaaagtgatgtcactgaagataatcatcataacatcaatttgggaagacctgtcactatttttagattatccgaagaagacatgcctcaggaccctggaaaaaccgatgaagcatcatcttatgaaaatatgggagaagagcttggtgacttaacaccacaggcagaggagtatattattcagatgcaatctcatttgaatgccatgaaaaaggagttacatgatctcaggagaaagaattctgccttacagatgcagcagtttgttggggaggaaaaaaacgac

SEQ ID NO: 74256 - DNA, 167 bp, Zea mays
  Clone ID: LIB3079-040-Q1-K1-E11
aatgaacatacatgacacaagcgtgtcttgactgcacaaactacatcctaggagctaagctacttcaagtcaaaagtctatgacattatgcgtacatgcatgtcactcgcatggactagtataaccgaatcatggctgacctttgtctacacaacaacaaggactac

SEQ ID NO: 74257 - DNA, 227 bp, Zea mays
  Clone ID: LIB3079-040-Q1-K1-E12
ggagattggtgctcgggtcaataatgatggtgattgtgacggagtgccctgcaaaataattaataattcgtgtgaaaaagttgattatatggttcctgacaaaaaaaaaaaaaaaaaaaaaaaaacaaaaaaaaaaacaaaaaataaacaaactaaaaaaaaaaaaaaaaaaaaaaaaaagacaaagaaatactgcatttacgaaaaaaaacgaaaaaaaggcattt

SEQ ID NO: 74258 - DNA, 104 bp, Zea mays
  Clone ID: LIB3079-040-Q1-K1-E2
atccatatggattgaaaataaccgaacaagcccttggagggtagatcggaggagtcgtgcagcagtagcactacgtcctgtgaaaagagtatcatctcggtttt

SEQ ID NO: 74259 - DNA, 407 bp, Zea mays
  Clone ID: LIB3079-040-Q1-K1-E3
attgagcgctggaagaacaagcgacaactaaaaagaaacggagggagtatctgctaaatcgcaaaagaaactcaggtgcccacacaaagtgctaggtttgctattcttcacagttctgatttttagcatttaaccaaagcgtttgtgtatccttaaaaggagagtgttttccaatgcttgaacttttgtagtaagggtgtgctacatcaaatccagcgtgtttaggatactgctacatacatcaaatcctaaagcctcctagaatctgtcattaggaatttttagagatgctgacatacttagatttttctctctttttggggacattcttgatcaaataagtaattattgcttgtgtagtagactagagtgggctggattaacccacacttaaaaaaaccggaagg

SEQ ID NO: 74260 - DNA, 403 bp, Zea mays
  Clone ID: LIB3079-040-Q1-K1-E4
gggagtcttcgttccaacaggagactctagtcggcgtcgaggtccagaccatgaacgggcacctgtaccccaaaccactgacccaggtgcgccccgagccgtcgtcctggcagctctcccggaggcccatcgaggaaccgcgcggggagatatggcgcttctcgaggaggccgagcgaggacgggacctctgatgccatggaagtgcacgccgtcgccccgagagagagcaagaaggcggcagaggtccgcggggacaggttcggcatcccgcggtgcatcgaggtgatgagcgccatggcggagctgtcgccggtggagaagtcgctggcgcccgacgtcttcttggacgcgagcaaccgggagatcttcctctcgctgagtgtagatattaggccaatctg

SEQ ID NO: 74261 - DNA, 425 bp, Zea mays
  Clone ID: LIB3079-040-Q1-K1-E5
cccacgcgtccggggaatcatcagtacagaatgcaaagaagtggtgagcgagtatggagagatgatccttgagttgctcatatcgcagacaagcccacagaaagtgtgcactcagattggtctctgtgtatatgatggtgcccattctgtcagcaatccaattgaatctgttgttgagaaacagaagcgtggttctgatcttttctgtactgcttgtgagatggctgttgtctggatacagaatcagctccgtgaaaacatgacaaaagaactcattttgaattatgctaatcagctctgtgagcgtctccctagccccaatggcgagtcaactgttgattgccatcagatctcacagatgccaaatcttgcattcaccatagcaaacatgactttcaccttaacaccagagcagtacatagtga

SEQ ID NO: 74262 - DNA, 392 bp, Zea mays
  Clone ID: LIB3079-040-Q1-K1-E6
cgccatgttcgcgggtctcggcgagctgcccgagtgcgccatggtgttccggcggcacgccggcgacgggatttcggtggcaggccgggtgaagtgaagtgaatcctgaattgaaggtcctgacatgtgggccggggcaggccggactccaataaaaaccagataaactcatgtagagctccttgatctatctacttttggcttttcttccgttcctcttgtcatcacctagcttttcttctttcatccttctctgattggttgtttatacacaaacacagacacggtagcagatagaaaaacttggcatttttgcgtttgcacagagttgattcggtggacatcaggggtgggtttgagaaggacacgcggattttttttttctctcaatg

SEQ ID NO: 74263 - DNA, 363 bp, Zea mays
  Clone ID: LIB3079-040-Q1-K1-E7
ggaagaagaagcatcggcagcatgtctgaggggactgccaactgcgtggacatcctgatcgccatcatcctgcctccgctgggggtgttcctcaagtacgggtgcgggcacgagttctggatctgcctgctcctcaccttgctcggctacatccccggcatcatctacgccatctacgccatcaccaagaacacctagctagtcatccttgccgactacgatccatgtctatgtatctgtgtctgatcatatgcctgatgccgacttgtgctgtatgtcgttgcttgaattcagtcgagttcctggtctgctaccgtacccaccccatgcatcatctgtcaccgcgacgcagtaatcatagta

SEQ ID NO: 74264 - DNA, 337 bp, Zea mays
  Clone ID: LIB3079-040-Q1-K1-E8
cccacgcgtacgaccacgcgtccgcctacgcgtccgaaaaaaaaaaaaaaaaaaaaaaaaaaaaaaaaaaaaaaaaaaaataaaaaaaaaaaaaaaaaaaaaaaaaaaaaaaaaaaaaaataaaaataaataataaataaaattaaaaaaataaataaaaaaaataaataaaaaaaatataagctattatcaagatctactaaatagtaatattttggtactattatcaatgtctatgtatctgtatatgctcatattcttgatgctgaattgtactgaatgatgttgcttgaattcaatcgtgttactgatgatattgcctattcaatagatgcat

SEQ ID NO: 74265 - DNA, 150 bp, Zea mays
  Clone ID: LIB3079-040-Q1-K1-E9
aatgaatctatattacagcataatgtatagactagagaaagtacatcctaggagtttacctcctttcatttaaaagttgctgtctttatctgtacatgcatgtagctcggctttttttgtataagtgagtcatggttgatctttgtctac

SEQ ID NO: 74266 - DNA, 329 bp, Zea mays
  Clone ID: LIB3079-040-Q1-K1-F1
cccacgcgtccgagagatcctggtgctgaacaaaagttcaaggaaatcagcaatgcttatgaggttttgtctgatgatgagaagcgatcaatctatgataaatatggagaagcaggtctgaaaggtgctggcatgggcacaggagattactcaaacccgtttgatctattcgagtccctgtttgaaggattcggtgggatgggtggaatgggtggcggtcgtgctgtccgtaacagaccaatgcaaggtgatgatgagagctacaatctggtactcaatttcaaggatgcggtgtttggtgtggagaaagagattgagatcaccagatt

SEQ ID NO: 74267 - DNA, 317 bp, Zea mays
  Clone ID: LIB3079-040-Q1-K1-D2
gccacgcgtacgggtatacccaccactcgatgcaccacacgagggcacgagagaagaaccacttccatggccggagcctcatcgagagctgctagcagcatcgctaccgagctcttgcgttagctctgacttactgtcgcacgtacgcttgtgagacacgcgagaaggcacgaacgattagcttatacattgacttggagcggcatctgaggttccaaccatcataagagagatgatggtacggaagagggagcgcgactgccagaacacgatgcgcatgacgacgagcatgacggactacgcgctggccgacgcgc

SEQ ID NO: 74268 - DNA, 443 bp, Zea mays
  Clone ID: LIB3079-040-Q1-K1-B8
cccacgcgtccgctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagctcttgctgccggcgctgatgtgtccatgattggcccagtcggcgtcggtttctac

SEQ ID NO: 74269 - DNA, 77 bp, Zea mays
  Clone ID: LIB3079-040-Q1-K1-B9
aaaaaaaaaataattaaaaaaaaaaaatataaaaaaaaaaaaaaaaaaataaaaaaataagggaggtcaatctagaa

SEQ ID NO: 74270 - DNA, 287 bp, Zea mays
  Clone ID: LIB3079-040-Q1-K1-C1
gtcgtatgagcaaagttggtgtctgatcttttgactgcaagggaaagagatgaacagagacacaccagtgtatagggtatatgcttgcctgagcgtgttactgtcggaatggcaggaggtctgttgtccatggagtactcatggtcctctgtttttggcattataggcaacatcatctcatttctggtgttcctagcaccattgccgacgttgcttcgtgtgtacccgaagaagtcgaccgaggggttcagctcggtgtcagatgcggtggctctggatagctgtac

SEQ ID NO: 74271 - DNA, 403 bp, Zea mays
  Clone ID: LIB3079-040-Q1-K1-C11
cggggaacccctgtactgtatttcgtcttcctttgccatggcgtcgtcgatgatgagttctcgcgcgggcgcggcggcggccggaggaggagaacaccgccgtcagcacgtcaccgtggcgtgcggtggtctgactcggccgagtaccaggcccgtgccgtgcgcagctggcccacggcccgggacgccgaggccgcggtgacctgctgcagctgcgggcggctcttcgtcttcgtcgccgactgggctcgcggggccggagtgcaactggtggggcgctgccgcgcggcagcatgcgacgccgaggcggacgaggagcgccagggccgaggtcgcgcgcgtgcccacgggcaaggggaaccgcgagctggtgagactggcgctcacgccgtccgtcgtgcgc

SEQ ID NO: 74272 - DNA, 418 bp, Zea mays
  unsure at all n locations
  Clone ID: LIB3079-040-Q1-K1-C12
ggctatagggcacaagaacaccaccaaagtggcgctcctagttctgctgctgtcattgatgctctctttgacagcgtcagtggcgcgcaatctccaatggcgactgtccgtcgctacggctgtggaggtgtgcgtgaaggctgctgtcggggctcctgacaagcttggcgactgtcccttctcacaaagggtgctgctcactctggaggagaagaaggtcccttaccggatgaggctcattgacctcagtaacaagcctggatggtttctgaagatcagcccagagggcaaggtgcccgtgtacaacagcggcgatggcaaatggattgctaattctgatgtgatcacccaagtcatcgaggagaagtacccagccccgtctctggcgacgcctncagaatacgcatcagtgggatcg

SEQ ID NO: 74273 - DNA, 387 bp, Zea mays
  unsure at all n locations
  Clone ID: LIB3079-040-Q1-K1-C2
ggagaatgtgcaagttatggagtttcggcatctgcgccaacttatccaccttgttattattccatttgttaaatattgccctgccgatttatggctgtggctagtgaaccttttgcagccgttatttgtccactgtcagcaagctcttaattattcatggtccagtcttcttcatgagggtcgggctaaggttcctgacagcattggtaatctttctgggtcagaactgaaggtagaggtaatggaagaaaagttgctacgtgacttgactcgtgaagtatgttctgtcctttgggctttatcatcaccaggcttanataatggactttcatccttggaacaacttggaccttncaaccgatggattctgttttgaagaatctggag

SEQ ID NO: 74274 - DNA, 426 bp, Zea mays
  unsure at all n locations
  Clone ID: LIB3079-040-Q1-K1-C3
ggagcacggacccgctgctcgggtacgtcttctcgttcggggaggacagccgcaaggacgtcttcgtcctggcgagcaagggcgtgtaccgcgtcgtcaggcccagcctctgcggctacacctgccccgcggagagaccggcgaccgacaacggcaccgcgccaggtccaggcgggccgtcgtcgggcgctcccgccgcgacacggctagggaggtcggtggcggcggtagcggtagctctggcgttgatcccgtgtgtgctgttactgtgaccttcagatgtgtgtctcgtgcgatgtagtaggatcagtcgtagctgaagctactgggagctggaagagtacatacgtatagcgtgagtaacgaacactcaaaaacagntgtgctatgtggatgcctcttgacaagacaaagagcaatgggtag

SEQ ID NO: 74275 - DNA, 407 bp, Zea mays
  Clone ID: LIB3079-040-Q1-K1-C4
ggccgtccaagttcctggtggtctgtctcaacgctatccgggatgcggtggcgcccgaggaaggcggtggcagcatccacggcgccggcgactggggcgtggagctctggcggtgctgctccgcccaggcgccgtccgacgtgctcgacgctagcggcgcgtgcgccacggtggcgcagaccgcgtggctcgtctccaccgcctgcgacatcgtcgctaggaaagagaggcatgggatggtcgtgtcttgccccttcctgctgtacctcgtctcgtcgcaggataaggccgcgcaggtgcgatcgatatgcaaacccctgaagcctcttgggattcattcagtgagcttgcatcctggcgcatccattgaacaccagatctctggactgaaaacttgtgagccggag

SEQ ID NO: 74276 - DNA, 440 bp, Zea mays
  unsure at all n locations
  Clone ID: LIB3079-040-Q1-K1-C5
ctccttttaccttctcccattcacgccccgtctctttcgtggccttccttttccggcggccacaagtgggcgagcggcggcgcccttcaccaggtcttcgtcgggcccttcaccggcgacgagcatccaccagaaacgtggagctcagagcattggtgcctctttcctctttcaccaaggattccggtgccttatttcacaagacaaaaaaagtctcaagggtcttgattcttgtatgaactcaagatttatggtggatcttggagctgtgggatgctaagcctggtctagctactagattatgaactctctgctgatctaatagcatttctacaagaaattctttgctggaaggtttattagttatntgcaacaatgaaggaacatctaatgctnaatattgatgacctaagcattcttgagcctaacgaggtcattgg

SEQ ID NO: 74277 - DNA, 338 bp, Zea mays
  Clone ID: LIB3079-040-Q1-K1-C6
ctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgt

SEQ ID NO: 74278 - DNA, 375 bp, Zea mays
  unsure at all n locations
  Clone ID: LIB3079-040-Q1-K1-C7
gcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctagattcttaaaaaaaaacnaaaattcaaaa

SEQ ID NO: 74279 - DNA, 445 bp, Zea mays
  Clone ID: LIB3079-040-Q1-K1-C8
cccacgccactctccctactcccttcctccctctctctctatctctctctctctagctccccatgcagctggcgaccaagccctcccatgctcctccctcaccttggaagctctcccatggcgtctccccctcctctacggcagcaaggtgtaggaccgagagatgatgatcgagctagtgatgtggtgccaaccacaagatgcagtcggtggacgacccaaggaaggatggacttaaccagtggatgctcgccaagcgagtacctccccagcaaacactctctaagtgttaaattaaaggtactccttaggatgattggttgatggtgcgacttggccttcatccctgccaccgggatagatggtcgagtgggttactgcttccgcaggagaggaccaggaggagtagtgtggccaggcttcggcatgttactcggttcttctc

SEQ ID NO: 74280 - DNA, 358 bp, Zea mays
  Clone ID: LIB3079-040-Q1-K1-C9
accgcttgggctatcccgaaccctaaccccgaccgccgcgccagctactcccgtttcgtcctcgcggcattcgcggcgttttctccctctgctcgaaccgcgccgacgagcgacgacaagaactgctctattcttcaaaacaaatggcgaccgttccagttaacccaaaaccttttctgaacaacctgacaggaaagcctgttattgtcaaactcaagtggggtatggagtacaagggttatcttgcttctgtggactcatatatgaatctccagcttgccaacactgatgagtacattgatggtcaattctctggaaacctgggagagattctgatcatgtgcaacaacgtcatgta

SEQ ID NO: 74281 - DNA, 340 bp, Zea mays
  Clone ID: LIB3079-040-Q1-K1-D1
gctacgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggctggcgccgtgatggcggtggcggctacggcagtggctgcggctacggtggcagcggcggctacggtggtggtggcggcggctacggcagtggcaaccgtggctgcggctacggcaactacgaccggaactggaagaactgagcggtggggcccgcgcggtcaagtta

SEQ ID NO: 74282 - DNA, 396 bp, Zea mays
  Clone ID: LIB3079-040-Q1-K1-D10
ctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggcccctccggcctcgagaaggtcgtgcttcgcggcgctcgcaactgctgtgccgagatttatctttatggaggtcaagtaacatcatggaagaatgacaatggggaagacttgcttttcctcagcagcaaagctattttcaaacctccaaaagctattcgtggtggtataccaatctggtttccccaatttggat

SEQ ID NO: 74283 - DNA, 374 bp, Zea mays
  Clone ID: LIB3079-040-Q1-K1-D12
aaaattttgggaaaacatcctgaagatgattatcctgtacttataacacattctaaaggtggatacaacatcaagcataggagatctctagctctagcgccaaagagtgttgacccaaagaagatgacacttgagcgtgcgctcaagctactaagcggtaaaagtgtcagacgaatcggtcgaccgaaggggaaggttgaaaacaaggaacccatggaatggcattagctggctgtactcgctacaagatcctaaacatgagtggatcgataggcagggagccttatatgcatgcaatgaatccagagtgaagccaatattcatatgactccgacgttcagcctttggagtgcttaactgattatgacgagagc

SEQ ID NO: 74284 - DNA, 392 bp, Zea mays
  unsure at all n locations
  Clone ID: LIB3079-040-Q1-K1-B7
cctgcctggctgatttcatcaactccggcggcttgtagaagacgaagctgctccagaatccgataggaagtttggtgctcgcgtgttgacgggttgatttcggtgcgccgatggggcaggcgttccgcaagctgttcgatgccttcctcggcaccagcgagatgagggttgtgatgcttggtctggatgccgccggtaaaaccaccatcttgtacaagctgcacatcggngaggttttgtcgactgttcccacgattggtttcaatgtctagatagttcagtacacgaatgtgatgnttactgtttgggatgctggtggccaagaaaagttgaggcccttgtggaggcactacttcaacaatactgatggcttgatctatgtagctgattca

SEQ ID NO: 74285 - DNA, 237 bp, Zea mays
  Clone ID: LIB3079-036-Q1-K1-F11
agaagactaaggcatactttgatgtgaaggagagcactagctcatcgaatgctaagactggggatgaggatggctcgaagtgagaggtcgatgacaaggatggcatcaattactacgtatacgatgactatgaataaacagtattcaaggtcacgaggtatcaaacccagtgttatgttcccaattaacttactgttttgatgactttaaatgttaaatggtttccaacatgtggtt

SEQ ID NO: 74286 - DNA, 461 bp, Zea mays
  Clone ID: LIB3079-036-Q1-K1-F12
ggatgtgctcagtcatacgcaaagaacatgggactttatggacaaagagcaggatgcctgagtattttgtgtgaggatgagatgcaagcagttgctgtcaagagccaactgcaacagatcgcaagaccaatgtacagcaacccacctgttcatggtgcactggttgtttctataatcctcagtgatccagaattgaagagtttgtggttaaaagaagtcaagggtatggctgatcgtatcattggaatgcggaaggcacttaaggaaaatcttgaaaagctaggttcacctttgtcatgggatcatatcactaatcagattggaatgttctgctacagtgggatgacacctgaacaagttgaccgtttaacaaatgaataccacatttacatgacccgcaatgggaggataagcatggctggtgttacgacaggaaatgttggttacctagcaaatgcaat

SEQ ID NO: 74287 - DNA, 289 bp, Zea mays
  Clone ID: LIB3079-036-Q1-K1-F2
tcgttcgcttaaagctggcaacgcctaccatttttatttttgtgaataggaacagctggcccagggttgtttaagtggccatgaaccctgtggagcatacccacggaggaggtaaccaccaacatatctgtcacgcctttactgttcgccgcgatgctatccctgtccagaatgacggtctcattgatgctattaggactggctggctcataagtcatgctgctgacacaaccactaatgctaacaatgacacctatcatattgatagtcatgatttatttattcctct

SEQ ID NO: 74288 - DNA, 431 bp, Zea mays
  Clone ID: LIB3079-036-Q1-K1-F3
gcaataatgggctggttactgctttcatgtcgaatctgattacttctgattgatgcatatccttggtggctgttggctagcgaatgctttcagaaaccacctcttctgtttagctattttgggcagtaagtcaagcagtgctttgtattttgtaaataggcattctttatgttaataaatctgtatagaaacaaaattggtcattcaataatcaatagtattatcagaattacatttctgtactacaacaattattttatcaaacaagttaaaaaactatcttgggaattttatccaacctatttttttctaagtcatgtttaggaaggtaggtttgtaatttttactattacaagcagttatactaattgctattaaatactactcaatttacatttagcattctgtattcagggctgaattgcttcatt

SEQ ID NO: 74289 - DNA, 377 bp, Zea mays
  Clone ID: LIB3079-036-Q1-K1-F4
cggcacacagagctcatgcttcaaccgaagtgtagttaccaagtatttgaagcctgctgttgctggcggcctcatgcagaaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgagctcgcaacttctcttattgagaaggcgaaggccaagggggtttctcttttgcttcccactgatattgtagtagcggacaagt

SEQ ID NO: 74290 - DNA, 362 bp, Zea mays
  Clone ID: LIB3079-036-Q1-K1-F5
gcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccaaataatgagttgacatgccatcgcgtgtgactcattattattaacaataaaacaagtttccttttatc

SEQ ID NO: 74291 - DNA, 375 bp, Zea mays
  Clone ID: LIB3079-036-Q1-K1-F6
cacgaatagctcgcattgcatcatatggagattgtgctgatgcttgtaaattatggaattgtggatccagttccagattatatgagaatgacactttcatattctcatggtgcaccgatgagaaaggtggagatcctaccaaaactcataatggctctgagaaagatgcatcaacagaaccactcggtagatgctccttacttattacaccaactgaagatagaactgatggtattactgagcctgatgaccttgcatagaataatgtgaatgcaccccaagaataccaagctgcatctgaaattatacgtgataaaggtgcatagggttatgatgtgtgttgcacacgaattactaaggatactactggccata

SEQ ID NO: 74292 - DNA, 351 bp, Zea mays
  Clone ID: LIB3079-036-Q1-K1-F7
gcagcaactgttggccttaccgagtttagattatgccagtgatgatgccacagatgatgaggcctaacatgatgtcaccattgatgataccacgcatgatttcactaatggtctttccgagcattatttaacaaatgatgatgccacaatgtcactgcgacgcctattcgcatataatgctgtatcaacagtaaccattcatgaacaacccaatggccatgacgaattcacctatgttcttacaacaactcattttttgagctacattctaaatataaatatgaaatttgtaccaaacaatgatttgacatgccatctttattaactcatgattattaactattactatta

SEQ ID NO: 74293 - DNA, 288 bp, Zea mays
  Clone ID: LIB3079-036-Q1-K1-F8
cgaactgcgccgtggtggccgcgcactccatggccacctacgacgagcagtgggcggccgacaagagcagcagcaagctgatggtgatcgacttctcggcgtcctggtgcgggccctgccgcttcatcgagccggccttcaaggagctggcctcccgcttcaccgatgccatcttcgtcaaggttgacgtcgacgagctcgcggaggtcgcaaggacatggaaggtagaggcgatgccaacgttcgtgctggtcaaggatgggaaagaagtaagccctgtgattgggg

SEQ ID NO: 74294 - DNA, 382 bp, Zea mays
  Clone ID: LIB3079-036-Q1-K1-F9
tatgaaatgactgtgaatcgttgttctgatttgtctttcaccacatgttttccttgcatggagtaatatacgatatttatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaacttaaaaaaaacataaaaacgataaaaataaggtgactaaaataaaatacagaaacacaaaattcaaaaaaaattaaaactagtaaaacaccagtagacacctaattaaatggccaaaccgaatattgatcataacaaatacttacgtcaaaacaaagagttcttcacaattggccttttcc

SEQ ID NO: 74295 - DNA, 425 bp, Zea mays
  Clone ID: LIB3079-036-Q1-K1-G1
ggaaaattgtgacaaggataaagatttcatttagcgtcaatgcgaaaagtgcattggagtgggtcgtaaattccctacgacacaactatgttgcaatgctataaaaagagctgatatggcttgcgtctgtcgtagcataacactagaagagcagctcacaataagtgtcgtgaaggttgtggatgttgcaaaggaatgtggcaacccggtgccgcctggaaataaatgtggaacttggactgttccaccacaactgctgggatgggtgcatccgtaagggttcaacaaagcgagcaacaaagggcgcatggataggagttcaacaatgaaagcaatcataggaaaatcttgagataaatgaatgaatgtatgctctactggcttttggaatattagatcaaaattatatgagatgtgaattattt

SEQ ID NO: 74296 - DNA, 454 bp, Zea mays
  unsure at all n locations
  Clone ID: LIB3079-036-Q1-K1-G10
gtacaccacaatctgaagcaagtagctccaatcatcagtcacaaaaagaccaagaaatgcagtcgcgaaacagcagcgatggtttagtgcctctgcctcttaatgcagatggtgctgttggttcaggaacaagcacaagggaccttgaaaattcacttcagaaggcacaagaaaactttattaagagccagattgagatgttacagatccaactgcaaatggtgcagcgtggcgctgctgggccgtccagtaacgagaatactgatcacacataagaatgactgaatctgtgaacagacacttctgcatcgtggtgtaataataaggagaatactgatgagcacacagctgaatctgtaaataggcggcgatgaggatgggacaaaagatagccaaggattggcgatacctgtggctggtggaaactgttacatgatgtctngcctggattttg

SEQ ID NO: 74297 - DNA, 456 bp, Zea mays
  Clone ID: LIB3079-036-Q1-K1-G11
cttgtgtatactccatttagttggatccaaatatgggcaccactcaaatttcttgtgcagggaatggagaaactatccatgccactgttgtttttgtcagtcacaacaacagtaagtgagctgtcctccaagcgtgatgatgaaccagataacaatacagaacattctgaaacaaatgaattggcatcaacttctggcacaagtgatgctgctgatggcacaaaggaaatcgtacaagagaactggcttgtgttacttttcagggagcttgagaagcaaggcatcactttacccgagaggtttactgaagatgaattacgcagattttatgttgctgcaaatggtgacttttcaagtttactctcttcggttaagaagacaattcgttggagggaaacgtttcacatacttacactgcaagaacttgataaatggtctcacttagtcttttggcat

SEQ ID NO: 74298 - DNA, 443 bp, Zea mays
  Clone ID: LIB3079-036-Q1-K1-G12
ggaagcagcaggggaagaaggcaaaggaggggagaagatgtagttcacccacttaaagtgtctctggaagatctttacaatggcacctcaaagaagctctctctttcgcgcaatgtcatctgctccaagtgcaagggcaagggctcgaagtctggtgcctcaatgaggtgccctgcttgccagggctcaggcatgaaagtcactattcgtcagctgggcccttccatgatacagcagatgcagcatccttgcaatgagtgcaaggggactggagagagcatcaatgagaatgaccgctgtccagggtgcaagggtgagaaggtcattcaagagaagaaggttcttgaggttcatgttgagaaggggatgcatcacaaccagacgatcaccttccctggtgaagctgatgaaacgcctgatactgtcactggaaacattgtatt

SEQ ID NO: 74299 - DNA, 58 bp, Zea mays
  Clone ID: LIB3079-036-Q1-K1-G2
gctatacatcggcagcacgctgacgcgcacttagcttttatgctatccactacgacgc

SEQ ID NO: 74300 - DNA, 421 bp, Zea mays
  Clone ID: LIB3079-036-Q1-K1-G3
cgcttatccatgagttctattcaagggaagtacaaagccccatccatcttacagtcgacaccggcttcactaggggggaagcttccatcaaagcctacgtctcatccaacctgtccctcggtgataggcaactcgctgcgcaatttcaggaaatccctctggatcttaggatgatcggggcagaaaaggctggatttgagatcctgaaatctacgatggtagagaagctccccaatgatctggaaggaatggagtcctcaatggagaagctttacattcttattgatgagatctacaaatacgtcgatgatgttgtggaaggacgcgtggcacctgataacagaatcggaaggttggtctctgaatcttgtgcttcaatgccgaaattgtccccagctgctttcgataagcttttcaatga

SEQ ID NO: 74301 - DNA, 432 bp, Zea mays
  Clone ID: LIB3079-036-Q1-K1-G4
cccaacccctgttagggttagggtttcctattctaactcttataatattatctaataaattactttgtagtctttgtcatatgccatgtgacttatattggcctaagttgttacttttgtttctgtacgtatatggggattcagaatgagaaagagtgtagcaaattaatataattaggtgctgcagtttttctctatgcaatgctattatgaacttccttttgtatttagcacaatcctgaacttcactggtagcatttaacattattatttaatctaaaacagagcaacaaggtgctctgtatttaagagtggtatttgtagtgagtgaaatgatgatttggaaattatcatattagtatatcatatttatgtgtggatgataacaagtactatgttgcaacttgtgagacaattttttagtgtaaggat

SEQ ID NO: 74302 - DNA, 436 bp, Zea mays
  Clone ID: LIB3079-036-Q1-K1-F10
cagatattggtctatccgttcatgtccaatggctcactacaagatcgtctttacggtgaggcatgaaaaaggaaagttcttgattggcccacaagactatctgtttgcattggtgctgctagagggctagtatatctgcacaattttgcagggcgttgtatcatacacagagatattaaatcgagcaacatacttctggatcacagcatgtgtggcaaggtagccgactttgggttttccaagtacgcaccacaggaaggtgacagcaatccatcaatggaagtgaggggaactgctggatatttggaccctgaatactattccactcaggtgttatcaaccagaagcgatgtcttcagtttcggagtagtcctgttagaaattgtgacaggaagagaacctcttgatgtcaaaaggcctcgtcatgaatggagct

SEQ ID NO: 74303 - DNA, 453 bp, Zea mays
  Clone ID: LIB3079-036-Q1-K1-D3
gttctcctacgtgttcgagaaaaaatagcttgtctagcttacttgttagcttaagctttcgtagcaagtaacactctcaagggcttcatcttgtgaaccatcatagctgtcttccgcttgttttagaaaaattgaggcacttcgaggttgagattattagttatcaccttgcttgtcttgtatccagctttaagtgcctcagaacatgaagcttacccaaaggtcttcataatgattaggaagtcagtcaaggctggatgtttgttcgaatattggatagggattcagagaggtttactcccttcaagttagaaaaacaaagaatggtatgtttttgtggtatttttgggtcagtctaggataaagtatttatgatccttctttaattgtttcagttagcagattgtaacattgagaacactattacttgtttttctaccttctgaaaatact

SEQ ID NO: 74304 - DNA, 370 bp, Zea mays
  Clone ID: LIB3079-036-Q1-K1-D4
gcaaactcagagagggacccgatggcacccatggcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaagcggccaaagctcgccgctacaacaagaagcccacca

SEQ ID NO: 74305 - DNA, 210 bp, Zea mays
  Clone ID: LIB3079-036-Q1-K1-D8
aaactatcagtgaccactgacagctttgcattacgttgatgtatggtcaacctgtaaactgggtgtactgctactcgtactataaataacataaggttttaaccaaaaaaaaaaaaaaaaaaaaaaaaaaaaaaaaaatataaataaaaataaaaaaaaaaaaaataaaaaaaaataaaaataaaaaaaaatctaattaatatttcaaaa

SEQ ID NO: 74306 - DNA, 302 bp, Zea mays
  Clone ID: LIB3079-036-Q1-K1-D9
ctcagtgttgacaatgaggttgagccttttatcactctgcaacgtttcaaacaacagttggaagtccctttctagtttctacattgaaattatcatattaatcagctggagcatttgggtctcaaggagtgagctggaacatcttccaagaaattctaccgtctgtatcaaatggctaagcctttttcaagaaagagtttgcccaggttatccatagagcatagaagaaatatttccttgaagaatgactagagcgtcagttgtggtcttttttaatatcttttgtgtcctttttttgtttc

SEQ ID NO: 74307 - DNA, 369 bp, Zea mays
  Clone ID: LIB3079-036-Q1-K1-E1
gagaaagctacagactggattttcagccactccgaagcatctacctcagcatctgctgatgcttccactagcaatgtaaatgctgatgacacatatattccagatggaagtggcagatacaagctgatggcgttcgtgagccatatgggcacctctacccactgcgggcactacgtagctcatgtcctcaaagacgggaggtggacaatctttaacgacagcaaggtcgcagtatctgttgacctgcccaaggaaatgggctacctctatttctttcagaggattagcaactaggcacgtcacacacaatggaaagaatggtgggctgttaggatactgtcttgctgattttaaagcgaacgtttactc

SEQ ID NO: 74308 - DNA, 372 bp, Zea mays
  Clone ID: LIB3079-036-Q1-K1-E10
acaaacataatatacacagctgatcgatcgagctgcataaacctgcacgttctacctagcagggcccaagatgtcaggcttacttcccaattccgtgcgcccctatcgccgatcttctgatcttcactctccacgcctccgccatacatgcgcagatacctgcctcggcaactaccgacgccgccgtggccgtcacaaacccgcatccaggaagcactggcactgtctgctgtatattgggcgccagcggtccggactctcgtctggaactctacatgcacgacatcctgtgccggtcgagcctgacagctcatcccatcaccggtttgctgggcatcatctaccacgggcatgtccatttcgcgcggccca

SEQ ID NO: 74309 - DNA, 419 bp, Zea mays
  Clone ID: LIB3079-036-Q1-K1-E11
tccggtcaagctggctcatctactgctctgcagattgccatgaagacctgtggcactaccgagggggtgttcacaaatcgacggatcctagagctagcttaagagctggctatgcctcttgctgcatgtgaagtactcccgctagaccttcatatttactggcgcacacacagtccatgatctagctatctccgacaatttgctggactcaaccgatactgtgtgcacctgaaatctggtgtacaagattatgtgatagaggatgcatcatgaccaagacagacatgtgacatatactacaccgctaactacacagagcaactaatggtcaaaactcatatgcgcatcactggactggacacagaataaagctcagagtcattgttcaatactaatgctgatggcagcacagcatgtgc

SEQ ID NO: 74310 - DNA, 378 bp, Zea mays
  Clone ID: LIB3079-036-Q1-K1-E12
tcgagaactccatttcgatctcatttgaaatcaacccatcctcgtttcctccgtctagcagcgctgtcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaagactccaagacccttctctttggtgagaaggaagttgctgtgtttggctgcaggaaccctgaagagatcccatggggttcggttggcgctgaatatggtgatgagtctactg

SEQ ID NO: 74311 - DNA, 433 bp, Zea mays
  Clone ID: LIB3079-036-Q1-K1-E2
aatggatgaaaaaattgatttctcgttcaatctatatgatatggatagcacagggtttattgaacggaaggaggttaagcagatgttaattgctcttctaggagaatcagaaatgaggctatctgatgatatcattgagacaatcctggataagacattctctgatgctgatgcaaatcaggatgggaaaatagatagaacagagtgggagaattttgtcacaagaaatccttccttgatgaagataatgactctgccatacctcaaggacatcacaacaacattccccagctttgtgtttaactctgaagtcgatgatctcgtcacgtgaccacgattttctcttcgatgtatagctaacaaggagaacctgtcgagggttacgactggagatttctagcctctggcattatgaatgcgaggtatattcatg

SEQ ID NO: 74312 - DNA, 414 bp, Zea mays
  Clone ID: LIB3079-036-Q1-K1-E3
catccggatccgccgacgccggagaagtactagcaggcgggtgcgcccaggcacggccggtccggctctctgaaggcgaactcttcgaggacaccgggcggcgagaggctgggcagggagaggtcggaatcctgcgggaggaactggctggaccgctgggtggaggagaggtacatggacgacgagaagaacgccaagattctcgaggtggacaacggcaagccacggcgccggtatgcttccaagaggcgcggcggcggcggcggaaaccaccaccaccaccaccagtcgccgtgctcgacgacgatgggttccgagcagaacagccggagctacgcgaccatggcggagtcgccgtccaaggactcgacgaccgcgcagcagtcggtgccgagcccggcgtctgtgggcatg

SEQ ID NO: 74313 - DNA, 383 bp, Zea mays
  Clone ID: LIB3079-036-Q1-K1-E4
gttgaaccagctgcttactgagatggatggtatgaatgccaagaagacggtttttattatcggtgcgactaacagaccggacatcattgacccagccttgctgaggcctgggcgtcttgatcagcttatctatattcctctgcccgatgagcagtccaggcttcagatcttcaaagcctgtctcaggaagtctcctgtggccaaggatgttgacttgaatgctctcgccaaatacacccagggtttcagcggtgcagatatcacagagatctgccagcgcgcgtgcaagtatgccatcagggagaacatcgagaaggatatcgagagggagaggcgcagcaaagacaaccccgaagctatggaagaagacgaagtagacgaca

SEQ ID NO: 74314 - DNA, 447 bp, Zea mays
  Clone ID: LIB3079-036-Q1-K1-E5
cccacgcgtccgcccacgcgtccgtccacgcgtccgcccacgcgtccgcccacgcgtccgggggaacacaagctactacagatccagactctttttctcaggcgatgagcaagctccgtcagcggtatgatgaactgaaagagcgctatggggtttctgatattactgtttcagtacaaaatgtggcttctcagcgggggtacagtagcattgacttggtgacgcttgaggacatggtccttgaaatcgtgaggcaaatcgagaagctgatccgtgcaaaggagatgatggaagctgcagggaagccattctaaacaagatacacatacacaatagttctgctccggcatacctattttctggccagttaccagaccttcgatgcttcgctgttcaagaaaccgattgcagttgcctacggctcaaagcacaagcgcgtgaaatcta

SEQ ID NO: 74315 - DNA, 390 bp, Zea mays
  Clone ID: LIB3079-036-Q1-K1-E6
ctcaagagtccggccacatgagagaaaaagcgtacgctatggacgccggggggatgaaagggataatctaggacatggacgccatggaggtggagaagctgatcttgtacatgctcaagatcgacgtcaagaagctgatctacctcaagctcaaggcgctcgtctaatagccgatctagctctacgtcggcgcgctggtctttcacgcgctcctggtcacgggcgtctactggctcgtttgcgcggtcccggacacgcggcgcttacagcgtcgtctgccgtgtcgtctacagctcaatccccatggtcatgcgcctcaaggaggacagggcaaacggcatgcgtcaagcgcagtaaggaggtcattggccacggggacaccgagctcat

SEQ ID NO: 74316 - DNA, 253 bp, Zea mays
  Clone ID: LIB3079-036-Q1-K1-E7
gtcacaactccggccacatcagcattaaactataccctgtatacatcccacaccatgaaacgtctcatcattaacttccacgccatgatacctcacatccatatacctaatatcctcacgatcatgatctcttagatgatctaactacaacttcactcccacgtcatctacccgatcatgctttaacatcattcactattcattcacaacctaatggacatgaccatttcaaccattttcttacagcaaccct

SEQ ID NO: 74317 - DNA, 408 bp, Zea mays
  Clone ID: LIB3079-036-Q1-K1-E8
ctgaaggctggcaacgcctaccacaagtaccgtgtgaagaggaacagctggcccaaggtccgtggtgtggccatgaaccccgtggagcatccccacggaggaggtaaccaccaacatatcggtcacgcctctactgtccgccgcgatgctccccctggccagaaggtcggtctcattgcggctaggaggactggaaggctcagaggccaggctgctgccacagcctccaaggctgacaaggccacctagagtattgttgttcttgttttatctatccctctgctgtgatttattagatggttaaaaaggacgtgttccgctatggatggtactatggtgaaacattgtgtcagtttttgtggtatctgtatggattttcaagtatgcctaaagaagtttttggtgctc

SEQ ID NO: 74318 - DNA, 460 bp, Zea mays
  unsure at all n locations
  Clone ID: LIB3079-036-Q1-K1-E9
cggacgcgtgngctgacgcgtgggcgattttggcttaagtaatatcatgcgtgatggtcagtttgttaagacgagttgtggtagcccgaattatgcagcacctgaggtcatatctggtaaactatatgctggtcctgaagttgacgtctggagctgtggagttattctttatgctcttctttgtggcactctcccatttgacgatgagaatattccaaaccttttcaagaaaataaagggtggaatatatacccttcctagtcatttgtcaccttcagcgagggacttgattcccagaatgctggttgttgatccaatgaaaaggattacaatacgtgaaatccgtgaacatgtgtggttcaagatccgacttccgcgctatttggctgtgccgtcttcagacactgctcaacatgttaaaaaggtcgacgaggaaactcttaatgatnngtataagatg

SEQ ID NO: 74319 - DNA, 288 bp, Zea mays
  Clone ID: LIB3079-036-Q1-K1-F1
aaaaaaaaaaaaactgataaaataacagatttaaattaaaccaataaaaataccacaaatggtaagggctaacatgatgacaccattgatgattcctatcatgatgtcaccaatggtattgccgagcatgatttctcatatgatgatgccacaattgtcactgctacttcttctttcagattattcttcaacagcagttactattcattttcaacccaattgccatgattatttcacccatgtttttacagaaaccctttgtttgtgcttcattcttgatataaatat

SEQ ID NO: 74320 - DNA, 383 bp, Zea mays
  Clone ID: LIB3079-036-Q1-K1-D12
gctgtctacatgctactaagccggcggctgcatcgggaaacccaagaagtcaccgtcgtcgccgagaaggccatacctctcgtcctattccgaggaccaccagaactgccgcttgatctgtagctcgaagggtttcaaggacggtggctggtgtgacgaaagcgtctagcacaaagtgtgctgctgctcccattagaaatataatatcgtatgttatgttgatgcatatatatgcatcatccatctacctgtgtggtgcaaaattctgaataaaatctacctgtgtggtgcaaaaaagaaataaggtgatattaatctacaaaaaagcaaaatatccaagatatgaacaatcgcgcatataaaaaacaaaaatggggccccct

SEQ ID NO: 74321 - DNA, 442 bp, Zea mays
  unsure at all n locations
  Clone ID: LIB3079-036-Q1-K1-B5
gttatttggaacggccccatgggagtgttttagttccagaagtttgcagctggcgccgaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctncacacatggactttcgaggataggcttgccaccgtgttttgctagatgagtcgtgaaataagcttttacttcctcgctgctgtgggtg

SEQ ID NO: 74322 - DNA, 445 bp, Zea mays
  Clone ID: LIB3079-036-Q1-K1-B6
cagattgtgtgttcagcaaatgagtaaaccacattgccgccgggtccacgagggagaaaggaaacacgagcatcgtttcctccgtcgtcgatagagctctgttcgtctcccctcgtagaaattgccgaccaccgccgcaccttgaagaccgccgtgctgttcgtcgtggtggcccgtctcaggcaacgacgagtacgccggtcgcggcctcaaagacctcccgccaccgctatgacttgaagccctcctccatgccaatcaagattcatggtgaacgacatccataacagagacgggtttgtcctcggaacctcaagaggagggcatgacactacgaaaatcattgattgtcttcaggaccgtgatactaaccagatttatattattgaagatacgatgtgtaacgcaaaattcctgaaacatggttttaggaagtctggtgacc

SEQ ID NO: 74323 - DNA, 404 bp, Zea mays
  Clone ID: LIB3079-036-Q1-K1-B7
acgcagagtgtgtgttcagcaaatgagttggctttattgccgccgggtccacgagggggaaagtaaacattagcatcgtttcctccgtcgtcgatagagctctgttcgtctcccctcgtataaattgccgaccaccgccgcaccttgaagaccgccgcgctgttcgtcgtggtggcccgtctcatgcaacgactagtacgccgatcgcggcctcaaagacctcccgccaccgctatgacttgaagccctcctccatgccaatcaagattcatggtgaacgacatccataacagagacgggattgtcctcggaacctcaagaggagggcatgacactactaaaatcattgattgtcttcaggaccgtgatactaaccagatttatattattcaagattcgatgtg

SEQ ID NO: 74324 - DNA, 296 bp, Zea mays
  Clone ID: LIB3079-036-Q1-K1-B8
ccgacgcgtacgcatagtgtgtgttcagcaaatgatttaagctcattgccgccgggtccacgagggagaaatgaaacactatcatcttttcctccctcttcaatagagctctgttcgtctcccctcgtataaattgccgaccaccgtctcaccttaaagaccgccttgctgttcgtcaaaatttcccatcttacgcaactactattactccggtcgcagccttaaataccttccgccaccgctattacttgtagccctcctccatgccaatcaatattcatggtgaacaacatcca

SEQ ID NO: 74325 - DNA, 403 bp, Zea mays
  Clone ID: LIB3079-036-Q1-K1-B9
gccagcccaaaaataggagcaagcaataaccagggccccatttgcacgccgcccgcgctggtggacggacgaggacgagggggccggtgcaatgcggctcgtgcggggtacggttacttccacttccatatagcagttactgtgctgggtaacaatggtttgggtttggtgcctcactgctagcagttactcttgtcgtcgtcagcctcagctactactaagttttgcgagttttacctataggtgtttgctagttttttttaccagttgcttggtataccgtatacgcgagtagaatgtacatgtacgtatactgtcagagatgggggaatggtggtagggggtgtagctcctggtgtagtggtgttcatattcgtgtgttgccttgctggcctgtaataat

SEQ ID NO: 74326 - DNA, 382 bp, Zea mays
  Clone ID: LIB3079-036-Q1-K1-C1
cccacgcgtccggttgaggccaccgccaccgccgcagcaggatatgtctggcgcaggcgggaccaggtggcccggtggcaatcaaatctacaacccttttgcaccaacggctgcggcggcggctcagagagcggaggctgaccctgagtacgaggatctcatggcatcagttggcatgaagtagcgaagactgctggctggcccctgatctgtctgtggcacaaacacagaggcttcttcctattgcttgccaagatgtgcgggttactaatctcctccaatgtatctctagatggtactgaattccgttccatcatagacaggtgccatgcttgaacgaaaaacataaataaaaaataaactagtggaccttgtttgagac

SEQ ID NO: 74327 - DNA, 294 bp, Zea mays
  Clone ID: LIB3079-036-Q1-K1-C10
gatagtcctaaggaccacatgatgattcatataaggattcaaatgtgatgtctactttaggagagttctattatgaccttgacaagatcaatgctcataccttccaactagagagaaccgctcaatcacgtgttgtcaacatggttcagcttgatatctcctcaaaccatgggaacttggaacttacatgcatctatcgcttcagggtgcatggcataaagcccgtctactccatcactggacgatgaagccctgagctgatacatgcgtgccatatcgcgacaacattcttgc

SEQ ID NO: 74328 - DNA, 454 bp, Zea mays
  Clone ID: LIB3079-036-Q1-K1-C11
ggtggctgtcggccgccgtgcagctggggctctgcatcaacctcttcttcaccatgccggggatgatgaaccccgtgtacgaggtcgccgagcgcctgctccacggcaagcggtactgctggtggcttaggtggctgctggtcgtcgtcgtcggactcgccgccatgtacgtgcccaacttcacggacttcctggcgctcgtcgggagcagtgtctgcgtcctcctcgggttcgtgctgccggcctcgttccacctcaaggtattcggcgccgagatggaatggcccggagtgctgtccgatgtcctgctggtcgtgatcggcctcgcgctcgccgtgttcgggacgtacacgtcgctgctgcaaatcttccaatcgtcaagcgcttgatcgacgcgcgttccgctgcgcgtcgatcatcgcattctccagggcaactacgatacatgtgttga

SEQ ID NO: 74329 - DNA, 428 bp, Zea mays
  unsure at all n locations
  Clone ID: LIB3079-036-Q1-K1-C12
ctgagtcctgatagtacacgacaggcaccgtagcagaccggccggactcggcgccaatcgcgatggatttgtcatccgacgacgtgaaggcggcgaacatgcggcctgcggttgctgctgccgacggcacgtcgacgcttctgcggggttggcgggagttcatgcggagcggcgcgccggcgaggttcctctgttatgaggacggcaagtggatcggtatcaccggagaggcggtgccgcagctgcgccaggcgttccaggagaggagggcgatggccgatgcttcgtacggtggcaaggcgtacctgttcgacttcctccgcatgatcaggatcgacgaggtcaccggcgaggagaccgggctggcgtggatcgacgaccgcggtgactgcttcttcccggcgcccgactgcngagggaggaagcgc

SEQ ID NO: 74330 - DNA, 365 bp, Zea mays
  Clone ID: LIB3079-036-Q1-K1-C2
gcgcatggaggagggggagttctccgaggctcgcgtttacctgtccgccctgaaaaagggcgtcagtgaggtcgccgcaaagggcggcactaataacgttaacaagaagaaggattcctgacctgtttgcttaaatctgtttgcttgtcaacccaatttgtggtgttaaaaaaccttagtttgtgtcctgccccccttggataatgtttgggtgtttccttccatcataattgcttgacacggctatagtattcgcatttgaaataaaaatctctctcttaaaactctctaggttctaaaaaaaaaaatcattatttacaatttcccttctattaacaaaaaacataaatttataatatactttt

SEQ ID NO: 74331 - DNA, 448 bp, Zea mays
  Clone ID: LIB3079-036-Q1-K1-C4
ctttgcttgacaacccactacattgatgcatactttatcttgaaaaaagaagactattgcgttcagggttgtaaaatatcaccctctcgcatacaagcttttaatgagattgctgagaggtctggatttccttcaaaggctggattaattcttgatgttccaaattgttgcaattcgacacacaacatgattatggaggccattgagtacaaagttgtcttgaagagatatgctgaggaacaacttgagccttcaccagatgatgaatagtggacaaattctgaggcgattggagagtttcttgggggcatttgaggaagctacaaaagtattctcaacacatagaagtccaacatctcatttgtttttgcataatgtgttatgtattggatccatcaagctctaagaaattaaaattggcaaatcaattgggtgcttgaagatctaa

SEQ ID NO: 74332 - DNA, 77 bp, Zea mays
  Clone ID: LIB3079-036-Q1-K1-C6
aaaaaaaaaaaaaacaacaatatattttacatttaaaaaaaaataaaaaaaaaaaaaaaaaatgaaaatatcataaa

SEQ ID NO: 74333 - DNA, 199 bp, Zea mays
  Clone ID: LIB3079-036-Q1-K1-C7
accgatacgtcaaaccatcaacttccattttctttatagaaataatataacctttgaagggcagggcgcttcatcggtactattaactataactactctaactaagtcaaattcattcatctataaatagcgacctgctcaaatcatatctacactccccacatcatttttacctgtacctctctaactaaaattattc

SEQ ID NO: 74334 - DNA, 511 bp, Zea mays
  unsure at all n locations
  Clone ID: LIB3079-036-Q1-K1-D1
cggaanttcccgggntcgactccacgtcgtgccggcanctctctctccaatctccctgcgtcctccgttctccttcttgnagtccagccatagcctagggatcggccagtgtgcggactcggagggagcccaccacttcgtaatcgaagggcctgacgccggagccgtccaagaacctacctcgcagcatgggctgtgcaccgtctcgtaatgaaccggggcttcatcgtcattcaatgaactcgctccctgcaaggggttgtggagggtttctactctcaaagacctggtaagcattggccatgccaaatgccacttttgttggccatagacatanttcaactgggaaaaaagctcgaagatattggttccttcgtcacactaactgtgatattnccgcatgtgaactcgtactgagtaccagctgattgatatatcagaggatggatttgtgagccttcttacttcagatggcaacactaaggatgatcttagacttccaactgatgag

SEQ ID NO: 74335 - DNA, 453 bp, Zea mays
  unsure at all n locations
  Clone ID: LIB3079-036-Q1-K1-D10
tgccccgaccccgacctctgctctctggttgccggttgtgctaaacttctacatctagtcgctactggatttgcagtcaatgctactgggatggccaaccaactacaactaggaaataggttgccctgggcaaactattcaactaaactaatcgcgactcaccactagtcggctagttgttgctcaggtgactagacttgatttatgatttggaaacactagtagctgcttatcttttatttacgctagttatcctcaaaagaccaccaaatgttattatacacattcgtagcaatcgtataaggttatattatgctacagtgaacgatgtgccaaaaaatggataagcgtgttcatttaaattctaagagagccattttatgtccttgctggatacaacaacattttgatttactgtctngcatncgaagggtgcattccaagcctatatct

SEQ ID NO: 74336 - DNA, 433 bp, Zea mays
  Clone ID: LIB3079-036-Q1-K1-B3
cccacgcgtccgcccacgcgtccgggatacagttaatgtaagcgctggagatgttgcttgtgtcgggtatttgtggaacccttgggcaatagtcacttgtgtgggatcatgtacatcaccaatcgagaatctaatggttgtaataatgatctacggatcctgttcacgtctggctcctcttgctgcttttggatatgttatggccacacacctctctctttatcctgcaattctcatagtaccggtcattctgttgctgggttatggtctagatgctcctcctccaaaagtatttgttataaaagggtcaattgccagaaaaagtgatgtgtcagacaatgataaaacaagcagacagagagttgttcagcagttttcatggaaaccagtacttcactttatattttggctgctcaatctgtcgtgccatgtg

SEQ ID NO: 74337 - DNA, 93 bp, Zea mays
  Clone ID: LIB3079-058-Q1-K1-B10
cccacgcgtccgataatgcagtaagacgacacacattatcatgtgtggtatgaccaataatagatccatggtcataataaagttttggttttc

SEQ ID NO: 74338 - DNA, 216 bp, Zea mays
  unsure at all n locations
  Clone ID: LIB3079-058-Q1-K1-B2
cccacacgtccggcctcgccttcccttccccaccagcccgtctctctcttctctctgactgtctctctcntagccgcgtccacctcgcaacaacaagcaagcgccaccaaatggcgcctctaagagaccgcggaacttcttccccggcggggtccaacaacctggtggggtcgttccgcgagaagcttatccactttgtcccccacctggcccggc

SEQ ID NO: 74339 - DNA, 112 bp, Zea mays
  Clone ID: LIB3079-058-Q1-K1-B4
cccacgcgtccgcaagcaggtcttagacgcagcaagcgttcttctcgtcctcgtattaacgggcgccaatatgatttttcggactccgataccgagcctcgaaaggcaggaa

SEQ ID NO: 74340 - DNA, 403 bp, Zea mays
  Clone ID: LIB3079-058-Q1-K1-B5
gggtggcagtcgaggccgaggatctggtggtggcggcagcagtgttggatgctgcggcgggggtggttgaagcggaggaggatctggtggtggcggctgcagcggcagtgggactagcggtcgttgccccgtggacgcgctgaagctgggcgtgtgcgccaacttgctgaacgggctgatcaacacgaccctggggacgccgcccatgacgccgtgctgcacgctgatccaggggctggcggacctggaggcggcggtgtgcctctgcaccgtcctcagggccaacgtcctgggcattaacctcaacctgcccatcaacctcagcctcctcgtcaactactgcggcaggcgcgtcccatctggctttcagagcttctgatatatatggtggtagattatatat

SEQ ID NO: 74341 - DNA, 288 bp, Zea mays
  Clone ID: LIB3079-058-Q1-K1-B6
tcgggtggccgaccccaaccccagctggccagttcttcgccggcgaagagcacttcaacgggggcgcccaccccgtggcttggtgctttgtggcccgccaaacccatcaccccaaccctcactcgagctacttggttaacttcgcgtctttcgatctgggctgaatgcgtctttcgatctggacctaactgaccattacccgctcctttctgggtatattctcaccttacctggagaaaaccagaggggatttcaagaaggccaggggcaacaaccaaaccaaacttc

SEQ ID NO: 74342 - DNA, 217 bp, Zea mays
  unsure at all n locations
  Clone ID: LIB3079-058-Q1-K1-B8
tcccggaccgacccatccgttgaaacctaaattcttaatgggtccacctaataattaaaatatatatctaaaacctaaagaatgtttttaaataaaaaatgtctggaaactttnttaaaaaaaccctaccaaaaaaaaaatcaaaaaaaaattaaaaaattccttagaagtaaatcccctaaaaaactttataaaaattatccataatacacccctc

SEQ ID NO: 74343 - DNA, 144 bp, Zea mays
  Clone ID: LIB3079-058-Q1-K1-B9
tttttttttaaataagggccctaaaaattccggttgttgttttataaaacattatgttaccccacttgtatgctgcatcccacaatggattttatgatgtggaccccgaatgttttgcttatacaatgtttgctatgcttcccc

SEQ ID NO: 74344 - DNA, 56 bp, Zea mays
  Clone ID: LIB3079-058-Q1-K1-C1
cccacacatccaacctcaccttcccttacttaccatccctactttctcttctctct

SEQ ID NO: 74345 - DNA, 184 bp, Zea mays
  unsure at all n locations
  Clone ID: LIB3079-058-Q1-K1-C11
tgtcgctctgccgcctcccgcccgggaacagaaccttaaccacaacctggtgcccggctcccctcaccaagctnnctggaagggggttccgggaacggaggggttcccctcaaaacgcaatttccgtcttttttaaggcccccggcccgaaagtgacaaaggggtttcaccccgtgggcacggg

SEQ ID NO: 74346 - DNA, 284 bp, Zea mays
  unsure at all n locations
  Clone ID: LIB3079-058-Q1-K1-C2
taccatacataatttacatccattttccttantaataaattatggatcgcntcttttaaactatcggcgcaccctcacctaattctattnaaaacttttnatttaccaacaaaaaagaaaaaaccaacatgtaatcctcacctactggtctaccttatctaccgtccacttaattataaccaattttttttattttttaaaaaaaaaaaaaaaaacnnctgcctgttttcccaaaaaacccaaaaaaaaaaaaagttcggaccntttnnggggtccaagcttac

SEQ ID NO: 74347 - DNA, 139 bp, Zea mays
  unsure at all n locations
  Clone ID: LIB3079-058-Q1-K1-C3
gaattccgactcgaccgcagtcataaaaaaaaaaaaannntaaaaaaaaaaaattttttatttattaaaaaaaaaaaaaaaaccgcggaagaaattttaaaaaaaattggcccccccccccaacaactttaattctaaa

SEQ ID NO: 74348 - DNA, 273 bp, Zea mays
  unsure at all n locations
  Clone ID: LIB3079-058-Q1-K1-C4
cccactcgtccnttaaaaaaaaaaaaatgttttcataactttaacaaaacaaacacaggaagccatatttaaaaaaataggggccccccctcttaaaatttcaatcctaccttccccttccatccacacgaaacccncttgncctagtacccttctatatatatatttttttcccccnnnnnccaacggnngaangggaaaaacccgggggaacccaaaataaaaaccctccaacccaatccccctttgcccacttgccaaaaaaccaaaaag

SEQ ID NO: 74349 - DNA, 264 bp, Zea mays
  unsure at all n locations
  Clone ID: LIB3079-058-Q1-K1-C6
gtgctcaccttcaagacttttctcgcggtttctcagcagtacaaacagtgaaagcgggnagtggtgcgtacatgctctgcatgcatactatanagaggtagctagctgctatccagtgtgtgtgggcgagagcgagacaagggagatggacatgtcaagtagaatcagaggatatgatgtcattatacatatttactttgcgagatatgtagctcctcaaaanaaacattgtcgcaagaactgtgaacagaagaagcgcggtca

SEQ ID NO: 74350 - DNA, 238 bp, Zea mays
  unsure at all n locations
  Clone ID: LIB3079-058-Q1-K1-C8
catcttaatccgctaccatacataatatacatcccagttccttaataataaaatatgttaggtttaaccaaaactttctcccaccctatataaatcttttcaaaactttttaaaaaccaaaaaaaaaaaaaaaacccccctttaatccttaaataccggtctaacggaattacccgggacctaaataaaaatttttttttttttttnaaaaaaaaagaaaaaaaaaaaaangggggaa

SEQ ID NO: 74351 - DNA, 144 bp, Zea mays
  unsure at all n locations
  Clone ID: LIB3079-058-Q1-K1-C9
catggaaatggattctctcacatccattgggattgatctttttccaanaaaacgtaggtgatcttaaataaatgctgcatttcctcttaaaacatctgtaggtcttggaggttatctacgtgtcatgggatctccaacagattt

SEQ ID NO: 74352 - DNA, 189 bp, Zea mays
  Clone ID: LIB3079-058-Q1-K1-D2
cccacgcatacgcccactcgtacgcccacgcgtccgcttgggtttacatatatttgtattgattatatattaatgaatgatctgcatccattcaatacaaaaaaagaaaaaaaagagaacctttcaagttgtataattcgtccgaacgctcctgtaccagcaacagtccctaaccagatgtctccccat

SEQ ID NO: 74353 - DNA, 56 bp, Zea mays
  unsure at all n locations
  Clone ID: LIB3079-058-Q1-K1-D3
gncccctnttccaccgccgccaccaaggatgtgtccagtgggaaacggtgcaaatc

SEQ ID NO: 74354 - DNA, 361 bp, Zea mays
  Clone ID: LIB3079-058-Q1-K1-D4
ggaaaaatgaaaccacatactgctatgatgtttccctggcgtttgaaacagccctggaggcatcatgtgaaatcaagtagctatggtctcaccaaagctaatgagcacaatcgattctatgctgaagtgaaagagcttatatttgctgattcgggtggagcatggggcactccattggtttcagttgaacgtcctccaggcattaatgatattggcatcgttgctaggaacatgaagctgtccacgccagaattgccacgtggccgggagattatagatgttgccaatgatgtgaccattaaagctgggtccttttgtccaagagaagatgcattttttgatgctgataccaatcttgcct

SEQ ID NO: 74355 - DNA, 287 bp, Zea mays
  Clone ID: LIB3079-058-Q1-K1-B1
tagccaacacacacacaaatactctccattccattccatctcaaaggatagaataatggggggtctctccaccaagcttttcgtggtcctcctcctgctcgtttgttacaccgggacgcaaggcgggccggtgactatggtgtcggcgaggaagtgcgagtctcagagcttccgcttcaagggaccttgctcgagggacgccaactgcgcaaacgtctgcctgaccgaatgtttcaccggcggcgtgtgcaagggcctacgccaccgctgcttctgcaccaaggact

SEQ ID NO: 74356 - DNA, 281 bp, Zea mays
  Clone ID: LIB3079-058-Q1-K1-D5
ggagaaaaacgagactccctctcgccaacttctctgctgcacagtcacaagcccagtggggtcccaatacgagccctagtcgtcgtccactacccgactgtcccccgtgcgaagacagacagccagccagccatatcatcggcctggaccggggagcccagagggatggaccccgagaagctccgctacaagctccaaaattttgtggggcatgatgcggaaggtatgtgcctgtctattggccaaaagtctaggcgtgtgtttattaccgggggcaatga

SEQ ID NO: 74357 - DNA, 316 bp, Zea mays
  unsure at all n locations
  Clone ID: LIB3079-058-Q1-K1-D6
gagaaaggctgcttccatatggacgaggattatctaggatccttccaagccatcgagcggtaccatgtactagagctaaatcgtcccnacacctacagttccacctacctagacctacacaaggactaacgcaagatgtaccttatgaagaagatccccctttgcaagcacaacgacaagttccatacgacctcttaccatgagatgtccctgatggcaaacctcagcaacccgtacatcgtcaaatacaaagacggatgggtataccaggggaccatcatctgcatcgtcacaagctactgctaaggaggggaca

SEQ ID NO: 74358 - DNA, 206 bp, Zea mays
  unsure at all n locations
  Clone ID: LIB3079-058-Q1-K1-D7
atcctaacaacttcaaccctgtttagaggctctatcactttaacatancaaccatatgtagacaaatttaaaccactgattacctcctcatacaaatttaaatccaacagggaacataaacctgataggggctttcaaaaaactttttactaacttgaaaatatatataccttaaagtcttcggcaattttttacaaccccatggg

SEQ ID NO: 74359 - DNA, 115 bp, Zea mays
  unsure at all n locations
  Clone ID: LIB3079-058-Q1-K1-E10
agccttccggtggttccnttttattttgccctccaccagggttaaccaatttttggaaccactaaccggggggccgaacttttaccaattcaccattttcccaagaggatcatac

SEQ ID NO: 74360 - DNA, 242 bp, Zea mays
  Clone ID: LIB3079-058-Q1-K1-E11
ccttccggaatcaggaccaacacaagccggcaggtcaccttttgcaagcgccgcaatgggctcctcgggagggcgtacaacctttccgtcctctgcaacaccaaggtggccctcgtcgttttctccagccgcggacgcctctacgagtacgccaacaacagtgtgaaggctacgatcgagaggtacaagaaggcacacgcccgtggctcttcctctggccccccactcttagagcacaatgc

SEQ ID NO: 74361 - DNA, 253 bp, Zea mays
  Clone ID: LIB3079-058-Q1-K1-E2
acctcatgctcgattcatttcgcctgcgattcgagataatggcactgatgcatatagtgaagagagaactccacggtatgatatccatcctatacatgtccatccttatgctagagcgccaccatcagcctactctggttacaaaagccatgctggctatgaggctgcaaatacatattaatacgcaaggaaccgggcgcctacaccttcaagtggatcttacattcctcggagaggacattacttacaaaaa

SEQ ID NO: 74362 - DNA, 108 bp, Zea mays
  Clone ID: LIB3079-058-Q1-K1-E5
ctccctcgcaaacagccgcgtgaagagcaagcgtgggaggtgggatgcagtgaaaggcgaggtcgctaacctcaacatcagccagtgcaccgccctgacacccccggc

SEQ ID NO: 74363 - DNA, 232 bp, Zea mays
  Clone ID: LIB3079-058-Q1-K1-E6
tgtacttctagctgttcctgctcttctatatgcaatcaacaattacctaaaattcaggtgcaggtgtacttcaatcctgcaactgtcaaaatgctaagtaacctaaaggtactggttatagcttttcttctgaaatttataatgagaaggagattctcagttattcagtgggaagctcttgctctattgcttattggaatcaacatcaatcaactcccgactgtacctgggg

SEQ ID NO: 74364 - DNA, 169 bp, Zea mays
  unsure at all n locations
  Clone ID: LIB3079-058-Q1-K1-E7
tttttgaagggtcaaacagtgcggataaaccgagaatgagaacgcagcaggagattctaaccaaatataagtttggcggggacgccgcccccgcaactgctcatgcgaaggataagctgatgcanaagcaggagaaactggagagaattaaccaacaaaccgcggagct

SEQ ID NO: 74365 - DNA, 387 bp, Zea mays
  Clone ID: LIB3079-056-Q1-K1-G6
taggtcaagtacatcggcttgtcagaggccagcccagacacaatccgccgtgcgcacgcggtgcgttccattaccgccgtgcagatggagtggtcgctctggtcccgagacatcgagcccgagatcgtgccactctgcagagaattggggattggaattgtggcttacagtccaattggccgtggattttttggtggaagaggagtgatacagcaagtttcttctgaatctagtctgcaaaggcatccaagatttacaacagaaagcttggagaagaacaagcagatttacctgaaaatagaagatttggcgaagaagtaccagtgcagcccagctcagctagctctagcctgggttctgcgtcaaggggatgatgtggttcctata

SEQ ID NO: 74366 - DNA, 358 bp, Zea mays
  unsure at all n locations
  Clone ID: LIB3079-056-Q1-K1-G7
gagatccatcccgttgtgtgctacaaccacttcatttctggtgctggtcatgctaagagggcagacatggccaaggcgatatatgaccgaatggaggcttcagggattgaaccatcaataacaagcaacgtgcttcttctcattagttatcttctgcaggcttttttacgttcaagagataaatcaaagcctctagaactgaaaggtgaagatatccaaggtcggaaggcaggaaggctcttgattggtgatctagttgcctcgtttgcaagtggtatcaganacatgagtgacttanagcatntgggagaggagatggaaaagtattttcctgttgatatttacacttataacatgc

SEQ ID NO: 74367 - DNA, 242 bp, Zea mays
  Clone ID: LIB3079-056-Q1-K1-G8
cactcttcatataatttcacattggaattgtggcttacagtccaaatggccgtggattttttggtggaagaggagtgatacacgctagtatcttctgaatctagtctgcacaggcattcaagatttacagcagaaagcttggaaaagaacaagcagatgttacctgaaaatagaagaggtggggaggaagtaccagtgcaacccagctcaactagctctagcctgggtgctgcgacaagggg

SEQ ID NO: 74368 - DNA, 349 bp, Zea mays
  unsure at all n locations
  Clone ID: LIB3079-056-Q1-K1-G9
actcgtcccaagggcaactacatcttcttgtcacacgctttcccttacacaatcctcccttctcactcagtncagtttaacaccacctttcacatccccttccccatctcctactcatacatcaatccctatatcctcccattctacacataactaaccacttcaattatgtctaacatcccactagtccgttaactctatattaccagaatacttatcctcctccccttcctctaatctattctcctatacccatccctattcacaacaaacaccctccatatgaaccaccttatttacctcataacaaacccttccacgcttcaataccactccatcataacctact

SEQ ID NO: 74369 - DNA, 330 bp, Zea mays
  Clone ID: LIB3079-056-Q1-K1-H1
gctatgctgctcttcaacccagagctccatatgccataacatcagccgcgaacacactgcgttgtttctcgaaatatgtgctgactacatcactgcactcgactattaccgcctgctctaaactcgacatcgtccgcgatgaccgaactggtaaaactacactttgtaacgatcatctcactgcatagcttgagacgacacatgctccaaccattgatgcggaacatcatcctatggatatcaccactaactgtcctaacatcacgatctactactgtcatacacgaacgtcaagatacgccagatgacctcacgcatggatactatatc

SEQ ID NO: 74370 - DNA, 394 bp, Zea mays
  unsure at all n locations
  Clone ID: LIB3079-056-Q1-K1-H10
gcagaatacagagcttttctagaatcatgtgacttcatcaaggcaagtactcagtggagagaagttcaggaacgtctggaggacgatgaacgttattcccgacttgagaagtttgatcggttggatatttttcaagagtacattcgacacctagagaaagaagaggaagagcagaagcgggtacaaaaggatcaagtgagaagacaagagaggaaaaaccgtgatgggtttcgtaaaatgctggaagaacatgttgctgatggcacacttaatgcaagaacttcgtggcgtgattactgtgcacagataaaagattcacagtnctacttggctgtagcgtcaaacacatctggctctacaccgaaagaagtatttgatgacgtgatcgaggaac

SEQ ID NO: 74371 - DNA, 225 bp, Zea mays
  Clone ID: LIB3079-056-Q1-K1-H11
ctcacgcatccggagcaactgctccatattcttgtatacctactgtaaactcgttgctaggctggcgaatcaacaatggcgcgttcataagcaactgtaaacggatgcgacactcggaaatacagttgcttacaaacaggcgcagacttcttcaccggaatgctagctgttacctactgatgtgcaacttcaagcaattcacgccttgcctgatattgctgaact

SEQ ID NO: 74372 - DNA, 297 bp, Zea mays
  unsure at all n locations
  Clone ID: LIB3079-056-Q1-K1-H12
cttgggcgtacgcggacacagccccgatccgaatcgtcgtccttgcgagcctcgccgatgccccggtcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacactngctgactacaacatccagaaggagtcaaccctncacttggtgc

SEQ ID NO: 74373 - DNA, 339 bp, Zea mays
  Clone ID: LIB3079-056-Q1-K1-H2
ccgggtcgacgggagccacgcgtccgattatctcgccgttcccatggacatcgatctctggcgctagacatgctaagaggcaggcttgatcagtgcgatgtatgaccgaatggaggcttgagggattgaaccatcaataacaagcaacgtgcttcttctcattacttatcttgtgcacgctgttttacgttcaagagatcaatcaaagcctctagaactgagaggtgaagatatccaaggtcggaaggctggaaagctctggattggagatctaactgcctcgtgtgcaagtggtatcaaacacatgatagacttacaacatgagggagaggagataga

SEQ ID NO: 74374 - DNA, 401 bp, Zea mays
  unsure at all n locations
  Clone ID: LIB3079-056-Q1-K1-H3
gaatatctcgccgttcccatggacatcgactctcttccccgacatcgaccttgactgcctggtcgcctccttctgcggcgaccccgccgccgtctccggcctcatcatcccgtccccgcctccgccggcgccggcgacggcgcacgatgcggaggcggggtcgccggagtcggtgacctcccggacgaacccgctcggggaggtggcgctctcggagatcgagaggctcctgatgcaggagggggaggcggaactgggcggngaggtcgatgggatcagcgtggaccagttcttcgacgcgctgtacgacggcgaggaggcgaaaggtgagcgggaggcggtggcaagcgcggatgtggactccggcagggacgatgtgctggaagtcgtgacgccagagg

SEQ ID NO: 74375 - DNA, 344 bp, Zea mays
  Clone ID: LIB3079-056-Q1-K1-H4
cgaccgacgcgtccggaaagtcacaaaagtctcacctcctcggagaaaggcttatagagaagacaaatctgataggcagagcaactatatgaaaaaggataatggtcctgagacaagtcgggttgggtataagatgcagcaggcaaagcagctgcaacagcaacaaagaccagcatctgcttcagcctcatcaaggcaatctgaaaaggaaagttcttgtgatgatgtagaaattgatgcaattcttgaggaagaggaggccctcattgcagttcacaggaaggagatcgagaatactatggagattgtgcgggaagagatgaaccttttggcagaggttgatc

SEQ ID NO: 74376 - DNA, 291 bp, Zea mays
  Clone ID: LIB3079-056-Q1-K1-H6
gaaagtcacaaaagtctcacctcctgggcatagggctcttccccgacatcgaccttgacgccctgctcgccttcttctccggggaccccgccgtcgtatacggcctcatcatcccgtccccgactacgccggcgccggcgaccgcgcacgatgcggaggcggtgtcgccggagtctgtgaccttccggacgaacccgctcggggaggtggcgctctcggagatcgagaggctgctgatgcaagacgctgaggccgaactgcacgaagaggaccatgggaacaacggagacc

SEQ ID NO: 74377 - DNA, 221 bp, Zea mays
  Clone ID: LIB3079-056-Q1-K1-H8
cgttcccatggacatcgatctcttccccgacatcgaccttgacggcctgctcgcctccttctccggcgaccccgccgccgtctccggcctcatcatcccgtccacgcctccgccaacgccgtcgacggcgcacgatgcgcaggcagtgtcgccggattctgtgacctcccggacgaacccactcgatgaggtggcgctctcagagatcgagaggctcctga

SEQ ID NO: 74378 - DNA, 410 bp, Zea mays
  Clone ID: LIB3079-056-Q1-K1-H9
cgggatcatccttcgcaaccatatctcacggatccttcggcgccactttaagggcaaacggtacggtgctgatctccttgatttgttcaatgaggttgagttcaagacagcttcaggtcagctgctggaccttatcactacccatgagggagaaaaagatctaacaaagtataacataacagttcacggtcgaattgttcaatacaagacagcctattattcattttatctgccggttgcatgtgccctgctgctctctggcgagaatttggacaattatggtgatgtagagaacatccttgttgaaatgggaacatactttcaagtccaggatgactatctggattgttatggtgatcctgaatttatcggcaagattggaacggacattgaagattacaagtgctcat

SEQ ID NO: 74379 - DNA, 266 bp, Zea mays
  Clone ID: LIB3079-058-Q1-K1-A1
cggacgcgtgggcactgaccccggtactagagggctttgtgattctgaagaagaacccggggtgcggggaggagtgaagacccatatagcatattggtgtttccgaggcccgtccagataggcagcctcgaatttgcgcggccttggatatctatcttctttcttgctcagcaggagcgccatcctggccctctccttcctgggtccgtgtccatgtttgattcttatcttaccggagctgtggctaactgaaagagctgtctttg

SEQ ID NO: 74380 - DNA, 217 bp, Zea mays
  unsure at all n locations
  Clone ID: LIB3079-058-Q1-K1-A10
aaaaaaaaaattttttttaaatatnganannnaaaaaaaagggggggaattttttaaaaagaacgccacccacccccccnccnctacaacaaaccaaaaaaaatatattaaatttctttctccaatggggggcccccgtttaaaaaaaaaaaaattttttttcccgtccatccaaacgaaaatccttttcttttcgcccccccaaaataaattaacg

SEQ ID NO: 74381 - DNA, 254 bp, Zea mays
  unsure at all n locations
  Clone ID: LIB3079-058-Q1-K1-A2
tcaatcccaatccacccgctaggtcgcaaactcaacacacantcaggctcgaacctctttctcgtccgaatccacaacttccatccatggcagtgtcatcagggatggtcttctccgtccgcccgccggctccggcccggccctgcgcttgctctgccacggcgagggcgcgccccgtcggcgactgccccaagtggtggccgccgctgctggggtggtccggccagccggactacatcgacgcgcggccggcg

SEQ ID NO: 74382 - DNA, 232 bp, Zea mays
  unsure at all n locations
  Clone ID: LIB3079-058-Q1-K1-A3
atcactcccactaatggttgttgagaatgtatgccgcagtccatctattaatttgcggcaggttatctcagagcttgctgctcctacaaaggatgcagaatttttaattttagaangcatggtgcgatcacttgcataccaacctcaatgcccgttttaagtgtgatgctctaaagcttgctatggtcaagaatcagcgatttgcagaaaaactcttcaatgggagtctata

SEQ ID NO: 74383 - DNA, 378 bp, Zea mays
  Clone ID: LIB3079-056-Q1-K1-G4
gaagggcagggacatcggcttgtcagaggccagcctagacacaatccgccgtgcgcacggggtgcgttccatcaccgccgtgcagatggagtggtcgctctggtcccgagacatcgagcccgagatcgtgccactctgcagagaattggggattggaattgtggcttacagtccaattggccgtggattttttggtggaagaggagtgatacagcaagtttcttctgaatctagtctgcaaaggcatccaagatttacaacagaaagcttggagaagaacaagcagatttacctgaaaatagaagatttggcgaagaagtaccagtgcagcccagctcagctagctctagcctgggttctgcgtcaaggggatgatgt

SEQ ID NO: 74384 - DNA, 199 bp, Zea mays
  Clone ID: LIB3079-058-Q1-K1-A4
cccacacatcccaacacgcctctctatagtattaaatcttacgcacacgttctagcggaggcatacttacataatcgtgcatgctacattatatctactctatagtgtcatacaaattcaatacattgaacaccctttcacatacccaagtaaatggaaaaccataacattacccattttactaatcttgcaatacata

SEQ ID NO: 74385 - DNA, 177 bp, Zea mays
  Clone ID: LIB3079-058-Q1-K1-A5
ggtgggttggcttctcctccccctccggttctggttccggttcaagaggttctccggggggcgggtttctgggtgagcggatcgaaattgcagcttctgatgttgaataccgctacttaatgcgcggcctcgcctgggccacggacgagcacttcctacacaacgcctttaacacct

SEQ ID NO: 74386 - DNA, 85 bp, Zea mays
  Clone ID: LIB3079-058-Q1-K1-A8
acgcgtccgcctacgcgttcatacccctctcggaattctctgaccctatcattgcgaaaaaatgtaggggaaagccggacataga

SEQ ID NO: 74387 - DNA, 256 bp, Zea mays
  Clone ID: LIB3079-056-Q1-K1-E2
cattcactcccatccatcatatatccttactacatcactcacacttcttcacaaaccctattcttatactccaatattttcctcaaatatttattcatttataatctaaatctccctattatctacaccaaccatcctctattctaattaaaatatcaattattctcaaatcaataatctacattctattcatccacaactcaatcaaaactttctccatttcatcttattaatcattacaattttcttaccccac

SEQ ID NO: 74388 - DNA, 60 bp, Zea mays
  Clone ID: LIB3079-056-Q1-K1-E3
acccactcatcccaacatagcctttatctattcctgtcaatttattcttcttacataatt

SEQ ID NO: 74389 - DNA, 384 bp, Zea mays
  unsure at all n locations
  Clone ID: LIB3079-056-Q1-K1-E5
cgcgtccggtgggccaacttttggagaaatgcctcctattgggcatgtgggacagcattgcatgaatgactgattctcaaagcatgcgtgagctacatagattggttctagtcgatacaccactggccccttacttctcagagtgcattacatctgaggatttggatgacatgaatattgagattatgaggaacactctctacaaagcatatcttgaggacttctacaaattttgccagaaactaggtggtgcaacagctgacatcatgtgtgatctnctttcatttgaagctgacagaagagctgttaacattacaataaatagtattggtactgagttgacaagagatgaccgtaggaagctgtactccaactttggtttat

SEQ ID NO: 74390 - DNA, 85 bp, Zea mays
  Clone ID: LIB3079-056-Q1-K1-E6
catatatccttactaacaccactcacacttctccaacaaccatacacttatacttcaaacattaactccaaatatcacaacactc

SEQ ID NO: 74391 - DNA, 180 bp, Zea mays
  Clone ID: LIB3079-056-Q1-K1-E8
ttgctttggtttttgccacatttacggcgcatggggcttggtgagagaagggttgctactatgaaaaagaaaggttcaagcgtgaatgcagcacaagctatgatcgttcaagtaagtttagatgttacactttgcggtcattcgacataatctgtgtatgccataccatgacctcttatg

SEQ ID NO: 74392 - DNA, 357 bp, Zea mays
  Clone ID: LIB3079-056-Q1-K1-E9
atcccttgccttcattgcccttccaggcactgtttggaagattgcaacagctagctagtggcgctgttgacgttctactgggaaaagataagatacaaaaggttttactctcaaggctaactgaaacagttatcatgtggctctccaatgagcaagagttctgggatatctttgacgaccgatctgtccaactccagccttcggggctgcagcagcttattcttgatatgcacttcattgtcgagattgctgtgtgtggaagggttccatatagaccagttcagcagcttgtgtccacaatcataaccagagcaggtgcagctttctcagcaaggggtgttgatccacaaaagtgtc

SEQ ID NO: 74393 - DNA, 387 bp, Zea mays
  unsure at all n locations
  Clone ID: LIB3079-056-Q1-K1-F1
ggcggctctctttatccttctagggattttcctgatactaacatcaacatcgtattggcgcaagatgactacaaaagcaatcattcagcttctgttctttgctttggtttttgccacatttacggcgcatggggcttggggagagaaaggttgctacgatgaaaaaagaaaggttcaagcgtgaatgcagcacaagctatgagcgtncaagtaagtcttgttgcgacactgtgcggtcggtcgacatggcctgtgttcgccgtaccatgacctccgaggaggaaacgggattaagtgttcaaaagatctcttttctttcaatggcttgcaacaactcattgcgagtcgtcgggaaaaaatacggagatattcctaaacgaccaatgt

SEQ ID NO: 74394 - DNA, 299 bp, Zea mays
  unsure at all n locations
  Clone ID: LIB3079-056-Q1-K1-F10
cttcgatcgtttgattcatgtatatcattttacaaaagacactcaaaaccaaacgcaagtgcagagctttggagaacctttttttatggttattcgtgaggatgagaccctatcttctatcaaagaacgtatacagaaaaagcttaaggttccagatgaggatttctcaaagtggaagtttgcatacatttcactcggtcgtcctgactattttgaagattcagatactgtagccctaaaattccagagaaacatgtatggagcttgggagcagtatcttggactggaacatncggaca

SEQ ID NO: 74395 - DNA, 321 bp, Zea mays
  Clone ID: LIB3079-056-Q1-K1-F11
acccactcgtccgaaaaaataaaaaaataaatatataataaaaattacataaaacactaaaaaaaaaaaaacaaatgaaaagctaaaaaaaacaatttaaatataaatataaaaaaaaaatcaaaccctatctatatctcaaagaacttatacactaatatcttaaagttccagataatgatttctaaaaatgtaatattgcatacatttcactcattcattctgactattctgaatattcagatactgtcgccctaaaattccatataaacatttatcgagcttgttagcaatatatactacttatacatccttacactt

SEQ ID NO: 74396 - DNA, 220 bp, Zea mays
  Clone ID: LIB3079-056-Q1-K1-F12
ggccacctcgcctactcccacaccaaccaggcgctcctccgccccaggtcgttcgcggccgaggacgaggtgttctgcctgttcgagggggtgctggacaacctgggtcgtctgagccagcagcacgggctgtcaagcaagggcgccaacgaggtgctcctcgtcatcgaagcctacaagacgctgcgcgaccgcgcgccctacccggccagcttcatgc

SEQ ID NO: 74397 - DNA, 297 bp, Zea mays
  Clone ID: LIB3079-056-Q1-K1-F2
ggggggctggctttatccttctagggatttttcttatactaacatcaacatcgtattgtggaatgatacttcgaaaggttgattcaccttctgttctttgctttggtttttgccacatttacggcgcatggggcttggtgagagaagggttgctactatgaaaaagaaaggttcaagcgtgaatgcagcacatgctatgagcgtccaagtaagtcttgttgcgacactgtgcggtcggtcgacatgtcctgtgttcgccgtaccatgacctcctattatgatacggtattaattgtt

SEQ ID NO: 74398 - DNA, 78 bp, Zea mays
  Clone ID: LIB3079-056-Q1-K1-F3
ccaaaccgacccactcaaccaatcggctctctttatccttctattgatttttcttttactaacatcaacatcgtatta

SEQ ID NO: 74399 - DNA, 290 bp, Zea mays
  Clone ID: LIB3079-056-Q1-K1-F5
gttgcttgtgcatgtgcacaggcaaatgcttagcaagatgacctgagggcccaagggccggattgttacattgcggtcagtagatggattgtatgtaccccgggagtttgatttctgcataaggagacagctaagtggcgatatcatatcaatgtggtgcataaagagtgctccgataatagaactcacgaatagaggcttgtggtgtttacagcaccgtctttggagtgggcggtatatgtgtcgtatacagagatgagaggggtggagctatcattattgtgttgtat

SEQ ID NO: 74400 - DNA, 189 bp, Zea mays
  Clone ID: LIB3079-056-Q1-K1-F6
catctacccatacacttccataccttcataaatacacaacctatatcctaaatcacatcaaattgatccataaatcttactccattcatacaactcactaatataaactcatttatcttacatcaaccacatattaatcaaacatatatatatcccatacaaacttaacatcaatactaactactcatt

SEQ ID NO: 74401 - DNA, 303 bp, Zea mays
  Clone ID: LIB3079-056-Q1-K1-F8
aggctgaccttcccgaggagcgacagatccagcttcctgcttatcttggctcatggatttgtttggcttccaaatggttcgatggtcctaaaatagtcagaatcacatgacatctgtgctatagatatggacctcagtggttttctccacattaggaaagctggaagagccgttttgaactcaatttttttgctaacattggtgttatggtgaaacatatttttgtgtgtatgtaccaacaactaaaatgtaaacacgacattatcatatttgattacaggaataattatctcttatatctta

SEQ ID NO: 74402 - DNA, 54 bp, Zea mays
  Clone ID: LIB3079-056-Q1-K1-F9
aaaagaaagaaaaaaaaaaaaaaaaaaaaattaaaaaaaaaggacaaccaatct

SEQ ID NO: 74403 - DNA, 402 bp, Zea mays
  Clone ID: LIB3079-056-Q1-K1-G1
tcgagaggttggtaatagttattgcaggtctcttgcttctctcagatctagggagctgctgcggctgactgacactgatctatatagtctgtgtggcactgtacactgtaccagttctgtatgagaaatatgaggacaaggttgatgcttttggtgagaaggctatgactgaactgaagaagtattatgccattttcgatgagaagtgcctatcgaagattgcaaagggcccccttaaagataagaagcactagattggtagtaaggtatttgctatgaatcaacatctacattatgtcactagctgacacctctatctctgaaggattgtgctaggtactggtctctagttgatagtatataatctgtatgtgcaacttttgtgtgactgacagtttgttg

SEQ ID NO: 74404 - DNA, 463 bp, Zea mays
  unsure at all n locations
  Clone ID: LIB3079-056-Q1-K1-G10
ccgaatttcagtttcgacccaggcgtacgcttggtctcgactccgcttttgcttggttctatcgtgccggagaggagaagctagctaagtagcggcagctctgttggtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctncaaccgcggcaagctatacgagttctgtagcggaccgagcatcacgagaacactngagaggtacgaaaaaaacagttatgcangcccagatactgctgtacagaacaaagagaacgagttagtccaggacagccgcaatgagtaccctaaactg

SEQ ID NO: 74405 - DNA, 443 bp, Zea mays
  unsure at all n locations
  Clone ID: LIB3079-056-Q1-K1-E12
gtcattcgtgctcgtacatatcctcctctgctgtcctggcgtttgcgggcccggtgcttgctctgccttccggccgcggcaatggcgtcggggaacaacaacaagcagaggagcgaggaggagtggcgcgtcgtactctcccctgagcagttccgcatcctccgcctcaagggcaccgagttacccgggacaggagagtacaacaaattctacggcgacggggtttataactgcgctggctgcgggactcccctgtacaagtccgccacaaaatttgattctggctgcngctggcctgcattctttgaggggcttncaggagccataaaccgaacaccagatcctgatggtaggagggtagagatcacatgtgcagnctgcggtggccatctgggccatgtngtcaagggtgaaagcttcaagacacctactgatgagcgcca

SEQ ID NO: 74406 - DNA, 428 bp, Zea mays
  Clone ID: LIB3079-056-Q1-K1-G11
cttggtgcaaccgtcgttacgtatccccttctagttgttaaggcaagacttcaggcaaaggacatgattaacgatgacaagaggcatcgctacaaaggtacacttgatgcgttcacaaagatggtacgatatgagggtctgtcagggatgtacaaaggaatgggcacaaaaattgtgcaaagtgtttttgcttctgctttgctttttatgattaaggaggagctggtgaagggtgctcgactattggtaactggtaacactagtctggttaagaaactaccatcaaagtcatcaagatgaactacgggcatcgcaagcgttagtatatcatcctaaaaagccatttattatccgcataaaccgtaaacaaggtcgacaagctatagagctcgcctctgctttggatatgtcaactgtaggttacacaa

SEQ ID NO: 74407 - DNA, 328 bp, Zea mays
  Clone ID: LIB3079-056-Q1-K1-G12
cccacgcgtccgcccacgcgtccgcggacgcgtggggggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaa

SEQ ID NO: 74408 - DNA, 258 bp, Zea mays
  Clone ID: LIB3079-056-Q1-K1-G2
cccgagtcgaccgacgggtccgaagggcaagtacatctcccttctcttaggctgggttttcgggcggctacagagctgaagcgaccgggtgacacggtaggttggaggcaccgtcgcactgtacactctgccagttctagatgagaaacatgaggacaacgtacatgcactcggtgagaaggctattaatgaactacagcggggttatgcagttcacgatgataattgcctgatatacatagctatgcacctgcttaa

SEQ ID NO: 74409 - DNA, 291 bp, Zea mays
  unsure at all n locations
  Clone ID: LIB3079-056-Q1-K1-G3
gggagcgatggggtcacgttcgcggttttgttcatctgcaaagcaacatctggaacgcngggctttgatgaggtcgatgaattcatttatcaactatgtgatgtcacacgatatggcgccttaacaaggcctgatttggaatcagacttggcgtctgttcatgaaactgtatntgcaataaagaatgaagctgtcgaagtttgcaacaatagaccattcgaagaatcctcaactctgcagtgttttcaaaggatgttgaatgggtctcatggaagtctatgtcattatcag

SEQ ID NO: 74410 - DNA, 390 bp, Zea mays
  Clone ID: LIB3079-048-Q1-K1-A9
gtcttgtaatactaatcgctccatgagtctgaagtgtgcaaaaatttaggtggcaggctcacaaatttacatgctggttctgttcaacccgtgaatctcctaaggtcacagcgtttttatttcattctatattatatttcagtctggactaatgttgagatctccatatgtatctacgtctaagcatttttcatttgtatttaccatgttggtcaattgggatatttgtttcttgtatgttagcatgtttgaaccatagcaattggtggacgtgtgtagagaagattgcaaaactgcagtatgatggattccactattcatcaaccgagatcatggcgcgcttcaatcgtggctacgctgaatgggaattgatccgttatggctcgtggc

SEQ ID NO: 74411 - DNA, 367 bp, Zea mays
  unsure at all n locations
  Clone ID: LIB3079-048-Q1-K1-B10
gcaaggcctccgacttcatcaacaacttccaccagaagaattgaagggtcgcgttggctgctagctgcgactgctaccgcttccccacgccagcatagcatgcaatatgcatatatatggtcgacgacgacgatggcacacggccggcagcaccaccgcccgccgccgcgccggtccacgctatgcatgcatgcagctacgtttcatttattaccaggttctntgatattcttatatatatgttgacgactatacatattagctgatctcgtttgtcatgttattatgtcgtgctcatttaatcagagagtgagagagaggatgaataattcaatctgctcgacagacatatatcgctgtcattgga

SEQ ID NO: 74412 - DNA, 446 bp, Zea mays
  Clone ID: LIB3079-048-Q1-K1-B11
gccatccccaaatgctaagcaagcgttctgcgtcgtcgcttcgcttgctcgggctcgttgtgtaacatatccagcttatgaataaattatgtggatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatatattaaaaatatacatttttataatataaaaaataaattttttaatttatatttaatattttattttttattattttatttatattaatatttttatatcttttagggggtggggtagttatttattattaattatatatttgttgttatcccttcaaatcataaaaaacacaaaaaattacatctatttctttttatttttaaataattttataattatatccttaaaattaattttctctatatctatttta

SEQ ID NO: 74413 - DNA, 300 bp, Zea mays
  Clone ID: LIB3079-048-Q1-K1-B3
cgctgctttccccccaccgtcccactttcgttacgccgccacgcttcttcttccctgtccggttcaacctccaaccctgccggctgccgcggcggctgattaacacaataccttgtcgagagacgtaatagtttctgaactcaccgcgctacgcccgatgtcggagactgcggctccgatcggcctgtcatgggctcccaatgcttcttcctttgcaacgaccagcggcggcagctagatcgaccacgcgccggatccgagcaccgcgcatggctcgctctggaagcgcacgagcgagct

SEQ ID NO: 74414 - DNA, 156 bp, Zea mays
  Clone ID: LIB3079-048-Q1-K1-B6
gcgcgcacgcgtccgggtatacacataactccaagcggtcgttatttattcttctggatgtcatatttaaggtatacttcgcttgtgtcctacatattatgtatttgtatcatgtatagatacgttttgttttttacttgttctaattataatgta

SEQ ID NO: 74415 - DNA, 438 bp, Zea mays
  Clone ID: LIB3079-048-Q1-K1-B9
cccactcttccgaaaaaaaaaaaaaataaaaaaaaaaaaaaaaaaaaaaaaggaaagggttaaaataaaaaaaaaaaaaaacccaacccaaaaaacccccccaacaaaaaaaaacccaacaaaccaaccccaccaaaccacaaaaaaaccccacaaaaaaacccccccaaaaacaaaaccccacccccccataccccccccccaaccccaaaaaaacccccccctccccccaccaaaaccccctaccccccatccccccacaccccacctcctaaaaaaccccaaaaactcccccccattcccccctgcccaccacaatcccacccccaaaaatccccacaaaacccccccccataccctcccctaaaaccccccccccccctcctctcccccccccccacctaaccccaataccccccccccaaccccccaaccccc

SEQ ID NO: 74416 - DNA, 388 bp, Zea mays
  unsure at all n locations
  Clone ID: LIB3079-048-Q1-K1-C10
gcggctgatgcgggacttcaggcgcctgcagcaggacccgcccgccgggatgagcggcgcgccgcacgacaacaacatcatgctctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatggaagcatctgtttggatatcctacagaaccagtggagtcctatatatgatgttgctgcaattttaacttctatccagtccctgctgtgtgatccaaacccaaactcccctgcanactcagaagcagcaagactgttcagcgagaacaagcgggag

SEQ ID NO: 74417 - DNA, 235 bp, Zea mays
  unsure at all n locations
  Clone ID: LIB3079-048-Q1-K1-C11
cgcttgaaaactactcctacaacatgctcaacacgatcaaggacgagaagagggctgtcaagctgccggcctatgacaacaagaagatcgaggacgccatcnacgcggccatcagctggctggacaccaaccagctcgccgaggcggacgagttcgaggacaagatgaacgagctggagagcctattcaaccccatcatctccaagatctaccatggcacttatgaacacatggt

SEQ ID NO: 74418 - DNA, 438 bp, Zea mays
  unsure at all n locations
  Clone ID: LIB3079-048-Q1-K1-C12
tccgtccgnattcccggctcgcccacctcccccacctcctcgacctttgcttactctacaaaacctcccagggcaggttgtttaatataacttaccncaaagaagttntttattttttcatattcttctcatcttttaatcaatcttttttttttttattctttctttttattttattttttattttatttttttattttcattatttctttctttatatttctttctatattttctttatttttattttattattttttttattttatttaatttttttatttattttaatctaatatttcatttctattcttttaattttttcattataattatcttttaatttttttttttttattctaatttttttttattttaatttttctttttattttaaatattaatactattatttatatttattttattatctattta

SEQ ID NO: 74419 - DNA, 144 bp, Zea mays
  unsure at all n locations
  Clone ID: LIB3079-048-Q1-K1-C2
ggtgtctttacatgcatgatccacgttaaccacactggctgcctttactcatggttgatcacatcaggggcactttgcatctggggctgnttcttcgaccaacttctcaaactgagttgatcgtttactctgatgtcgattggg

SEQ ID NO: 74420 - DNA, 286 bp, Zea mays
  Clone ID: LIB3079-048-Q1-K1-C3
cgcacgcgtccggatttactgaagcagtttgtagaggaggtttctctccatcttgcgcaaggctaaagcagagaaaaggctttgatgctgagttatcaagttgctgaagacttggctagagcgtttactgagcgtacgatcctccaaatatttttggaggatgagattaatggtccttctggtttcctaaaggaggtacttggcttgctgagatctctatatgtcatggtgaacatatttgaatccacatcttttctaagatacgggcatttatcacgtgacaatg

SEQ ID NO: 74421 - DNA, 155 bp, Zea mays
  Clone ID: LIB3079-048-Q1-K1-C6
gacaaaacagcgtccccctccctctactaaaaaaaaaatggaggcatgagctgcgccgtcttctcgtctctcgccgatctccccaaaccctagccccgacctgaccgcctgctggcccgccggccggagaaagagtcgctcccacccacccaact

SEQ ID NO: 74422 - DNA, 378 bp, Zea mays
  unsure at all n locations
  Clone ID: LIB3079-048-Q1-K1-C9
gccaggctctcagcgacgactagaaggggtcgccgaggagcactctggtgggggttggtcacaccgatgccgcggagagcccgcccgcgacgacggagaaggcgaagggcaggaggccgccgccggctcgtggccatggtggctcagcagctccccacttcatgtcctccacggtgtgcagccggcagagacggtgcgcgggaggctaccattctgtcggtaacggtaagccgaggctgacggcggtgtcggtgaacaagtacccgccgccggctgctganctttatgggagccagaacgcggctgccagggctagcaggtcggcgtcagtggcactcctcgccggtgtgcacaagttgagtgtgcttgcgtgtcaac

SEQ ID NO: 74423 - DNA, 247 bp, Zea mays
  unsure at all n locations
  Clone ID: LIB3079-048-Q1-K1-D10
ctcgcgctctctcncgggggggttctttttcngtttnntcncccnttcnnnncnttnttttncttttttttttcttttctttttttttttttttttcttttttttttttttttcttttttttttttttttttttctttttttttttcttttttttttttcttttttttttttttttttttttttttttttttttttttttttttttttttttttttttttttttttttttttttttttttttttttt

SEQ ID NO: 74424 - DNA, 63 bp, Zea mays
  Clone ID: LIB3079-048-Q1-K1-D12
cgtccgattcccggtcacccacctccggttgcttgaggatgattaaataactgcctcctcata

SEQ ID NO: 74425 - DNA, 130 bp, Zea mays
  unsure at all n locations
  Clone ID: LIB3079-048-Q1-K1-D2
ttttcgctttaagtgcgccaccttcgagtanacaccgtatcttccgccccttcggcggcatgagcngggccctcatctactgcaccgccagcatctcctgcgggcacatcaacccggcggtgaccttcgg

SEQ ID NO: 74426 - DNA, 291 bp, Zea mays
  unsure at all n locations
  Clone ID: LIB3079-048-Q1-K1-D3
cgcacgcgtccgggttggtgtggataaaaggactggatctgctggtggaactggcgggcgggtattngttcgagacattgaacttttctcctattgtgagtcatgcttgcttccattcagcatacagtgccatgtcgggtatgttccctcaggtggaagagttggttgtttaagcaagctgtttagagtatctgatgtctgttctaagagattgcaaaacccttaaagactttctattgaaatctgtggtgcactgcatgcttgcattcaacctgcttgtgtggctgttgc

SEQ ID NO: 74427 - DNA, 157 bp, Zea mays
  Clone ID: LIB3079-048-Q1-K1-D5
gcgggtaaattagcagtcctgtgttgtgactcatattgagtactttgcttcgatagatgggttttatagtagactacgtgcaagacgcggagtcgctggacctatataatacttaagataatattttggtacgatcctctgaatcgtgccatgagcc

SEQ ID NO: 74428 - DNA, 220 bp, Zea mays
  Clone ID: LIB3079-048-Q1-K1-D6
ggcttctagcctctgtccaagccggcagcccgccacccgcgaggccgcgaccggcggccgaccgcccctgacgtggtgactgcgtcctgctccgctctccgtgcgccaccctgaagcggtgaggcgaggaccttcaagcaaccgccttcctggttcggctgctaccttgaggcctttctttccaccggttcaacagattctgatccgaacggccaaaggc

SEQ ID NO: 74429 - DNA, 278 bp, Zea mays
  Clone ID: LIB3079-048-Q1-K1-A7
ttctgtattatgaagcaacgtggtgagtaacttccctgataagattgtatcgtaggcagctgagttccagagcaggatcggtttcgggatgattggtgtgggtgacatcatatatttggttggaggagtgattggacctgggccgagaaaccaatgcattaagttgcattctgatgttgatatctggaacgtcacaatgtgtgagccaacctggagaccagtgtcgtcgatgactcattttcgaggtagcatctgtggctgcgctttgttgaggattt

SEQ ID NO: 74430 - DNA, 266 bp, Zea mays
  Clone ID: LIB3079-048-Q1-K1-D9
cggactcttgggccgcgcgctttgctctggcgagaagggcgtgggcaagtcggggagtctcgctccactacaagggctccaccttccaccgcgtcatccccgagttcatgtgccaaggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttc

SEQ ID NO: 74431 - DNA, 299 bp, Zea mays
  Clone ID: LIB3079-048-Q1-K1-E1
caagcttcttctcattggggatagcggtgttggcaagagttgcctcctgttgcggtgctgtgatggttccttcactacaagctttattaccacaattggtattgactttaagatacggacaatagaattggatggcaagcgtataaagctacagatttgggatacagcgggccaagaacgctatcgtactattaccactgcgtactaccgtggagctatgggtatcttgctggttaatgatgtcaccgatgaatcttctttcaacaacattcgaaactggattcggaacattgagcaac

SEQ ID NO: 74432 - DNA, 275 bp, Zea mays
  Clone ID: LIB3079-048-Q1-K1-E10
aaaaataaaaaaaaacaattcaacaaaaaaacaacaaaacaaaaacacaataccaaaaaacaaataacaaaaataaaccaaaaaacaaaaaaaataaaaaaaaacaataaacaaaaaaaaatacaaacaaacaaacacaaaaaaaaaaaaccaaaacaaaaaacaaaaaaaaaaaaaatccacacacaaaaacacacaaaaaaacaacacacacaaacaaaaaaaattcaaaaaaaaacaaaaaaaataaaacaaacaaaaacaacaacatacac

SEQ ID NO: 74433 - DNA, 158 bp, Zea mays
  unsure at all n locations
  Clone ID: LIB3079-048-Q1-K1-E11
caagaacccccaccatccccactcgcctgcagatcgattcgcgaaagagacgggcgcgttctcatcttaccgttcccnnaccccccctctcctcgctgactcggctcccctcctccgccgtcgcctgaagctaagcaagttgtgaccacatattcatt

SEQ ID NO: 74434 - DNA, 283 bp, Zea mays
  unsure at all n locations
  Clone ID: LIB3079-047-Q1-K1-F11
cgacaacaccaagtactacgagatcctcggtgtgcccaagtcggcgtcccaagaccgcctcgttaaggcctaccgcaaggcanctatcaagaaccaccccgacaagggcggtgaccccgagaagttcaaggagctcgcacaagcctatgaggttttgagtgatccatagaaacgtgagatttatgatcagtatggtgaaaattcccttaaggaaggaatggttgttggtaatttctttcctaattcctttttcatcaacatttctttcttcataattatttat

SEQ ID NO: 74435 - DNA, 70 bp, Zea mays
  unsure at all n locations
  Clone ID: LIB3079-047-Q1-K1-F12
ggttcggaacccgctcgggccagcgtccgggctacagacgcgccaggcgtccttcagtagncgccggccc

SEQ ID NO: 74436 - DNA, 428 bp, Zea mays
  Clone ID: LIB3079-047-Q1-K1-F5
ctcttcagctcggtgctgtggatcttctacgcgctggtgaagaccaactgcgagcgtctgcttaccatcaacgccttcggctgcggcgtggaggcggcctacatagtcctctacctggcgtacgcgccgcggcgggcgcgcctgcggactctggcctacttcttcctgctggacgtggcggccttttcgcttcgtcgttttcttttctcttttttttctccttttgcttttcttcgttttgttctttggctttttttttttgtttttttcttgttcttttttcttttttttttttttttttttttttttctgttttttttttctttttttcttttttttcttttcttttttttctttttctttttttttctttttttttttttcttttttttctttttttttttccttttttttttgtttctttcttt

SEQ ID NO: 74437 - DNA, 440 bp, Zea mays
  Clone ID: LIB3079-047-Q1-K1-F7
agagaaactaccaccaaaaggtcctactaaattcttgatcaacttgagagagagatggtatctgatcgccaaagaattgaaggggcacctcctccggtggttgagagttccatgccttcaccgcctgcatatgaagaagtcaatggtatattcatgaggaatacggtcgcatagttggtcgagaccgtggagtatttcctggcttatgcaatttaatcatatcgagcatagagcgacactgatctcaacctttcagcttgtgactacatagttgtttctaaaggtttcttacaattgatggtccgattgttaattcatttttagtgctttctttttcttttacttcttcattttttattctttttcttttttttctttgttttttttttctatttttttatttttttcttttttttttttatttttttttttgttttttt

SEQ ID NO: 74438 - DNA, 127 bp, Zea mays
  Clone ID: LIB3079-047-Q1-K1-F8
ccacacgtcccagaacaacaacaacacaacttacattataaaaaaaaaaacaaaacaaaaaagaaaaagaaaaaattaaacatataaaaaaacccaacccacaaaaacaaaaaaaaacaacaacaaa

SEQ ID NO: 74439 - DNA, 65 bp, Zea mays
  unsure at all n locations
  Clone ID: LIB3079-047-Q1-K1-F9
gcgngaacctacaacaccgcactctacactactccagtctgtgaatccgccccacccccgcaccc

SEQ ID NO: 74440 - DNA, 76 bp, Zea mays
  Clone ID: LIB3079-047-Q1-K1-G1
cattcccaactccacccactcctcactacatactatataaactaccaccaaaattttctattaaatctttatcaac

SEQ ID NO: 74441 - DNA, 239 bp, Zea mays
  Clone ID: LIB3079-047-Q1-K1-G10
cgccacgcgtccgggcacattgtgaatgatgttccaaacagtttgctgaagcacatcgttggctagaacaattaaaacaagccagtgacaaacagcagagatacacatgaggtgaagcttgagcaaggccttcaagtgcttaaggttttcaaggatcatgtgtgcaagacatctatactggatgactttggcttttacgataatcgtgagaagatgattcaatataggaaagcaaagca

SEQ ID NO: 74442 - DNA, 462 bp, Zea mays
  unsure at all n locations
  Clone ID: LIB3079-047-Q1-K1-G12
agcaaatgcctccccggagctcatcatacaggctgatcccagaccatgctaggcgncgtcttgttctcactttattgcccaccgctggaccataggcgaaggctctatggtgtttaaaccttgctctttctgattcttcgttgtgccataggcaattcaaggtgtagaatctgaccattattggaaagccaaacacgagctggcgccaatgtgttgcataatgagaggcggtatgttcgtgcagccagccttttgccgcctgttttaatgcaaaatctgattttacttaagcagtgtgaggggaagtgtgttggtttattttattatttttttatatttttctatttatttttttttttattattatttttataatgtggttttctttttatttatactcttattttttttatttttttcttctctattttattttttttttttttttgtttattttattat

SEQ ID NO: 74443 - DNA, 227 bp, Zea mays
  Clone ID: LIB3079-047-Q1-K1-G3
tgcctgtccactgttggcttggtgacttcctccgctccgctccgctcccctccgctgccgaagtgtcgatctttgcatggcagcagcagctggctccaaggggcgggcgatcgctggaagcttcgtcagccgcgtcctcgccggcaaggccgtctcgccgaggagggccgtgcacgcctcggcgtacgacatgaacctggaggaccaggtgcgcccggcgttcgtgc

SEQ ID NO: 74444 - DNA, 97 bp, Zea mays
  Clone ID: LIB3079-047-Q1-K1-G4
aaaaaccaaacaaaaaaacaacaaataacaaaaaaaacacaaaaaaaaaaaacaaaacaaaacacaaataaaacataaaaaaaaaaacacacatcac

SEQ ID NO: 74445 - DNA, 351 bp, Zea mays
  Clone ID: LIB3079-047-Q1-K1-G7
cccacgcgtccgtgctcgggtgaactgaaatcagcggccaaaagaaactcgagtgtcgtcagctagaccatattacatgccggacaatttgttcggagacctgatcgacgtgaagagttttggcgccggaagcaagatcagcaggtctaccagcatgccgagtccaaagggtggtggccagcctatgatcggtagaaacaaataggcctctgctgtttaagatagggatgagcatatatttagctggtagccactgtcgtttggtttgattgtaattttgctgtctttttttacgtgtcaatttggctgattttgttattatggttatatttttggattttcttttttttt

SEQ ID NO: 74446 - DNA, 270 bp, Zea mays
  Clone ID: LIB3079-047-Q1-K1-G9
agcaggacagggaaaatgtctcgaacaatatcaaattcagtaatgtgtatgtgaaggatgtgtccgatactgttactgatgatcagttgaaggagatgtttggaaaatatggaaccataacaagtgctgttgttatgcgggatagtgatggaaattctaggtgttttggatttgtcaattttgaaaatgcagatgctgctgctcaggctgttcaagagttgaatggcaagatattcaatgataaggaactgtatgttggaagagcacaaa

SEQ ID NO: 74447 - DNA, 359 bp, Zea mays
  Clone ID: LIB3079-047-Q1-K1-H4
gcgcacgcgtccggtcaagtcgaaaccagttctaatgataggatcagtgtatctctggagatacgttattgtttaccctaccgtatctgtaaagtaatgatgccggccgaactacctttcctaacgcgtttgggcagaaattcgttgctgtcaccatattttgactgttgtttttttctttttgtcttttgatttttttcttttttttctttttttttttatttttttttttttttttattttttttattttttttttttctatttttatttattttttttttttttttatatttatttttttttttttgttttttttatttttttttttttattttattttttatttttctttttttt

SEQ ID NO: 74448 - DNA, 131 bp, Zea mays
  Clone ID: LIB3079-047-Q1-K1-H6
ccttattccctctcgacccactcatcctaaaaaaaaaaaaaaaaacttttaattttaaaaaaaaaaaaaaaaaaaataagaaaaagtataattttaaaaattttaaaaccaaaacaataatatattataat

SEQ ID NO: 74449 - DNA, 379 bp, Zea mays
  Clone ID: LIB3079-047-Q1-K1-H7
cccactcgtccgggcttgcgtccggttattcccaggtgtcagtatggactggttttgtttgtattccattctactgtttcacaagttacatgtatatttatcgagtctattgaatatagttcttattatcatttttcatgttcaatctctttttttcttgatcagatcaattcttttctttaattatttttttttcttttttaaaatttttttatatatttttttttttttttttttattttttttttatttctttattctttttttttttatctattttttatattttttttattttttttttttattttattatatttttatttttttttatttttttattttttattttattttttttatatatatatttatattt

SEQ ID NO: 74450 - DNA, 315 bp, Zea mays
  Clone ID: LIB3079-048-Q1-K1-A1
ccagaccgcattgagtgttatgctgagaggactgccaaaggtaatgtgctcgaaccgcaagggttaattgaaattaagttcaggtcagaggaactccaagactgtatgggcaggcttgacccagagttgataaatctgaaagcaaaacttcaagatgcaaagcatgtaaatgtaagtctaccatacatagaatcgcttcagaagtgtttagaaacgcgtacaaaacagttgttaccttgatatacccagattgcagtacgctttgctgaattgcatgatactttcctgagaatggcagctaaaggcgtgattaat

SEQ ID NO: 74451 - DNA, 359 bp, Zea mays
  Clone ID: LIB3079-048-Q1-K1-A10
catttcttctctctctgctcctccgcctccgcctgatccatccaagacagggagtcggcatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggat

SEQ ID NO: 74452 - DNA, 124 bp, Zea mays
  unsure at all n locations
  Clone ID: LIB3079-048-Q1-K1-A11
agacattatcacgtattgcttcactgttacatgcagcgccatacccaaccaggatctgctgtgttttactattaccaccaccacctcnaatccaanacctacacttgcacttccaatacctacc

SEQ ID NO: 74453 - DNA, 243 bp, Zea mays
  Clone ID: LIB3079-048-Q1-K1-A12
agtcacatccatcatccatccttgcttccaagcaccaactaatcaaataacgagcagccttattaaaaattactcaccatccacaaacaaaaatcaacaacctcacttctaccttctactgatactgacactaacaattgcatccaatctgttctctcttcataaagaaaccatcctccaaatctaattcttcttctccctccaaaacttttacatcttttcactccataccccatctttttt

SEQ ID NO: 74454 - DNA, 156 bp, Zea mays
  Clone ID: LIB3079-048-Q1-K1-A2
cgcacgcgtccgcacatatatgatcttgtctgtgtgtcaatgtgtcgaaaaacatagctggggtttagctatatgaatgtaacgcgcaatgtaacatacaggactagctgcttgcttgacgatgcgtttgcgtgtatccgtataaattaaaggcta

SEQ ID NO: 74455 - DNA, 297 bp, Zea mays
  Clone ID: LIB3079-048-Q1-K1-A5
caacaacgtgaagtcgagtgtgtgtgacattccaccaattggcctgaagatgtgctgcgacattcgttggcaactcaacctccatccaagagatgttccgccgcgtcagcgagcagttcacggccatgttcaggaggaaggctttcttgcactggtacacaggctagggtgttgatgagatggagttcaccgaggcatagatgtacatgaacgacctggtggccgagtatcagcatgtcttggatgccactgccgaggatgaggagtacgaggaggatgaagatgaagaggaagaga

SEQ ID NO: 74456 - DNA, 156 bp, Zea mays
  Clone ID: LIB3079-048-Q1-K1-A6
gcgagcttcccctgtcagtggtgcttgtgttaccaaataggttccctgtctacacggctgggtgttgtaaaatatcaagagcatgcatagctagtgcagctactgtgcagggaaatgagaatgatgtcgaagagctagagatgtcgctggaggcat

SEQ ID NO: 74457 - DNA, 334 bp, Zea mays
  Clone ID: LIB3079-047-Q1-K1-C11
caacaatggaggacatgattttcatgctacccttccaaataacatgactgaggaagggtatgtgatggaagaagaacaaaggatctatacaaggcttcaacaagagaggagggaaagggaggaggctattaaaaggaaggctgagagaaatgcaaaaatgaaagctgagatgaaggaaaagactatgagaatgttcctggtttctcagaaacacattgtttacaccgaaccacttgaaatacatgctggaactactattgatgtgctttataatccttctaatacagttctaactggaaagccagaggtttggtttcgatgttcatttaatcgt

SEQ ID NO: 74458 - DNA, 338 bp, Zea mays
  unsure at all n locations
  Clone ID: LIB3079-047-Q1-K1-C12
acgcttcaaacacatattactaataatgtttccctttcatcataatcccccctacaaaaggaaccgttctcttttatacaacaacatccttctcaanaactccaacatattctatccaaataatactctctatctacatttgacactttcaaacttaacctttcatttacataatattacccaaacaaaccaccaacttttctattttattctaagatattttatccaaatatatattcttatataaacaatctttttgatattctacaaaaccattttaatcctatatatgatttttctccaattttaactttttatttcattctattcttttatta

SEQ ID NO: 74459 - DNA, 436 bp, Zea mays
  Clone ID: LIB3079-047-Q1-K1-C4
tgcccctgctcacgttcgccgggcgcttcctcttcgggatcccgaccatcctggccgtgaaagtctgcttcaaggctctgtccaagtggctgctgcccgttttgtgcatcaccctgttcattcttaccttgtcattctgctacttccagttctttatagcttacagctcatcttcaatatacttgtttttctcttctctttttcatcttttgcttttactttatttttttttttatgttttattttttttttttttcttttttttttttattttttttttttttttttttttttttaatgtttttttttattttatattttttttttttttttaattatatttttttttttttcttttttttattttctttattattttttttttattttttttttttattatttttttttttattttattttaattttttttttt

SEQ ID NO: 74460 - DNA, 122 bp, Zea mays
  Clone ID: LIB3079-047-Q1-K1-C8
tcgcacacgtccgtgccagttccatgttacctcaagctaccctgtatctggcatacgtaggattgtcatcttccacatcataaccttcaacactgacatgcattctttaaatcttctattca

SEQ ID NO: 74461 - DNA, 142 bp, Zea mays
  unsure at all n locations
  Clone ID: LIB3079-047-Q1-K1-D10
cggcggctcancancatcacaaccactgccctaagatggtgaagtttctcaagcccggcatggtcgtatttcttcttcaccncaccttccccnnccggaaggcggttatcgttcgcgtgttctatgatttcacctcttacct

SEQ ID NO: 74462 - DNA, 484 bp, Zea mays
  unsure at all n locations
  Clone ID: LIB3079-047-Q1-K1-D11
ccaggacagcaaagaaaacgccagcgtcgactacgtcggcggcggcgacgataccggcncggtaccggcacctgctcagcaaggacccagcgaggcgaaggggaaagcgaaatcgaagcagcatacggcggagatggaggagaggcagcccgtggacgccagagtgactgtggagtacgaccaccgaggcgtctgttgggtctacttgagccttatgccttctcttgcttttattagctacaactcatttgctatctgatttctagttttttattttttactcttctttactcttttattttttattgttttgttaatattttatttactttatattatatttcacnctgtttttttttttttatttataagcccaannaaaaatggttattttcaattttttataacaaccaatttttaaattaattttttttattatatttttatttatatatatatttttttttttattttattttatttt

SEQ ID NO: 74463 - DNA, 53 bp, Zea mays
  Clone ID: LIB3079-047-Q1-K1-D12
caacaagactctacacaacctgttcttcgtctatatgaggctgggtctcttca

SEQ ID NO: 74464 - DNA, 425 bp, Zea mays
  Clone ID: LIB3079-047-Q1-K1-D2
atcaaatacatactggctcactcgagtttccttcacccagcagttcgtaaccacctgctaaatgatcaaaaagatggccccctgcaaagtagcagcagccttactcctgttgatcacaacaatttccgtcaacaccgtaaccgggtcgcgatgtaacgctcaggagaagaaccagattgtgagcttgtgccaaatgtacatccagagaggaaccctcgttcagcttccatcccaaactgggccatgctgtgctgctgttatagagcctgataggtttcacagggtttatgcagatgaagtgcatttgcggtcttttttacccttgatacttttttaattattatctatcttttatctatttttttttatttttattgattacttttctctatttttgttttattttttattttttatctttttta

SEQ ID NO: 74465 - DNA, 192 bp, Zea mays
  Clone ID: LIB3079-047-Q1-K1-D3
ggttcgacctcagtggttgagccatattacagtgtcctgtccacccactccctcctggtacagtctgatgttgctatcctgctggacaacgaggccatctatgacatctgccgccgttcccttgacattgagcgcccaacctacaccaacctcaacaggcttgtgtcccaggtcatctcatccctgactgcc

SEQ ID NO: 74466 - DNA, 417 bp, Zea mays
  Clone ID: LIB3079-047-Q1-K1-D6
cgcacgcgtccgaagaccatttcccttctcctgatcgtcctgttcctcacgtcatcgtccatttctgccgatccggagaagcaggcggcccccgcggcacatgagactgccgtgcacatcgtgtacgttgaccgtccctaggacgctgaccctgatgagtttcacattctcaccttttattttttcctttttagtttacatattgtttttgtttctttgtttttattattcttttacttcttttttttttttttctttttttttttttttttctttttttttttttttgttttatttatttttttttttttttttatttttttttttttttttctttttttttatttttttttttttttttttttttttttttttttattttttttaatttttttttattatttttttttttttttt

SEQ ID NO: 74467 - DNA, 100 bp, Zea mays
  Clone ID: LIB3079-047-Q1-K1-D7
taattggtgtaatggtatcgtattggttttttgagcattgagttactcatagtttctgatgtttttttattatcgttaaacttttaaaaatatttaaaat

SEQ ID NO: 74468 - DNA, 402 bp, Zea mays
  Clone ID: LIB3079-047-Q1-K1-D8
taaaaaaaaaaaaaaaaaaattaaaaattaaaaaaaaaaaaaaaaaaaaaaagaaaaagaaaaaatataaaaaataaaaaaaacaaaacaaaaaaaaaaaaaaaaaaaaaaaaaaaaaaaaaaaaaaaaaaaaaaaaaaaaaaaaatcaatcaaataaaatacataaaaaaaaaaaaaaaaaaatataaaaaaatttaataaaaaaacaatataaaacaaaaataaaaataatataataataaataaaataaaaaaaataataaaaaatcaaaaaaaaattaaaaataaaataaataatataaaaaaaaaaaaataaaaataaaaataaaataaaaaaaatatataaaaaaaaaaaaaacaaacaaattaatataaataaataaaaaaaaaaaaaaaataaa

SEQ ID NO: 74469 - DNA, 307 bp, Zea mays
  unsure at all n locations
  Clone ID: LIB3079-047-Q1-K1-D9
cgcactcgtccgtggagagcgagtgttagagttggaactgatgtgttttattcttncggtgggtttcttctgttcatataacatccccnaaccctgctggtcagataagatttgtgaacacaccttgcgactgagagagaaggcgtcttataatttgatatgaacaagaatcaacaatgttcattattaaaaaatattaacaaacatatctatttattttttattattattatctaatattattctctctttaatttattttcttattatttttaattttttcttctatatttacttttttattttt

SEQ ID NO: 74470 - DNA, 281 bp, Zea mays
  Clone ID: LIB3079-047-Q1-K1-E11
caaaaaaaaaaaaaaaaaaaaaaaaaaaaaaaataaaacaaaaaaaaaaaaaaaacaccgaactctaaaaaaaaaaaaaaaaccaacccaacccaaaaaacaaaacaaaaaaaaaacaaaacaacaaaaaaaaaaaaaaaacaaaaccattggcccattctcaaatatacttacctcaacctccacacaatttaaagaaaaattcccatcacttcctactaaaaaaagaaccaaaatccccatttcaaaaacacccaacactaaaacaaccttaaaccaaa

SEQ ID NO: 74471 - DNA, 230 bp, Zea mays
  unsure at all n locations
  Clone ID: LIB3079-047-Q1-K1-E12
cttcatttcaccatgtcnntcagcaatcgatttgctgnggccnccnccctcacctcggccgtttattttatatcttctccacacctcccaccanctnnanccaaaaaatactaaacaatatcacctttacatactttctataccattaacaattacctctattttttcaaaaactctatcttttatctctttatctttattcattattattttactatttttttaaattt

SEQ ID NO: 74472 - DNA, 101 bp, Zea mays
  Clone ID: LIB3079-047-Q1-K1-E3
gcgactacaccctacaggtgtcagtcattcaatttccctgggtcccattagcatcatgccttcagaaccttatacgactctgttcagtccatcaaacctac

SEQ ID NO: 74473 - DNA, 432 bp, Zea mays
  Clone ID: LIB3079-047-Q1-K1-E4
atcccgctcgacccacgctccgcccaccgtccgcccacctccgatcagttttagcatggattgctgataatctggctatggactgttattggaatcaaccatttgcatctcttttattctctaaagatattataactcattttaaagatctacctactattttcatcttttttttatttttttttattattttttttattttttttatttttttttatcctttttttttcatctttattattttttatttattttatttttttattttttttatttattattttatttttttttattaatttttttttttttttttttttatttcttttttttttttttttatttttttttttttatttttatttttttttttttttttttttttttttttctttttttttattttttttattttttttttatttttttttt

SEQ ID NO: 74474 - DNA, 431 bp, Zea mays
  Clone ID: LIB3079-047-Q1-K1-C1
ctccaagacttccagcggcatgtgaattagcttctgggaaaggtcgatctctaatagattctgcttgttcataacttaaacggcatacacattttctccttttcttcactagtactacataaataacttgtgaacagtaccgagggtgtatatattgcagtgacaaataactaggacactgctaattctactgctggcttaccactgtcttggttagatttatccctacaagattgtttactgtgtatttcttatgtttatttagtcatactttgttttttatatatttttttttattttttttttttttttttttttttttatatttattttttttatttatttttttttttttattttttttatttttcttttttttttttattattttttttttttattttatttttttttttttttttttttttttt

SEQ ID NO: 74475 - DNA, 96 bp, Zea mays
  Clone ID: LIB3079-047-Q1-K1-E5
taatcaaactcctttcatgcattcaattataccaaaaacacataaacataaacgcaaagcaaccttttacaattcatgtcaccccatcaaacctac

SEQ ID NO: 74476 - DNA, 192 bp, Zea mays
  Clone ID: LIB3079-047-Q1-K1-E6
cgccagttcaccacccaccttccacttccagttcaccccgtcgtcctcggggccagggctccttttccccctgcgctactcccccgctccacggtccaaggaaagatggcgtcccatattgttggataccctcgcatgggccccaagagggagctcaagtttgccttggagtctttctgggatgggaagagc

SEQ ID NO: 74477 - DNA, 420 bp, Zea mays
  Clone ID: LIB3079-047-Q1-K1-E8
cgtccccctgcatatactaacactgcaaaactgaaaagggtgatagcaaagtacaagtaggattgtgtacatggcagctgttatgtttttggttcttgcaaccatgtcttctacctccccatcattctgccaagctgggggctgcatcggctgcccacggtctccaccaccgccgtccgatgagacatgctactaggacctcaagtgttcggcttctatgtgccaccttggttgcatacacttgtgcttcattgtttctgtttcttactgttcttttatgttcttcttctttttactttgattcacttttttgctttttttctttctatttcttacttttttttctatatgtttttcctttttttttttacttttatttttttttttttttttttatttttttttctatttttttatttt

SEQ ID NO: 74478 - DNA, 364 bp, Zea mays
  Clone ID: LIB3079-040-Q1-K1-A12
cccacgcgtccgataaaaaatatgtatatataaaaaaatactataatataatacaatagtttgaacaaagctaaaaaatggataaaaaaaaaaaaagtaataaatggacggtccaaccatggggcctaagcttatcaggccccaaggttatctacgctggcttgcacatgttaccgctttagacttcgatgtcactctaatttcaattgacatgcccatgactatcaaaggccagactgatacaaccttgattgtcccgaagttaatcacattgtacagattgccttttgtccagttggcctattaccgaagaggccatcgacgatcggccttaccagaatttggactgcctgaatgcctattg

SEQ ID NO: 74479 - DNA, 357 bp, Zea mays
  Clone ID: LIB3079-040-Q1-K1-A2
aagaaaaggagccagatcagagaagaagtggtggcgatgccgccgagggcagtgccgtcgtcgtctcccttgcctcttgcactcgccgccgtcgccatagtcgtcgtagcacttgccgtttcctcctgttccgcgaccaccgatgctccaggcctgggagtgggagcgagagagatggtggcacgggacgaccccaagtgcgaggagatggtgccctgcaccttcaggcgctgcatccagtactgcgtcagcatcgggctgcagcccaaggggttctgcaactccaagcccaacatgcaggtctactgctgctgcgtcatcccctagcatcatagctcctcgtcaacacacctaaat

SEQ ID NO: 74480 - DNA, 426 bp, Zea mays
  Clone ID: LIB3079-040-Q1-K1-A3
aaccacaccaactctccccaatccagcagccctcgagtctggtcccccacccctcagcgcgacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgccggcaggtcgaggagctcatctaggaagccgaggacgagctcaagctcatcgctaaaatgattgaatgggatccatggggt

SEQ ID NO: 74481 - DNA, 344 bp, Zea mays
  Clone ID: LIB3079-040-Q1-K1-A4
aaccacaccaactctccccaatccattattcctcgagtctggtcccccacccctcagcgcgacgaatgtaagatgttcctgctgaggatcctgaccggcgggggcggcctggcggccctgagggcggcgcgcgccgtgaaggagactacggggatcgtgggccttgaggtggtgcctaacgcgcgagaggttctggtagggctctacgagcgcacgctcaaagagatcaaggccgtccacgaagacgagggttaccgcatggccgttgaatccttcaccggtcaccgcctccagatctgccaggacgaggaggactggatgcgcatcgaggaccgaatcggatg

SEQ ID NO: 74482 - DNA, 351 bp, Zea mays
  Clone ID: LIB3079-040-Q1-K1-A5
accacgcgtccgcgaagatgttccggaaccagtacgacaccgacgtgacgacatggagcccccaggggcggctgttccaggtggagtacgccatggaggccgtcaagcagggctccgcctgcgtcgggctccggtcgagcacccacgccgtcctagccgccgtcaacaagcccgcctccgagctctcctcctaccagcggaaggtgttccgcgtcgctgaccacgccggggtcgctctcgccggcctcaccgtcgacggccgcgttctctcgcgtttcctccgcaacgagtgcatcaaccactccttcgtctacgaggcgccgctccccgtctccaggctcgcgctcaagc

SEQ ID NO: 74483 - DNA, 371 bp, Zea mays
  unsure at all n locations
  Clone ID: LIB3079-040-Q1-K1-A6
gttcggccagggatagcataacaccgccgaggaagcagcaagcagcaaggtcgacatgtcgtctccgccgccggtgaagctgatcggcttcttcggcagcccgtacgcgttccgcgcggaggcggcgctgtgcctgaaaggcgtgccgtacgagctgatcctggaggacctgttcggcagcaagagcgagctcctgctccaccacaaccccgtgcacaagaaggtgcccgtgctcctccacggcgacggccgggccatctccgagtccctcgtcatcgccgagtacgtcgacgaggccttcgacgggccgncgctgctccccgccgacccctacgcgcgcgccgcggcccgcttctgggccgacttcatcg

SEQ ID NO: 74484 - DNA, 360 bp, Zea mays
  Clone ID: LIB3079-040-Q1-K1-A7
gagctccaaagtccaaagattagtgaatccaaaaggcgaccaaacagatcccccgctcctgtgctccgctcatgttagagaaccccctgggaaaacgcagcggagaaactctggagatcgaaaccccggcacgcagctaggcgaactgcacgcaactgcaggtcgacgtctgatccatttcttgacgcttcagcttctggtgctggtcttcttccagttgcatgctggttacctgtgtcaaggggcggttggtgtctggtgtagttggagggcagagcttcgcgggcggcgaagaagaagagcagcagagagactctgctgacactgaccgtaggagatatggcgaggaagctgagagag

SEQ ID NO: 74485 - DNA, 427 bp, Zea mays
  Clone ID: LIB3079-040-Q1-K1-A8
gcggtaccgtcgaccgccaccaaccaggcatctgatcagccaacaaggtgactctggcctgcagcactggaggagattcgttagcgcagagactggtaggacctgtaggagatagggagaaagggtaaacgattagatgacgagaggatgatgctatatttatcaagtccgcagcgcctctcttgtggtggcccgcgacacacgtggggtgattgacagtgacatcgctcgctctaagataggttttggttcttccctggcccccggaaatcatcacctggcgccgccacattcgaatggagatggatctgctgtcatcatcttgcttcctattttgtaaagcttttgctgctgagtatagtggtaccttagattgtcgtccatttctgccctgttttccgggcagctatttgtagtgtaaaatatg

SEQ ID NO: 74486 - DNA, 83 bp, Zea mays
  Clone ID: LIB3079-040-Q1-K1-A9
aaaaaaaaaaaaaaaaaaaaaaaaaaattaaaaaaaaaaaaaaaaaaaaaaaaaaaaaaaaagggctgacaatttaaagggta

SEQ ID NO: 74487 - DNA, 382 bp, Zea mays
  Clone ID: LIB3079-040-Q1-K1-B1
ggattatccagcgagggacgccggtttgatgctcgtactgctgcctggttgcccgaggcggctgtggcgggtcgaccatgtacagatcggcgtgtgtcgtgatggcgtggaacgtgttacggttctgcactgctctagcgtgggctaggttcaatcatgatcctgctcgtgctcgcgatcgtcggcgttactctactacgctgtcgtgctatgcaactacagtgctgtcctgatcaccggtggcggcaccactctggtcgcgctcgcagtgatgctctgcttgcacttcctgcttgctatgcttctatggagttattcatctgtcgcgttcactgaccctggttctgttccaccagatcggaatcttgattctgatgtggag

SEQ ID NO: 74488 - DNA, 415 bp, Zea mays
  unsure at all n locations
  Clone ID: LIB3079-040-Q1-K1-B11
tcgggtttcaccaatgtggatgagattctacatacgggcaaaagtgcttcagcccctggaatctggctcttggctcaattagctgctgcgaaagttgtagcaacggcactttgcaaaggttctggtcttgttggtggcctttatgctccaagtttgatgattggcgctgctgttggtgctgtttttggaggctcagcagcagaattaataaactctgcgattccgggtaacactgctgttgcacatcctcaagcttatgcactggtaagtttcttattttttgtcagtcagtttaacgcgtgactcctatattgggctaactttccatacgatttangtgggaatggctgctacgctggcttcagtgggttctgttccactgacatttgtgctgctactctttgaattgaccaag

SEQ ID NO: 74489 - DNA, 300 bp, Zea mays
  Clone ID: LIB3079-040-Q1-K1-B12
ggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcagc

SEQ ID NO: 74490 - DNA, 369 bp, Zea mays
  Clone ID: LIB3079-040-Q1-K1-B2
ctacaagatgcggtgcgtctacgctcactttcccatcaacgcctccatcaccaacgccaactccgccattgagatcagaaacttcctcggggagaagaaggtcaggaaggttgatatgcttgaaggtgtgaccatcttgcgttcagagaaggtcaaggatgagcttgttcttgaaggcaatgatgttgagcttgtctctcgctccgctgctctcataaaccagaaatgccatgtcaagaagaaggatatccggaagttcttggacggtatctatgtgagtgacaagggccccatctttgatgagcaatgagctgccctttgttcctggctagcacaagccgtgttaggctgtggccagtagactgtttg

SEQ ID NO: 74491 - DNA, 345 bp, Zea mays
  Clone ID: LIB3079-040-Q1-K1-B3
acccgccgcagccaaaccctctccagcagccgtcgtcgccaccgctgcagcgcggaggcgacccccatcgccgacaagatgcagatcttcgtgaagaccctgacggggaaaaccatcacgttggaggtggagtcctcggacaccatcgacagcgtgaaggccaagatacaggacaaggagggcatcccgccggaccagcagctgctcatcttcgacggcaagcagctcgaggacggccgcaccctcgccgactacaacatccagaaggagtccaccctgcacctggtgctccgacttcgaggtggcgctcagaagcgcatgatgaagacgtacaccaagcccaag

SEQ ID NO: 74492 - DNA, 345 bp, Zea mays
  Clone ID: LIB3079-040-Q1-K1-B4
cccacgcgtacgcccacgcgtccggacagggtgctgctacagcaatgtcttgaaggattcccaccactgcgtcgaaagagcaatgcatcacaactgccccgtctgctttgagtatctgctcgactccacgaaggacatcagcgtgctgcaatgtgggcataccatccatttggagtgcatgaacgagatgagagcacaccatcacttatcatgcccagtgtgctcgaggtccgcctgcgacatgtcggccacatcgcagaagctcgacgaggaggtcgcggccacgccgatgcctgacatctaccagaagcacatggtgtggatcctgtgcaacgactgcatcgc

SEQ ID NO: 74493 - DNA, 295 bp, Zea mays
  Clone ID: LIB3079-040-Q1-K1-B5
ggtgattggagctcgaaaacggagaaagcgaggggtgtgataggtcgaacacaacaacaaatgacaattagcactggaggatgccaagtattcaaagggtgcattattataatgccaacagagcaattactgtcttcatgatgccaatagtctgaagtccgatgaatcgagtgccaaaattgcaaaaatctctccatcatgcgggagttagtttcatttcgcaacagcagtgattcttaggttcttatttctggtggctatggtagcacttatccattaacgatgtcattatcac

SEQ ID NO: 74494 - DNA, 243 bp, Zea mays
  Clone ID: LIB3079-040-Q1-K1-B6
gaaatgtatcggttcgaggtcccatctgtcagtcatatgaatgtcctgtcgctttactttatgctttttttccgctcagacattgcctactctgagcattttattcacacactttgtacccgccgttggatgattctgaataatcttggtgttcctggacgcgagttatgtttgcggaaacgagtgtacggacaaatgtatcagaatatctcggataacgatctaaacataatacataagaaa

SEQ ID NO: 74495 - DNA, 432 bp, Zea mays
  Clone ID: LIB3079-040-Q1-K1-A11
acgcgctctgcgccgccgcctccttcgaccgcgatgccgccaacgcgttccagctttacgtcgccgagtatctcgcgttcgccgtcaagcgggcgggcttcctatacggccgcatcgacgcagagaccaaggaggtcttggtcgacttcatctatgagccgccccagcagggcttcgaggacgtggtccatctcatgagggatcccgacgaggaggcccgcgtcgataccattgccgaggggcttgggatgcgccgggtcggcctcgtgttcacgcaggccgtcgggaggagggccagcaagactggtgagtacactatgtccaaccgggaggttgtgcatgcggcccagctgcaggctgagggcgggaccccggagtgggttactgccatagtcaaattggaggtgggggatgacggcactggggatgtgc

SEQ ID NO: 74496 - DNA, 424 bp, Zea mays
  Clone ID: LIB3079-039-Q1-K1-G11
ctgaagtcctcttccagccaggcatgattggaatcgaccaggccggcatcgatgagagggtcagcatctcactcaggagattaatggaggacgagtctgtgaaggagcgcctctgccagtcgatccttgtcactggcgggagctccctgttccctggcatgatccctcggctggagtctgggatacggcaatatcggccctaccttgctcccctgaagcttgtcggagcagctgaccccattttagacgcgtggaggggtgctgccgtctttgcggcatcaagcaagttcggcaaacaaacgttcagcctagctgattacggacagcatggagagaacctgtttcatcggtacaacattgtttactcactataaccggaaaatgacatagtgatcgaaccatctcagtcaggctatttatttaa

SEQ ID NO: 74497 - DNA, 357 bp, Zea mays
  Clone ID: LIB3079-039-Q1-K1-G12
gtgccagtcctccggcccaaaccccgcgcacccaacccccagccccggcaaccgatggcggggtccgcggccgacgcggagcaggagcaaaagcgggcagcggcggcggcgtacgactacgagggcgacgcgcgctgggccgagtactggtccaacgtactcgtcccgccgaacctcgcctcccgacccgacgtcgtcgaccacttgaagcgcaagttctaccagcgctacatcgaccatgatctggtcgttgagccaaggtcattcaccagttccactcaggccagcatgccagatgtaaagtcttcgtcttcgtcatccaccgaaaacgtcagggagcgtaattcatgatctact

SEQ ID NO: 74498 - DNA, 419 bp, Zea mays
  Clone ID: LIB3079-039-Q1-K1-G2
gtaaacacgcaaagaggtggagacgtgctcatcttcctcgttggaaataaaactgaccttgtcgacaagaggaaagtgtccaccgacgaaggagaagccaaagcacaggagcatggtgctatgttcatggagaccagtgcaaaagctgggttcaacgtcaagcccctgttccgcaagatcgctggatcccttccaggactggacgcactttcgtcaggaaagcatgaagacatggtcgacataaacctcagacctgccagcggttcgtcggcttcaggtgcagccgcgcagctggagcagaaatcaagcggttgctcctgttgagacttcgacagttttgtgttcagagaagctacagcagtactgcaacatcgagttaagtactttcagagagattattaccaagagtgtgtttttgt

SEQ ID NO: 74499 - DNA, 215 bp, Zea mays
  Clone ID: LIB3079-039-Q1-K1-G3
atcaaccatggtgaaagcattccatgagcgtcgtgattaccttgtaagaagctttagggagctgccaggtgtcaagatatcggaacctcatggagccttctatttattcatcgacttcagctcgtactatgggtctgaggtggaaggttttggtaccatcaatgactctgagtccctctgtctgttcctgctggagaaggcacaagttgcgcttg

SEQ ID NO: 74500 - DNA, 91 bp, Zea mays
  Clone ID: LIB3079-039-Q1-K1-G4
aataaccactgttccgggctcccatgtcactcgctttgagctgcctctataccgtcagtgggggttcccgattggctggtttctaggctga

SEQ ID NO: 74501 - DNA, 325 bp, Zea mays
  Clone ID: LIB3079-039-Q1-K1-G5
gctcccgcaggccaaggccacctcagcgacggtctccctgcccatcgtggacctctggctcggccgcgacgaggtgcggcgcgccatcctcgaggccggcaaggagatcggcttcttccaggtggtgaaccacggcgtctccctggaggcgatgcaggacatggagacggtgtgccaggagttcttccggctgtcggcggaggacatggccgggctgtactcggaggacacggtgagggcgacccggatctactccagcaccatgttcgacacgggcgcctagaagtactggcgcgactgccttcgtctggcctgcttcttcccc

SEQ ID NO: 74502 - DNA, 373 bp, Zea mays
  Clone ID: LIB3079-039-Q1-K1-G6
agcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgttacaggcatggacgtcgtctacgcgctcaagcgccagggccgcaccctctacggcttctgcggctaagctatgcctgtcgcgct

SEQ ID NO: 74503 - DNA, 240 bp, Zea mays
  Clone ID: LIB3079-039-Q1-K1-G8
tccacgcgtccgggaaatacctgctctatttactgaaacacacttaaaacctgtcagtggcaaagacataaacttattgaaggttgatccctataaaggaagctgggggctccgccttctggaacttgagcttttcaatcctactgatgtcgatttttatgttgatgttgctgtgcatttggatgacacggatgtggaccaagatgtaatttcagactgagatgctgcttgtcacaaaac

SEQ ID NO: 74504 - DNA, 398 bp, Zea mays
  Clone ID: LIB3079-039-Q1-K1-G9
cccacgcgtccggtaggtaaaatcacccctgtgcctttgcgtgaagtccgttcaaatgatttgggacctcgagcacggataagaatgtacttccctactgaaggctcacagtatacccctccacactgctctgtcaatttcttttggaaggattattgtcctatggttttccggaaccttcgagaaatgttccacattgatgctgcagattacatgatgtccatatgtggtgatgacagtctgaaagagctttcttcacctgggaaaagtggcagtatgttctatctttcacaggatgaacgttttgtcataaaaaccttgagaaaaactgagttgaagatactgttgaagatgctaccaaaatattacaatcatgtcagagcttatgataatacgct

SEQ ID NO: 74505 - DNA, 214 bp, Zea mays
  Clone ID: LIB3079-039-Q1-K1-H1
acgcgaattaataagcatggccgcatgcagctgcctgtgctatacatggtgctaggagagggctggaaggttcttgcatggcaagtattttctgtaacatttgtgatgaacattgatactatccacttaattttagaataatcaaagaacttggttaatgatgctacatattgctttaagctttgaaatcattaatttatgcctcttttttgta

SEQ ID NO: 74506 - DNA, 400 bp, Zea mays
  Clone ID: LIB3079-039-Q1-K1-H10
gctggttatggtcctgttcacacacattcaagatggttcaacgatatagtgaatgtgatatgctcgtccaaggcgtttgttgctggcttcgtggcatatttgctggacaacactattgacaggcatgaagcttcagtcaggagagaccgaggctaccattggtgggacaaattccggtcgtacaggaccgatacaagaagcgaggagttctattccctgccattcaatctgaataagttcttcccatcggtctgagcttttgctgtggttaatgtgagatgctcttgttactctggaactgcccaccccctgttctccggcggtggcaccgtgatctggattttctcggtacatgaaaaaattactgtatattaaaacccgctcagctcgggtttcaccc

SEQ ID NO: 74507 - DNA, 459 bp, Zea mays
  Clone ID: LIB3079-039-Q1-K1-H11
cggacgcgtgggccgcggagggcggcgcccacatcaaccttaaggtcaagggacaggagggcgaatgaggtgttctgtcgcatagagaggtccacccagctgaagaagctgatgaacgcttattgtgaccgccagtctgaggacatgaatgccattgcgttcctgtttgatggccgcaggcttcgcggcgagcagacccctgatgagctggagatggatgactgcgactagatcgacgccatgcttcaccagaccggaggcagcgttcctagcaccacctaaaagcctcgttttgctctccgtcctgcgtagtactaaacaaaagggaaaaagtctttttaaggaacttgtgatgctctggctccttgtgccattgctgagggacatccttagcctttgtttagtagtatggtttggtactatgttctgtcatcactcgtttatctatccctaatacat

SEQ ID NO: 74508 - DNA, 324 bp, Zea mays
  Clone ID: LIB3079-039-Q1-K1-H12
gccgagtgcccgattacaatcagccatcgccaccacctccctccgcggctccgccttccggcgcgaacacgccggtgtctcgaccccttgtcctcctccttcagcaagatggcggagattgagataaaaacagcacctgctgacttccgcttccctacaacaaaccaaacaaggcattgttttactcgctatgtcgagtaccacaggtgtttgaatgccaaaggggatgatgctggtgtttgcgaaaaatttgccaagtactacaggtccctttgccctggagaatgggttgagaaatggaacgagcagagggagcatgggacg

SEQ ID NO: 74509 - DNA, 336 bp, Zea mays
  Clone ID: LIB3079-039-Q1-K1-H2
ggtgtaacctggtcacctagagagcagttacctcctggcatccttggtcctattaaaaataagcctttcttgcttgaagatgggcgcctactgtgttgatcatcagttgaaagttggaattcttggggtgcatggcttgaggtattcagattgttgtttgattctatttttgcatctctttgtaccccttctgttagaatggacagtccttgtgtagtgtattgagctgtctcactgattcattaaattgcaggttcgactgctcttggtgtgcccttttttgagtacctgttccatgatgatgtaaatattccttttgattctatttagcacttg

SEQ ID NO: 74510 - DNA, 122 bp, Zea mays
  Clone ID: LIB3079-039-Q1-K1-H4
aaaaaaaaaaaaaaaaaaaaaaaaaaaaaaaaaaaaaaaaaaaaaaaaaaaaaaaaaagggagaaaaaaaaagaaaaaagaaagaaaaaaaaaaagaaaaaaaaaaaagagggagaaaaaaa

SEQ ID NO: 74511 - DNA, 173 bp, Zea mays
  Clone ID: LIB3079-039-Q1-K1-H5
ggagttagagagagaggggatctgcgacgtgttttgctctgcggctgcttgtctgtgggccctattgaggctatgtgcacatttacaccgaggtcggtggttgatcatcagttaattattacatgttacagtagatatgaacagattgtgatgaggttgaatcgatgactaaa

SEQ ID NO: 74512 - DNA, 454 bp, Zea mays
  Clone ID: LIB3079-039-Q1-K1-H6
cccacgcgtccgaaaaaaaaaaaaattttaaaaaaaaaaaaaaaaaaaaaaaaataagagaaaaaaaataaaaacagataaaaatgttaaataatataatggaattatttttgattttattttttttaatctatatctatattatacttcttattgttttatattatgtcaattaattttttattttttatattatctgattttttatactttatgattttttttatatatgaatttttctttttactaaattttttatttatttgttattctattttttatattttatactttatttttattttttaattttatctttcttttattttgttttttttttttattctattttattatcttttctatcttattcttaatcttatttctattttcttttattatatatgttattatttatgaattgtcttttcgttataatttttatatatttttt

SEQ ID NO: 74513 - DNA, 298 bp, Zea mays
  Clone ID: LIB3079-039-Q1-K1-H7
cgaggtcttcagatcaacaacgttcttctcccagagcacatttgtcttgccggttccagggctgccgggctcattcatcttcatggctgatcggtggaacccatccgatcttagagattcgcggtatgtctggctgcctctgacgatagggggagtccctgatgaagccgtagactatagcttcattgtccctctctggtccccgggtgtccatctactggcacaaacggaggcgtctccctgatgagtggaaggattcttggaaatatctgatgtcttttagaataattcaagatgt

SEQ ID NO: 74514 - DNA, 202 bp, Zea mays
  Clone ID: LIB3079-039-Q1-K1-G10
aaggagggcattcccccataccagcatcgtctgatctttgcggccaagcagctggaggatggccgcactctcgcggactacaacatccataacgagaccacccttcacctcgatctccgcctcaaaggctctatcccaatctcctgaaagaccttgtctctaaaaaccttaacccatcatgacatacagctactacactcaa

SEQ ID NO: 74515 - DNA, 337 bp, Zea mays
  Clone ID: LIB3079-039-Q1-K1-H9
acgcaccgtatgcacatgcacgggcaggccgacctcgtttgtccgagtttcatgaccgctccttggaatgtgattatgggcgggaggttgatgagattgggaatggtatcagcgaaactgcgatgaggggaaagcttgtaaagacgaacaagaagtcttctggctgacttggatatctatggtgggcatagaatcaatgtggaagcaatagggacgctaagtgaagacagtagatcataaattagatcaaggggtgacacggatatctacaaccaacaagccctttatgctgaacagaacgatgttgtatcatctgtagtcacagtgttatctgatc

SEQ ID NO: 74516 - DNA, 93 bp, Zea mays
  Clone ID: LIB3079-040-Q1-K1-A1
gaaggcgtcagctgctcgtgtgcttactcttggaagctttctggctgctaggtagggagatggtagtacaactatgaagcctgaagatgcaga

SEQ ID NO: 74517 - DNA, 61 bp, Zea mays
  Clone ID: LIB3079-040-Q1-K1-A10
gccaccgtccgaacgaggccttatttcaagcggccatatgccaatggagagctgattatga

SEQ ID NO: 74518 - DNA, 244 bp, Zea mays
  Clone ID: LIB3079-039-Q1-K1-E11
atccatttcagcatttccaacgccttcgccctaccagccacgtcggttcgaggccgggcgagcgagcagctggtggcaatggcggcagcagcggaggtcgtgctgctggacttcttggtgagccccttcgggcagcactgccagatcgcgctggcagataagggcttggcctacgagtaccgagagcaggaccttctggacaagggcgagctgctactacgatccaaccccatccacaagaaga

SEQ ID NO: 74519 - DNA, 335 bp, Zea mays
  Clone ID: LIB3079-039-Q1-K1-E12
cccacgcgtccgcaattgtgggcacattacctatgtcaatgaaagaaaatccgcagtgatgcgcaactttgtgaggagtttgcatcacaggccctcttctatttaaatgaaaatgagacccagactgaaatcattgatacactacaccaagcttgttcaaagtttggctcttttaagctggagtgcacgaggttggtggattattatgtccctcttttcttcacaaaaattgcttcattaagccctgaagaattctgtgcatcagcaagtttttgtgggggggtaacattcattcgtctaccaagacatgaagatacttgcacactttgccatga

SEQ ID NO: 74520 - DNA, 306 bp, Zea mays
  Clone ID: LIB3079-039-Q1-K1-E2
cacgcttctcgttggatcgaacagctagggtttccaagatgttcgggcgcgcgccgaagaagagcgacaacacacggtgctacgagatcctcggggtctccaaggacgcgtcccaggatgacctcaagaaagcctaccgcaaggccgccatcaagaaccaccccgacaagggcggcgatcccgagaagttcaaggagctagctcaggcttatgaggtcctcagtgatcctgaaaagcgggagatttatgatcaatatggtgaggatgccctcaaggagggaatgggaggtggtggagggatgcacg

SEQ ID NO: 74521 - DNA, 420 bp, Zea mays
  Clone ID: LIB3079-039-Q1-K1-E3
ctagtattaattcaggctgtactgtacattggagtcatagcagtgacccgacttgcgcggcctagcttgtcgaagatgtgctacaacagaagaatggagaaaaacactatgttcttgctctcccttctcagaatagtggcagcttggtccatacttgctgcctacaccatacccttcttcatcatcccaaggaccgtgcatccgctgcttggctggcccctctacttgctcggatctttctcactttcctccatttgtgatcaacattgtcttcctccaccctatcaccgtcctcacaacatggtatggattcatcggctcactcctggtgatggcctttccttggtatctaaaatggcgttgtcagggctctggcagtgtttgcggatgcgttctgctgcgcgccctttgatctgggct

SEQ ID NO: 74522 - DNA, 330 bp, Zea mays
  Clone ID: LIB3079-039-Q1-K1-E4
tctttgacggccatggcggcccggacgccgcagcctacatgaagaggcatgcgatgaggttcttgtttgaggaaagcgagttcccacaggcgtcgcaggtggatgaggtgtacctcgagtccgtggagagctgtgtccgcagagccttcctgcaggcggaccttgccctggctgatgatctggacatcagccggtcctctggaaccacggcgctcactgcattagtgtttggaaggcaactggtggtcgcgaacacgggggactgccgcgcggtgttgtgccggaaaggagtggcgatggagatgtcccgcgaccaccgtgcgaaccacg

SEQ ID NO: 74523 - DNA, 55 bp, Zea mays
  Clone ID: LIB3079-039-Q1-K1-E5
aaaaaaaaaaaaaaaaaaaaaaaaaaaaaaaaaaagacagacgaatataaagata

SEQ ID NO: 74524 - DNA, 419 bp, Zea mays
  Clone ID: LIB3079-039-Q1-K1-E6
cccacgcgtccgcatactttggtgaatttctatggaaacattgggaaaacccttctttcattggagacggttttctttgatgtcctgttcattatccaacactacgtgttgtaccctgtcaagaaggacgagaatggtaaggcaatcatttctgaaagggtagccccccttatcaggccttcggacaagcctgaagaagataacgtatgatctagctgtagttatattgcgcgcattgcattcacgcgctgtttgcacacaggccacacacgcatgcgaattatttgttcaaaaggaattgcttgcgcgtcttgattatattactgcttataacttttaaaaaaatatttttatttattttttatttttatgatttttttttattgtttttagttttttcatttttttatttttttttc

SEQ ID NO: 74525 - DNA, 311 bp, Zea mays
  Clone ID: LIB3079-039-Q1-K1-E8
tccaacttgatctcacagctgcactcttataattctagccctacagaaaacaaactggaaccagtagaaaagtcctgtgcatcggaggcatatgcggtgaactggaacgtaccaccttaccaacaatcgcatgacttcctcgagcatgctagagccgtatcgagtgatatggaatcaaccagtgcatggtgaaaagtcctacgtattcttagcaatttctgtgaaatggaacattaccatcattaccaatcaagcaatcttaagacttctttgagccatttgcatatttgtgtgaaatggttcaatattac

SEQ ID NO: 74526 - DNA, 385 bp, Zea mays
  Clone ID: LIB3079-039-Q1-K1-E9
gccaatttgatgttgtcaatcaccctccgcattgtctcaggtgcggctgaggttgtggattgcctgtcacaactgatggtgttcttgtgggtgctgtattaccttattactgtggagggaggtggagctacagagcaaatcattgatcttttgccagtgtcaaaacaagtaaaggaccgctgtgttgaggtcatggatcatgccatcagtagtgtattgttggccactgccaagattgccatattccagggggggctgacatggctattgttcaagttcttcaaagtgcattttgtgtacacatcaactgtgcttggattcataagtgcacttgtgccaatacttccattttggctgtcctcgatatttgccacaaggcagcttc

SEQ ID NO: 74527 - DNA, 191 bp, Zea mays
  Clone ID: LIB3079-039-Q1-K1-F1
tccacgcgtacgcccacgcgtccgcccacgcgttcgcacagattcgcaattactgggggttggatgatgatggatgatgggagactatcggatatcatgtctagcacaacggcttgtcaaaaaaaacaacgacgatgaagattttgtggaaggccatggtcgaatgtcatgtcttgctgttacactctata

SEQ ID NO: 74528 - DNA, 310 bp, Zea mays
  unsure at all n locations
  Clone ID: LIB3079-039-Q1-K1-F10
tccacgcgtccgccagattggtcctgaccagattgaagctctgtatcagtatgccaagtttgagtttgagtgtgggaactactcctgggctgctgagtacctgtaccagtatcgtgctttgtgcacagatactgagcgaagtgtgagtgccctctggggaaagctagcagcagaaatcctaatgcagaactgggatgtggctttggaggaattcaaccgcttgaaggaaataattgattcaaagaacttctcatcacctctgaatcagctccagaacaggatatggctgatgcattgggctctgntcatc

SEQ ID NO: 74529 - DNA, 285 bp, Zea mays
  Clone ID: LIB3079-039-Q1-K1-F11
tcgtccacgcgtccgagctagtagccgaagagacgctccgaaagctgctgtcggaccaaagtatgcagaactggcgcgggaccaacagcagctgcgtaaaattcaagaacacggcgctgctggcgccccggagagcatcatcgggcgctgggatatacgacgtgaacggactgagcctggtggccgactggccgtacagcgtgaagacggtgtccatcgggctgatcctgagcatgaagctggaccgggagctcgagatgacgaggacgaccacgacgagcgcta

SEQ ID NO: 74530 - DNA, 307 bp, Zea mays
  Clone ID: LIB3079-039-Q1-K1-F12
gtctgcaagtggctcacctacaacgaggaccgcttgtacatggccggcctcacgctcatgagccaagacaaggtggtaatggagagctgttactatctcaaggacgcagtgctgtactgcggcatcccatacaacaaggcgtaccggatgactgcgttcgagtaccactgcacggactcgcgcttcaaccgcgtattcaacgaacgcatgaagaaccactcattgatcatcaccaagaagatgctggacttctacacaggcttacaaggcgtgtcaacgctagtagacataggctgtggcttgggca

SEQ ID NO: 74531 - DNA, 389 bp, Zea mays
  Clone ID: LIB3079-039-Q1-K1-F3
ctaaaaccatctgcttcagccttcagctagccccaagtttagtcggccgatcgatcactgaagtagtaatggcctccgccaacagctggaccctcgagatcgcgtcgccggtggccccgcagcgcctgttccgcgccgccgtgatggactggcacaccctggcgcccaaggtcgcctcccacgtcgtcgccagcgcgcagcccgtggagggcgacggctgcgttggcagcgtcaggcagttcaacttcacctcagtcatgccgttcagcttcatgaaggagcgtctcgagttcctcgacgcggacaagtgcgagtgcaagaacacgctcatcgagggcggctggatcggcgtcgccatcgaaacggcgacgtcgcacatcaaggtggag

SEQ ID NO: 74532 - DNA, 281 bp, Zea mays
  Clone ID: LIB3079-039-Q1-K1-F4
gtagacacatctgttcgagaaagccattaatacactggagtctcggataaacaaacaaagtagttccagagactgagtgaagcagattagcactagatgagatttctgcaataagacatgaagaatgcgtgtcaaatcagggctccactgcgtccatacattatccgtgtatgattggcttttattctcgtgttcagtccatagatctgtgacaggaaacctaggtggcatctactctaggcaatgtatcgtcagctcagttgtgtagaacaacttcatga

SEQ ID NO: 74533 - DNA, 375 bp, Zea mays
  Clone ID: LIB3079-039-Q1-K1-F5
gccggttccgaagaaataatttccttccttggcgtgaacattgtgacaccatcgcaggagctattggctagccaactgtcttgtgatgtatctcaagggaaaagccttcttgtgactggtccaaatggtagcggaaagagttccatctttagggtgcttcgaggcttgtggcccattgcttctggtagtcttagcaagccatctgaaggaatttttaatgttcctcaacgtccatatacttgtcttggaaccttgagggatcagatcatataccctctctctcacgaggaggcaaagttgaagattctctcatgcgaaacaagtgacaagtctacagcttccgagcttgtggatgatcacctgaagacgattcta

SEQ ID NO: 74534 - DNA, 359 bp, Zea mays
  Clone ID: LIB3079-039-Q1-K1-F6
gtggtggctctgactatatcttgctatatgggatcattccggttacagtcgcttctatgctgtctggtttggcctctgcattatgtcagtgggcatctcaagttaaaaagcatacctcttacatgatgactatagaaatgtcatttattggaagtgcgtgcttgttagcaagtacctatcggtcaccagatggagaagccataaggaaatatggggttttccatgaatggactttctggaccatggtaccggtattaatgaatgccgtgggtggaattcttgatggtcttgtcacaacttacgcaggtggtattagaaagggttttgttatatcatcagctcttcttgttacttcactg

SEQ ID NO: 74535 - DNA, 425 bp, Zea mays
  Clone ID: LIB3079-039-Q1-K1-E10
cagtcatggccaattgctatgaagggtagggatatagtagctgtggcaaagacaggtgcaggaaaaacactgggctgtcttctgccagggtttattcttctgaagcgcctgcatcataattcaagggaaggtccaacagtattagttttgtccccaaccagggaattggcaacacaaattcaagatgaagcaatcaagtttggcagatcttcaagaatatcttctacttgcttatatggaagtgctccaaaaagtccttaacttaaggaatttgaaccttgttcccaatgttgtggtgcaacttctgggagattgaacgacattttggaaattaattaaatgaaccttggccaagtattatatcttggccttgattaaacttaccctattcttgatattggaattgagccaccaattagaaaaat

SEQ ID NO: 74536 - DNA, 332 bp, Zea mays
  Clone ID: LIB3079-039-Q1-K1-F8
agcagatcttcgtccctggctcgtcgtccttcgaagattcctttctcagtgcaaacagcaccccttccagctcaaggttctcggtcgcagaccgatccttggattggagctcctctcgattctcagagacgagcggattggctcatcaggacgaccatgacagtgaccaggctaacgagaggcctttggttctctgcaacaaggagccaatgtggcacgagcagctgcagtgttggtgcctcaacttccatggtcgggtgacctgggctttctgggataaactgtcagtcgattgctgcaccactactagattcttgaccgttacagcaagc

SEQ ID NO: 74537 - DNA, 263 bp, Zea mays
  Clone ID: LIB3079-039-Q1-K1-F9
tcgttgttcaaagataacgcatgtgacctaagatgagctcaacgagaacagaaatctggggtggaacatacaggttaaagctcgctggattatgatttacagctcgaatactaaccgggtacgcgtggcctatcgatcctttagacctcaagagttcgaagcttgaggagtacagaacagataccacactggataactgtgcttgtgtgcagccaatctgatcatagtcgacttaagcataactgatcctccagatgattagc

SEQ ID NO: 74538 - DNA, 242 bp, Zea mays
  Clone ID: LIB3079-039-Q1-K1-G1
gtcctccgcccgagtctcgctcgctagctagggtttccaccaatggcggcgcccaccacctgccgccgcggccccggcggcgcccgcaacatggacgacgagaacctcaccttcgagaccttcccgggggtcgaggtcgtcagcagcttcgaccagatgggcattaaggacgacctcctccgcggcatctacggctacggattcgagaagccctccgtcatccagcagcgcgctctgctccc

SEQ ID NO: 74539 - DNA, 432 bp, Zea mays
  Clone ID: LIB3079-045-Q1-K1-G5
cccacgcgtccggggaggcaaggccccccttaagcagctcgccaccaaggcggcgaggaaggcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccggttccagagccacgccgtgctggcgctccaggaggccgccgaggcctacctcgtcggtctcttcgaggacaccaacctctgcgccatccacgctaagcgcgtcaccatcatgcccaaagacattcagctcgcccgccgcatccgtggcgagcgcgcgtagccatcatcttcggggatctgatgaatgtctagttaccaaacaaa

SEQ ID NO: 74540 - DNA, 372 bp, Zea mays
  Clone ID: LIB3079-045-Q1-K1-G8
ctgagattgatactgaaggtttggttgcgaatgacaagtttcatgtaagttacagaggtggaaggctaaacagctccttatctcaggcgctgaccaattgcctgcgttattacctccgaaggcctgagacagatgaagacagctattgattgttgtgtttgtcgaaccttcctatagtgcattagaatcagaaactttggcttcagttccttcgctatgggccccttgtactgctgcaaatggagttttccattgtagctgataaagtgccgacaaggtgcatccatatgtgcataggtggcactgaatcggggctcactggaccagtttgatattgtagtaatatatatacagctgggagcaacataattt

SEQ ID NO: 74541 - DNA, 409 bp, Zea mays
  Clone ID: LIB3079-045-Q1-K1-G9
attcccggctgctagccacgcatctctgagcctcacaaccaggttataattcattcgactcaagcaagggtcctcactatccgggagggctctattttacagggcttccccgattactaccgattgtttggcccgatcaaggagaagtacattcaagtcgggaacgcagtggctgtccctgttgcccgggcactgggctactgtctggggcaagcctacctgggtgaatctgaagggagtgaccctttttaccagctgccttcaagtttcacctctgttggatgactcactgcggggcatgcgatggcctctcctgttggcacccctgcacgggaagtagttgagcactaaaaggattacagatctgatctgatcttggcaacatccaacggcaggagcattttttgtt

SEQ ID NO: 74542 - DNA, 171 bp, Zea mays
  Clone ID: LIB3079-045-Q1-K1-H1
taactttttagaattaatttgtgtgatattgataatattttccacgtataaaaaattaaatggaaaggtattatattaatataaataaattaaaaaaataataataattactttacttctaaattaatccttatcttactttctctttcattcttcattttaatctttttt

SEQ ID NO: 74543 - DNA, 231 bp, Zea mays
  Clone ID: LIB3079-045-Q1-K1-H10
acttctcttctacactccacacgaccgcctcattccaactgcatccaactcattctcacacatctcctcttcatacatcctccaacttcatccaccccaccaatatcttccacccagatacatccatctttcatactatctcaataaatccctttttcactattcaaccttcatccacaattttattatacctcctcaattacattcccataaccatttcactctccatac

SEQ ID NO: 74544 - DNA, 143 bp, Zea mays
  Clone ID: LIB3079-045-Q1-K1-H11
cactcatccgaagaaaaaaaaaaaaaaaaaaacaagtttatttaaaaaaaaaaaaaaaaaaaaaaaaacagaaattttaaaaaaaagaaagcaagaaaaaaaaaaaacaaaaaaaaaaaaaaaggcccccccccctaaagaac

SEQ ID NO: 74545 - DNA, 338 bp, Zea mays
  Clone ID: LIB3079-045-Q1-K1-H12
ctcggtcggattccggagccaggcgtccgcggacgcgtccagaccatacacggctttgttttcaaggactacccggagccccataggaggttttctatacacgtggggcgagcgtgaactggaacttcgctctaaacgacccaggcttatctcgccttgccttcatctacataggcgcacaaaagaacgtcctaccttcaatcgactggcctgccatctaccgcatggaccctgataaaacccttcagttcctcacgttaatcatgctggacttcattactctttctgacgacgccttactatacaacagcccgccctgctatgccatttacaacagt

SEQ ID NO: 74546 - DNA, 334 bp, Zea mays
  Clone ID: LIB3079-045-Q1-K1-H2
ggatggtagagctaataaaatcaagagttagagattctactcctgaaacccatgagtatggaaagcaagaagaaatcccaagtaggaatgcaggcatggcacatgacttcacaggaacatgccgctccttgagccgtgataggaatttcactgaatcggtcccattctctagtatgagaatgagacctggtcattcttctccaggctttccactccaagcatcacctcagctatgcactgcagcagttagggaagcaaaaaaatggttggaagagaaaaggcagggactgggcgtaaaacctgaagacaattgatcatgcacattaaatacaga

SEQ ID NO: 74547 - DNA, 60 bp, Zea mays
  Clone ID: LIB3079-045-Q1-K1-H3
aaaaaaaaaaataataaaaaataaaaaaaatttaataaaaaatataatataaaataaaaa

SEQ ID NO: 74548 - DNA, 157 bp, Zea mays
  Clone ID: LIB3079-045-Q1-K1-H5
cccacgcgtccgctagttctagatcgcggttctgccgctctcgatctaacccacacgggcagagctcattatctactactgtgctaccaccttcaatacactaaaccttacttcatgttcctagtcctgcttaaggcccttgcctgttactagcacc

SEQ ID NO: 74549 - DNA, 379 bp, Zea mays
  Clone ID: LIB3079-045-Q1-K1-H6
gctgccggagggcgctgggagccccatggatgtgctctgtcaggttggtctggatggaaggcgggtgcttgatcccaacactggtaggacactaagaatatatccccttgaaactgtaactagatgcgatgtattagattcctctatttttgccttttggtccaagagttcggtggatgttgaaggaaaaagaataaggctgaaatcaaacagctatacatccagcaccattcttgacactgtcacagctgcgactgtgcagttcaaggagatgggtgaaagcagcatttcaagaagtagagcaattgctgatgcatccaaacccgctgagcagcaaaatgagaggaagaaaaatttcttgatcggaggaatttaaatg

SEQ ID NO: 74550 - DNA, 356 bp, Zea mays
  Clone ID: LIB3079-045-Q1-K1-H7
cgctaaagcaagtctagtctctagaggaggtggcggagggggaggccatgggcaagggcggcgtggtccagagcggcgcgggcggcggggagttcgccgccaaggactacacggacccgccgccggcgccgctggtggacgcggcggagctgggttcgtggtcgctgtaccgcgcggtgatcgcggagttcatcgcgacgctgctgttcctgtacgtgacggtggcgacggtgatcgggtacaagcaccagacggacgcgtctgcgtcgggggccggtgcggacgctgcgtgcggcggcgtgtgcgtgctgggcatcgtgtggcctttcgcggcatgatcttcgtgcttgtctact

SEQ ID NO: 74551 - DNA, 239 bp, Zea mays
  Clone ID: LIB3079-045-Q1-K1-H8
cttgttcacgcgttcaaagatgcgttggggtttacaacatagtccttcttctcctcttcctgtttgctgtaatttctccgaaccaagtaattggtagttgcttgtactccggaactaaatgctgccatcctaaatcaatgcgaagagtacatcaagccttggataccctcttatactgccatcgtacgccagtgtgtgttgcgacaaggtgagagatgtgccaaatagggacatgaact

SEQ ID NO: 74552 - DNA, 135 bp, Zea mays
  Clone ID: LIB3079-046-Q1-K1-A1
ataggatcgactctgtctgacgctttcctgtttggagatacctgctcctgccgactaccgagagttatcctactcagtctgcgtgctggcacggccaactaggatatcaactaggatgagtcgaggaggaatggc

SEQ ID NO: 74553 - DNA, 111 bp, Zea mays
  Clone ID: LIB3079-046-Q1-K1-A10
ggttgctggtcacaaggacttccttgtatgaaatccttatctgaagcatcatctacgtacttctttaaaactacatcaccactcttaacttctgccaaccctacaccctta

SEQ ID NO: 74554 - DNA, 168 bp, Zea mays
  Clone ID: LIB3079-046-Q1-K1-A12
ccggctctacccactcatccgcctccacctatttcctcacctcgttctactaactcaccacatatcacataaacctgaccattatataaaatacttacccccaaaaccatctaataactacaatacatacatacatattcccatctaatccaaaacacccttcttcaa

SEQ ID NO: 74555 - DNA, 329 bp, Zea mays
  Clone ID: LIB3079-046-Q1-K1-A2
aatccgttgaggcactgcaggccaatgtccatagtcttaagacatacaaggccaatctgatcagctttccaattcattctcacaacgttcacgctcatgtctctactccacatgaacttgtcaacgatacccagatccagggtgactacataccttatactcgtagttagaaacctccacttaaggcactataccatgcataccttactaatttatcacctacctttttcaatcaaatactagaattgatgatgtcacaacaacatttacaccctccattttttttatttttattttcactatatttttcattttaaccttttattctt

SEQ ID NO: 74556 - DNA, 304 bp, Zea mays
  Clone ID: LIB3079-045-Q1-K1-G4
cccacgcgtccgctctgaaatgtagttgaataggagtggcatacaaatgccactctggccgggaaacatatgttgaattacctatgatgagatgcatacagatgcagtgcttccgcgaaacgaatattcttacataagcgagctacatcatatcagaatgatgaaagtcagcgatcatcctatgggcggtgcacctgcttgtcatgctgcgcatagctgtattatgtccttgagcgccggcgactctggctccatggtccactgctgggtgtactcctctggcctgtatacagactcagggtta

SEQ ID NO: 74557 - DNA, 225 bp, Zea mays
  Clone ID: LIB3079-046-Q1-K1-A4
tccggtcgccacgcgtccatctcggctctcgagtccgacagatagagcgattcgaaatatcaaggcgcttaaagagatcacagccacacacctcctcgcatacccgcgtcaaaccacctgccgcgacccgtcagcaccatcaacgaaccagtctggcgcagaaagtcggacaatccaaagaccgcctaacatccaggaccatcccaatcttcagtccaagccccg

SEQ ID NO: 74558 - DNA, 358 bp, Zea mays
  Clone ID: LIB3079-046-Q1-K1-A5
ctcttccgaaatgattccccatcttcagacgattacatttataacacaaatgctacttcaaatggatacgtttaattttaagattacacaggacatgactctctaagaatttcataaaataacaatcacacaatactaaagcactacttgcattaaacgctcactacaggaaacatgaagttgacaaagattagcactctctgcaaccactttcaaacaacaaataacatcatgaacttctcattaaactcacttcttacaacgatcatatgaatgaaaacccttaacttcattaccatgccaacaaatctcatagcatcaactactccctgaaacctacttaatgaaaaatgtacta

SEQ ID NO: 74559 - DNA, 244 bp, Zea mays
  Clone ID: LIB3079-046-Q1-K1-A7
cctcaattccctgatcgacccagctcgtccgctaatgctggctatcatgcttcgacatcaatactcatcagagcttcgaagctttcaacccggtatcgttttctttcatgatctaccccacccacaccgtgaacatcaacgccattattgatgcattccacctcattaatcctcagaccatgattctctcccactacccacctcatacaacatcaaatgtatgccacctaaataatccatctat

SEQ ID NO: 74560 - DNA, 281 bp, Zea mays
  Clone ID: LIB3079-046-Q1-K1-B1
tctcggatgctggctatcaggcttcgatatcaatactcatcagagttttgaagctttgaaccctgtagccgttgctgttgtgatctaccccatccagagtgtgaacgtgaaggtcgttattgatgcattccacctcattaatcctcagaccatgatgctcgcccaggatccacgtcatacatcatcatatgttgggcacctaaataagccatctattcacgctcttatccatgggttgaatagacactactattcaatcgcaatcaatttaccgcaaaaat

SEQ ID NO: 74561 - DNA, 242 bp, Zea mays
  Clone ID: LIB3079-046-Q1-K1-B3
gatgatgatactggccgtggtggttccccctcaggaagcaagtcaccctgaacgctgcaccgtctgagttcttaggtgcttcgtgatgcagtgggcaaacataccaaagacgtgatagctgtatcgtttccctatctgagacgtggacttatttagcttgctttgatattggtgtcttatttctcttatgaataatgtggacacgcatgttgtgtcgcccaaaaaaaaaaatataaataaac

SEQ ID NO: 74562 - DNA, 92 bp, Zea mays
  Clone ID: LIB3079-046-Q1-K1-B7
tcttcctcctctgttaggttctaccattataccttcggcgtccctccttccggtctgatcttttcttaaatggtctctccacaggattccat

SEQ ID NO: 74563 - DNA, 229 bp, Zea mays
  Clone ID: LIB3079-046-Q1-K1-B8
tcttcctcccactcttcctaaaaaaaaaaaaaaaaaatttaaaaaaaaaaaaaaaaaaaaaaaaaagaaagaataatttaacaacctttctaaaccatccaagctaactaactcatacatccaacataatatcatcacaaaaattaacaccaaaatccaattcacttacctcctattaacaacattaaaactaaaaaaaccttatcattacccaactaaatcaccttac

SEQ ID NO: 74564 - DNA, 368 bp, Zea mays
  Clone ID: LIB3079-045-Q1-K1-E12
gcgacgactagcacaggcggtggcagtgctgcagcggcgtgcgatcccaagccgcttggggtgttctatccggcgttgatggactgagcgaaacccgcggcagcatgctgctccaccctgcgtgcgcaggaggcatgcttgtgcgtgtacgccaaagaccccaagtttgcaaaatacatcaacaaccccaacaccgccaaaacctttacctcgtgcggcatagccatccccaaatgctaagcaagcgctctgcgtcgtcgcttcgcttgctcttgctcttgtgtgtaacatatccagcttatgaataaattatgtggatcagttaattagtggaaaaaaaaaaattaatttatttatttttatatttt

SEQ ID NO: 74565 - DNA, 413 bp, Zea mays
  Clone ID: LIB3079-045-Q1-K1-E2
caagaacaacccgccgtttgacatctcgaccgatcacccaccaacatactacgaagacatgcagcgctcggtgttctgcctctgcccgttgggctgggcaccgtggagtcccaggctagtcgaagccgtggtctttggctgcatcccggtgatcatcgcagacgacatcgtcctccccttcgcggacgccatcccgtgggaggagatcggcgtcttcgttgcagaggatgatgtcccgcagctggacagcatcctgacatccatccccacagacgtcgtgctgaggaagcagcggctccttgcgaacccgtcgatgaagcatgccatgctgttcccccagcctgctcagccaggagatgcgttccaccagatcctgaacggcctatcgcgcaaagctccgcacggcagcaatg

SEQ ID NO: 74566 - DNA, 398 bp, Zea mays
  Clone ID: LIB3079-045-Q1-K1-E3
cttgctcctcgctcttcttggttctcgctgtgttgccgggagctgggatcgaaagtactgcggtggttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgatgcactcactcccagaacaagatcatcagctccaggagaacatcaaggtccatggcatcaacggcactttgcacgatgatcatcagtactgcggccatttggatcaactcggttcttcttcgtcgtc

SEQ ID NO: 74567 - DNA, 142 bp, Zea mays
  Clone ID: LIB3079-045-Q1-K1-E4
ctagaacctactgattccttgtcaccatcttttcttctcctccaccacaacctctcggggagacttcttcatatgtcctttctactctccaccctctactattcatcttatcctagtccatacacccctacgattctcctat

SEQ ID NO: 74568 - DNA, 340 bp, Zea mays
  Clone ID: LIB3079-045-Q1-K1-E5
ggccgaaccacgggataaatcctcgtgtctcttgtgcttgtccttattgtgtctattgtgcgtcacatgagttctcctctctactcacttgatttcattattcaactcataatcaagtttgtggtgttaagttttaagttttacaggatcacctattcaccccccctctaggtgctctcaattggtatcagagccgttctcttcaagaaagggactaatcgctcgaagagatggatcctatgggcaaggggatggtggtcaatgataatgagaaggagtccttcgtcaatgatccaaaagattacaagcctactgactcgggctcaagccacatatgaaa

SEQ ID NO: 74569 - DNA, 349 bp, Zea mays
  Clone ID: LIB3079-045-Q1-K1-E6
tcgctgaagatgatacaacgtcagaagaggtcttcattatggagaacaatttgcctaatgatgtgggggaattgctaaattattgtaatttcgcaagagttccaacatgaccacgatcagtgcttgcaaacaggaatgtttaaccagctcaaaaagtaatcgatgtgttcgaactggtcaatccagttactcctgaagaaatgtcccatatggcaattgatagagaagctaacaccaattccataactaattttgaggaaaacagtaaagactagctctgtggtcaagaccaataacgtgcttaagaaattaatatctgcaatcaagttggctaatcaatggcatttca

SEQ ID NO: 74570 - DNA, 109 bp, Zea mays
  Clone ID: LIB3079-045-Q1-K1-E7
gcagaaaccacaccactctactgacgcccttactagcatgtaccattttccttcagccatgagtaatttagaatactcacatcaacattcgtggccattggccatgttc

SEQ ID NO: 74571 - DNA, 450 bp, Zea mays
  Clone ID: LIB3079-045-Q1-K1-F1
ccgctggtggtggagccgtacctgggcgacatggacgcgctggtggcggcgtggctgccggggtcggaggggcagggcgtggcggacgtgctgttcggcgactacgggttcacggggaagctgccgcggacgtggttcaagtcggtggaccagctgcccatgaacgtgggcgacgcgcactacgacccgctcttcccgttcggcttcggactcaccaccaagggcacgaagtgagtgagtgtgaggcgctctgatgggatgtggcctgtgagtgagctgtgtattcgtgggcgggcgtgaagctctttggctttcgaattggttgggggtgactggcggcgagtcgtgtacgccggacacattgcgcagcgtacgttgggttgggatgtttgcgtctgggaataacagtgatgcattcttgagatgggtgcttgtagtgtgggtttgttg

SEQ ID NO: 74572 - DNA, 255 bp, Zea mays
  unsure at all n locations
  Clone ID: LIB3079-045-Q1-K1-F10
attcccgctggagccactcatccgaggatgacagaaaagaaactttatagttcgatgaatgggcagtttgccgtggttttntgataatttgtacttcgtctgttttcgcttctgttgtcgtaccattgtcttaatcgatttgtggattttgaagtctccttttaaaaaaaaaaaaaaaaaaaaaaaaaaaaaaaaaaaaaaaaaaaaaaaaaaaaaaaaaaaaaaaaaaaaaaaaaaaaataaaactttctaaat

SEQ ID NO: 74573 - DNA, 442 bp, Zea mays
  Clone ID: LIB3079-045-Q1-K1-F11
ccgacgcgtccggtcgcatccgccgcctctgtcaccgcggcctcgccctcgccggcatggttgctcttacgacggcctgtgcgctacgccgtcctcggcgccggctttgcgggtctctccgtcgcgtggcacctcctcaagcatagcccgagggattcccgcgtgtcagtggacatctacgacgagaacggggtcggcggaggcgcgtcgggcgtctcgggtggacttctccatccctactcgcctaaagtgaaacttctctggaggggtgctgagttctggaaagaaagcatggatctccttcgcagcgccgagcaagcaaatggaacctcggtatcaaatacaactagtcaagatgataaccttatcttgagaagggggattgtacgaccgtctacaactgataaagcttgaaccatattgcttgagaatgttcaaaaat

SEQ ID NO: 74574 - DNA, 232 bp, Zea mays
  Clone ID: LIB3079-045-Q1-K1-F12
ccggctcgagccacgcagtccgccgacgcgtcctcccacacgtccgggttcctccctgcgtgtatgcttgttaccgtcatgtcttttctttcactactaggctccatccaacatcgatggcttgcttctttatcagaacatgtttgaataaacgctatttggtaaaaaaaaaaaaaaaaaaatattataaaaaaaaaaatacaacaagaacaaataataaaataaaaacatt

SEQ ID NO: 74575 - DNA, 429 bp, Zea mays
  Clone ID: LIB3079-045-Q1-K1-F2
gcattgtggatgcaaataattgggttttcatttaggtttttgtcttcattcttatggatgggaatgtatagattatgggcttcttccagcacgccaacatattttgaaaccaaccatgaagcaagaattagtttcttaagccctagatctgattcagttagactgagtcctacggcagatgatatattgggaggttcgatctatgatccttcttactactcgtcactgttcgaggatgtccgaaacaatgcatgcaatcatcagggtgataaacaaagtggtagtaatgacagtggttcaacatctgcaggccagacaccacgacttaaatcttttgctaatgatgtggaatgtggactaaaaagaccgttgaactcctaaggataaaacaacgggctcatcttggaacctaaatcctgaaccaacgtt

SEQ ID NO: 74576 - DNA, 445 bp, Zea mays
  unsure at all n locations
  Clone ID: LIB3079-045-Q1-K1-F3
tcgcagtctcgctccacaaccacaactattcatccactaccggctccctccctcctcctgagaaccccgaccgcgggcgaaccaaaccctagcgagcgaggcgatcagcgtccggcgaccggcgacagagcgcaatggagacgcgcccggcgccttgcgacctcgaggcggccgtgcccgcgggctccggggctgcaacggcggcggcggcgcagcaggaggcacccgcggcgaagaaagtggcggaggaggaggatccgcgcctgcgctgggccttcgtgcggaaggtgtacgccattctctccctccagttcgcgctcaccgcggccgtcgcggccaccgcgtgcctcgntccgccgatcccgcgcttcttcgccttcggcccccccgtcgtcgtctggtccacgtacatcgcgatcctnctgtccccggtcatcgtcatgtt

SEQ ID NO: 74577 - DNA, 148 bp, Zea mays
  Clone ID: LIB3079-045-Q1-K1-F5
tcttactctttagaaaaaaaaaaaaaaatattataaaaaaaaataataaaaaaaattaaaaaaagatattttataaaataaaataaaataaaaataataatattaaataaatacatatataaataataatatataattatacatatat

SEQ ID NO: 74578 - DNA, 189 bp, Zea mays
  Clone ID: LIB3079-045-Q1-K1-G1
tgccagtcaatagcgagttctactactagttgctagcctgctgatctgttctgttgattagtgcggggagccttctgtttcggcgaccatggatgatgagaggaacacccagcatcaccagggctgtgaggcccagcaagacgcctacgatcaagttgacgtgaaggatagggggcttctgtacagtct

SEQ ID NO: 74579 - DNA, 105 bp, Zea mays
  Clone ID: LIB3079-045-Q1-K1-G10
ccactgctacccactcatccaaaaaaaaaaataaaaaaaaaaaaaatttttttaaaaaaaaaaaaaaaaaaaaaaaagaaagattttttacaacctttctaaacc

SEQ ID NO: 74580 - DNA, 414 bp, Zea mays
  Clone ID: LIB3079-045-Q1-K1-G11
cggacgcgtgggctagccgcctgtctttctgtccggtctccactcgtccgggctactagactactactgagggtttctgcgggggatttgtttgtcgctgactcgccggcgaccaagatgaggccggttttcgtggggaacctagactatgatacccgccactcggagctcgaccacctcttctaccgctatggcagggtcgagcgcatcgacatgaagtcaggctttgcttttgtctactttgaggatgaacgtgatggcagtgatgccatacgtgctcttgatggttatccatttggcccttgcagacgcatgctttcagtagagtggtcacggggtgatcgaactgctagacgtgatggcaacaaaccagaagtaaatactaagccaactaaaacattgtttgtcattaac

SEQ ID NO: 74581 - DNA, 151 bp, Zea mays
  Clone ID: LIB3079-045-Q1-K1-E11
cctatatgctccaacaagcattcttatcaagcaacatacctctatcaccctagccattttaacaatctccagccctatctatccttcactcatcattacaaaccatcatctcacatcacctccatcaactctttccacctatcatcaacca

SEQ ID NO: 74582 - DNA, 366 bp, Zea mays
  Clone ID: LIB3079-045-Q1-K1-G12
ccggctggagccacgcgtccgatgttttggccgtgggactaaatgtttcccaccaagtggttctaaccgatgctgaccagtaattgcttgagcagtgtgacagcaaatacgcccgctacttgtgcaagctaatgggcgtttattttgattaccacagggacggttacttcataaaaggagcgtatcttcacgatccaacgactgttattgcttcggtgaacccatcgctgctgacttacacagaacgcgttgtgagggtacagacagtctggatcaccaagggccttactgttttcgacaacaccaagaaaaggtactgagagatcacagactcgtagtggcatgcccaccgtgaatgtcgctatc

SEQ ID NO: 74583 - DNA, 346 bp, Zea mays
  Clone ID: LIB3079-045-Q1-K1-G2
cccacgcgttcggctcagggcatcctccattatgaccccttcgaggttctcgaccagagagtagtgttcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcatgtgcttgtctgaggggctgccttctcgttggcagcctgcttgtggtgcatctggtgattaataatactactatgacagtaccatatgctctgtgaagagt

SEQ ID NO: 74584 - DNA, 95 bp, Zea mays
  Clone ID: LIB3079-045-Q1-K1-G3
cccacgcgtccgcccacgcgtccgacccactcgttcggacatatgcaaaaaaatgttctgtggtggtacattggttccagtattattgtcttcgc

SEQ ID NO: 74585 - DNA, 338 bp, Zea mays
  Clone ID: LIB3079-045-Q1-K1-C11
gcggattggtgagttcctccaccaggcttttaccatctgcctgaacatccagaattatgacgtttatatcctcaaggggttcaacaagggcctggtgaacaacaaggacatcgagaacctcaaggtccaggtggagaagtttgccgactccttcgacatgcctgggttcacgcttgagagcatgaaatacaaggagtagatatgcctctttcatgcgcggcaaggtcctcctgtaccgatgtctttccttgtggtggctcatggtgccatggcactgcattgccgccacacttacgatgatgatgatgggttattgattttgtctacaatgtcatcat

SEQ ID NO: 74586 - DNA, 419 bp, Zea mays
  Clone ID: LIB3079-045-Q1-K1-C12
aacccatcgctcaccaccacctgctctttcagcggcggcgtccagggtgaacccgaatgcccatcaccatggcggggggcaagatccagaagaagcgccacggcgcggcgggaggcgcccggctgcagggcggtatcccgttcgagaagtccaaggggcagcacatcctgcggaacccggcgctggtggactccatcgtcgccaaggccggtctcaagcccaccgacaccgtcctggagatcgggccgggcacaggaaacctcaccaagcgccttctcgaggctggtgtcaaggccgtcgtcgccgtcgagctcgacccgcgcatggtgctcgagctcaaccggcggttccaggggcacccgctctcctcgcgcctcaaggttatccaaggagatgtcctcaaatgtgatctcccatac

SEQ ID NO: 74587 - DNA, 444 bp, Zea mays
  Clone ID: LIB3079-045-Q1-K1-C3
ctcgaggcctacgcacaatagattcgatctcgagtcctcgaatcctgccttttcctctggtcaggaaagcatgagcttgatttccggcgcttctcgccgtcgagctcgaaccagaagataagaagaatccgctaggggcgagccccatagaagatggccccgcacccgcaggaggacaaatcagatcggcacagcagcggcgccggtgcgtcgagggagcaggaacggcggccgtccaaggcatggggaatcctcatcttcggcctcatcggcgtcaccaccgccagtttcgctattactcaagttcgcaaaagcatggactggttctacactcagttgaataaagtgcagtcaacatcatcttggacttggaggtatacaagtaataactcaagtcgtggaagcttaatgaggaagctaagaaaagtatttatcagcgaatgc

SEQ ID NO: 74588 - DNA, 130 bp, Zea mays
  Clone ID: LIB3079-045-Q1-K1-C4
cccacgcgtccgggagggggagcaagcattttccgtccgtggaagaagatgtcttacgtagtgcctcttctgcactcgttgtgggcggtggaccatgccatcctcgccgaggaggagctcctattcatca

SEQ ID NO: 74589 - DNA, 421 bp, Zea mays
  Clone ID: LIB3079-045-Q1-K1-C7
ggttgctcttccagcaaggaaaaggaacgctaggctttcttttgcatttgtatacccaggcgaagaatggtcgttttgttgtcagacaggtgggttcgaccttcgcttatggccatggaagaggtgatgatgccaaaactcttgcagagcttgggttccagattggcgattatctgagcgtcgcgatcatgtaactgcagattggcgattacctgagcgtcgcgatcatgtaagccggtgcccgcaatgagttccggtgactgcaccggatagaactgatgtgatgtaaaaaatgcattggttgcgacgagcaagggaggagtatctgttagcgctaggaagtggaaccaaaactgtctgtaatgccggtactaccaaagttgcctagacactttgaacgatcaaaaaaaataaaataggg

SEQ ID NO: 74590 - DNA, 335 bp, Zea mays
  Clone ID: LIB3079-045-Q1-K1-C8
ggctggcttctcctccccctcttaccaagttcttctcgggttagggttccttagggttttgtggaggggcgatggcggcggctgatgtggagtaccgttgcttcgtcggcgggcttgcctgggccaccagcaacgagtcgctggagaatgccttcgccttctacggcgagatcctcgactccaaggtcatcaccgaccgggagacggtgaggtcccgcggcttcggcttcgttaccttctcctccgagaactccatgctcgacgctatcgagaacatgaacggcaaggagctcgacagccgtaacatcaccgttaaccaggcccagtcccgtggc

SEQ ID NO: 74591 - DNA, 370 bp, Zea mays
  Clone ID: LIB3079-045-Q1-K1-C9
ccggaatgatagtataccaaaaagcttctcaaggaatctgacgattacaaaggatatgaaggattctatatttgtgtggtatcagctggatgacttttaccagaaccataggaggtatgtcaagagccgtaatgatgcacagctaagagataaaagtaaggcgagtgactttaccaattgtgatcctgaggccaaaacggtagactgaaaaccaattgtgccttgtggtcttattgcatggagcctgttcaatgatacatataaactcattcacaacaatgtaacctttagagtggagaataatgacatctcttggaaaagtgacagagaccacaaattctggagtgatgtctttccaaccaacttttaa

SEQ ID NO: 74592 - DNA, 198 bp, Zea mays
  Clone ID: LIB3079-045-Q1-K1-D1
cccacgcgttcgcccacgcgttcgcaaggctcatgcctgaaagtcactattcgtcagctggggcggtccatgatacaacagatgcaacagccttgcaatgagtgcaaggggactggagagagcatcaatgagaaagaccgctttccatggtgcaagggtgagaaggtcattcaagagaaaaaagttcttgaggttcat

SEQ ID NO: 74593 - DNA, 263 bp, Zea mays
  Clone ID: LIB3079-045-Q1-K1-D11
actccacccactcatccgaaaaaaaaaaaaaaaaaaaaaaaaaattaaataaaaaaaaaaaccaaacaaaaaaaaccagccaattaaaaaaaaaatacgccaacacaaaaaaaaaacaaaaaaaacaaaaaaaaacaaaaaaaaaacaaaaaaaaaaaaaaaaaaaaccccccaaaaaaaacactcaaaccaaactaacccaacaatccaacacaaaaccctttcaaaaacaaccccaaaacccaaacaaccccccaccaatc

SEQ ID NO: 74594 - DNA, 375 bp, Zea mays
  Clone ID: LIB3079-045-Q1-K1-D2
aggaggtccgtagctgctcatccatggcatgatcttgagatcggtcctgatgctcctgcggttttcaatgttgttgttgagatcacaaagggaagcaaagttaaatatgagcttgacaagaaaactggactgattaacgttgatcgagtcctgtactcatcagttgtatactctcacaattatggttacgttccaaggactctttgtgaagacaatgacccaatggatgtgttagtcctgatgcatgaacctgttgttactggttcgtttctgcgagcaagagcaatcggccttatgcccatgattgaccagagtgaaaaggatgacatgataatagcaatctgtgctgatgatcctgaatatcgtcactacaac

SEQ ID NO: 74595 - DNA, 152 bp, Zea mays
  Clone ID: LIB3079-045-Q1-K1-D3
gcaagttcaattgataacactgctgatgcctttttcctgatagcagaccactcttaatttgcgggcattcttaagggtagcagctgcatacctgtaaagttaaaggccaaatgtgggtttctgccttcttcagattttttttaagaagataa

SEQ ID NO: 74596 - DNA, 333 bp, Zea mays
  Clone ID: LIB3079-045-Q1-K1-D4
aaaaatcttcccaaaccctagctcccgatcttgatggcgaaccctcgcgtcttcttggaggtgacctttggcggctcccctgcagtcctgatcgtgatggagctgtacgccaactaggtgcccaagaccgcggagaactttcgcgcgctgtgcacgggcgagaagggcgttgggcaagtcctgtaagccgttccactacaagggcttcacgttttaccgcttcatcccctatttcatgtgccatggcagcgacttcacccgctgcatctgctcctgctgcaagtccatctactgctagaagttcctcgactagaagttcgtgcgcatgcacat

SEQ ID NO: 74597 - DNA, 345 bp, Zea mays
  Clone ID: LIB3079-045-Q1-K1-D5
gcgaggcgtccgagcctcacggcaccgccttcgatggtgccgccgtggcgcggcgcgcgggcacgtacacggtgcagatcaagacgagctgcgcgtccccgcggagctccgcggacgcggtgagcctcgcgttcggggacgcgtaccgcaacgaggtgtacgcggcgactgtgacgcctcggcgcgggttcgagcgctgctccacggacacgttccgcgtcgccgggccctgcggctacggcgtctgctacctctacctgcgccggtctggccgctcggtcgggtggacgccctagtgggtcagggtgttcgagccggctttcggtgcgtctctcaccttttact

SEQ ID NO: 74598 - DNA, 188 bp, Zea mays
  Clone ID: LIB3079-045-Q1-K1-D7
aaaaaaaaaaaaaaaaaaaaaaaaaataattaaaaaaaaaaaaaaaaataaacttccacagatacttttccaaactcacttacacttccaatcaacatcttacctatcttaaatttacacctaaattacaattaacaaccctttcttctcacatcacatcacatataaaactctctctttacccaact

SEQ ID NO: 74599 - DNA, 264 bp, Zea mays
  Clone ID: LIB3079-045-Q1-K1-D8
cggacgcgtgggcggacgcgtgggcggactcgtgtgcggcaacggatatctcggctctcggatggatgaagaacgtagcataatgcgatacctggtgtgaattgcagaatcccgcgaaccatcgagtttttgaacgcaagttgcgcccgaagccttctggcggagggcacgtctgcctgggcgttacgccaaaagacagtgaaaaataaatttgagatttcaattacaatttagatcaaataatatagtaatataatatgtgtc

SEQ ID NO: 74600 - DNA, 392 bp, Zea mays
  Clone ID: LIB3079-045-Q1-K1-B8
cccacgcgttcgcccacgcgtccgctcctttacgctgcagctgacgaacaagacagacaagcaagtctcgttcaaggtgaagacgacaagcccgaaaaagtactgcgttcgcccaaacaacggcatggtggcgccccggtccaaggctgacgttgttgttactatgcaagcgcagcgggacgtgccaccggacatgcaatgcaaggacaagttccttgtgcagagcgccactttcgccaaggaggtcgtgccaaatgaggtcactggagacatgtttaccaaagattcaagcaatgtattggaagaagttgaagtgaatgtagtttatgtagcaccatcctcctttcaaagcctatagatttgaggattgtaatctctgcagtttgagtttt

SEQ ID NO: 74601 - DNA, 457 bp, Zea mays
  Clone ID: LIB3079-045-Q1-K1-D9
cgaattcccgctggagccacgcattcggctgacataatcatcttattcacttactctttcgatcactgtactgaaatacgatgctctagtcgaccgcgatgtttgtagccgccctggccctggtggtggtgatggcgacgacgagcacaggcggtggcagggcggcagcggcgtgcgatcccaagccgctggtggtgtgcgatccggcgttcatggactgagcgaaacccgcggcagcatgctgctccaccctgcgtgcgcaagaggcatgcttgtgcgtgtacgccaaagaccccaagtttgcaaaatacatcaacaaccccaacaccgtcaaaacctttacctcgtgcggcatagccattcccaaatgctaaacaagcgctcttcgtcgtcgcttcgcttgctcttgcttcttggggtaacatattcagcttatgaataaattatgtggatcaat

SEQ ID NO: 74602 - DNA, 408 bp, Zea mays
  Clone ID: LIB3079-045-Q1-K1-E1
ctagaagaatctgttcttgctggtggtgcatccgcaaatgctgtcagagactaccagcgggaagggcatgagatgaatgaggaaatgaaaactcttgatcgtgagctagctcgtgcaaaggtttcagcaaatagggttgcagtagtggtggcaaatgagtggaaagatggcgatgataaagtaatgcctgttaaacgatggctcgaggagcgaaggattctgcaaggagaaatgcagcaactccgggacaaacttgctattgcagaaagggctgcaagatcagaagctcaactgaaagagaagttccagctacgacttaaggtactcgaggaaggattgagaatgtctacatcgagaaccaatgtcagtggcacacgccgtcagtctattggtggtgctgattgtttg

SEQ ID NO: 74603 - DNA, 455 bp, Zea mays
  unsure at all n locations
  Clone ID: LIB3079-045-Q1-K1-E10
cacgcatccgatgattaccaccaccagtagcagggctctgatctctcgaggtggcgggctcttcagggacgggtttcataatagtctggtgctggcgtccgactgctttccatgcacgtcgaggtcggacgaggacgcagagacatgctggccagtggctgcggccacaggccccatcgttgtggcaccagcgacgaggaggttgtagtcgagcagcgtggcgcgggtgtcgttccgcgtatggaggcactatccgctctacattcgccccatcgttccatggtagctaaggtacccgtaccaccaactctctgactctaacgatcaatcgatctgctttggctagggaggtctcgattggtagatgcatgttgagtgcttgcggtactgatgcggacngagcttgagagtcggattgatgcatattgtggttagcgattgactacttgtttgcc

SEQ ID NO: 74604 - DNA, 360 bp, Zea mays
  Clone ID: LIB3079-038-Q1-K1-E2
ggccggcgagaagaacaagatagacgccgccttctgttactgcggcgtgcagtacgcagccgtccaggtatggcgcggtacgcctaacaacccgttgtggacataggtggagctcatgaaccaaacagaaatgctttcttatatatccaccctttgtaacgtgtctccgtgaggaatgagtccatagtatctcccatcgccgattacaatgactgctccgacctttatttcttctgaactgatctgagctggactgacgtatgtaacagccatggatgcaacgaatcatggaaaaattgatgtgaaaacgaaaggttttgtgtgttctggtgcaacttaagaaagatgacggctcccccg

SEQ ID NO: 74605 - DNA, 365 bp, Zea mays
  Clone ID: LIB3079-038-Q1-K1-E4
gagagagaggagggaaaatgctgcgccacgccgcccgccgcctcgtttcccgcgccgtcgctccgcccaccgcgcgccgggcgctcgccacggcggaggtgcccgcggaggccgtcgaggactccacgttcgtcgaggcctggaaaaaggtcgcccccaacatcgagcccccagcgacgcccctctccctcatgcagccgcgcccgcccacgccagctaccatccctaccaagctcaccgtcaacttcgtcctcccctacaagtccgagatcgccaacaaggaggttgacatggtaattgtaccagctacaactggtcagatgggtgttttgccaggccatgttgccacaattgcagagctcaag

SEQ ID NO: 74606 - DNA, 123 bp, Zea mays
  Clone ID: LIB3079-038-Q1-K1-E5
cacccttccgaaaaaacattccgaaaaaaatacatttttttcattcaaaaacctagaaacacaccacaagggaggttttctcaaagaggggggggcgctaaaaaaaaacaaaaaataatacgg

SEQ ID NO: 74607 - DNA, 368 bp, Zea mays
  Clone ID: LIB3079-038-Q1-K1-E6
cttgactcgtggccagtacctgcacgactctcacaagggtgcaattctacaaaggctacctggcttagctgaggaaagccatcgatgacggcgccgacgtggctggctacttcgcttggtctatcctcgacaacttcgagtggcagtcaggttacacgtccaagtttggaatcgtctacgtcgacttcagcacgcccaagctcgaacgacaccccaaggcgtcagcctactggttcagagacatgctccagaaacacttatgagcgtctaacaaccaagcctgaaataggtaccattaaatttcttcagcgctgcctaagctagtggccatattattgtagcaaaagttgtaagctagcacagtgcaa

SEQ ID NO: 74608 - DNA, 361 bp, Zea mays
  Clone ID: LIB3079-038-Q1-K1-E7
ccaggagcgcctcatctagctctaaccttgactccccagctccaaaatcttcggtcccgttagctgttcctcctgtaagccaggctccgccagcaacactgatcgccactacaactgcagcagcaataatgcctagaggtacggtactgctggctgcatcgtagttctcgttgctctcttcctccactgtattgaaattgtatcgttcttgtccgtccgatgcagctgtccctcaagctaggaaggcgtcccttgctcgattcttggagaaaaggaaggaaaggtagaatccatactcttattctcggtgattccattccaccacacatctgttttggttttgaggcagatctgcaactgt

SEQ ID NO: 74609 - DNA, 396 bp, Zea mays
  Clone ID: LIB3079-038-Q1-K1-E8
attgccgggtacgacaccacgcgctccggagagagaggagggaaaatgctgctttctacgccgcccgccgcctcgtttcccgcgccggcgctccgcccaccgcgcgcggggcgctagacacagcggagatgactccacaatgcccacttgctccaagatccattattacactggaaaaaggtcgccccccataaatgggcttcgaacacccagctgtgcaagcgcatacgcgcccacaaacaattgctgcgagcgttttacaacaaccaatcaacttagttgcttcaacaaagcttggcacatctaacaatacaaaccatcgcatcatagcaccaacaacaaatcctaccagcactgagccacctagccatggtgaaccctgacgcctacttgcaa

SEQ ID NO: 74610 - DNA, 438 bp, Zea mays
  unsure at all n locations
  Clone ID: LIB3079-038-Q1-K1-E9
cttggagtggtccatcgatcgagctccgtgaaagagagagagagagagcaagcaggggcgacagcagggaaggtgatcaagtgcagagccgccgtggcgtgggaggccggcaaaccgctgtccatcgaggaggtggaggtagcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaagagagcaacatgtgcgacctncttatgatcaacgtcgaccgcggcgtgatgatcggcgac

SEQ ID NO: 74611 - DNA, 350 bp, Zea mays
  Clone ID: LIB3079-038-Q1-K1-F1
cgcaagtcggaagccaacgatttgtttacaggcgccggagctcccgacgacgactgagccatgtgcggcggggcgatccttgcctagctccgcgagccggagccgcgccgggtcacggagcgggacatctggcagcagaaaaagaagcccaaaaggggcggcgcctgcgggaggcgctcgttcgcggcggaagacgatgaggacttcaaggcctgcttcgaggactatgaagccgactccggtgattcggattcggagctcggagaaggggctgacgacgacgtcatcgagatcaagcccttcgccgccaagagtactttctccagagatggcttaagcaccatgactac

SEQ ID NO: 74612 - DNA, 418 bp, Zea mays
  Clone ID: LIB3079-038-Q1-K1-F10
caagctctttggcttggatactgagaaagtcatcaggtttgttgaaaacaggccattcaatgaccagaggtacttcttagatgatcagaagctaaagagattgggatgggcagagcgcacaccatgggaagagggtttgaagaagacgatggagtggtacaccaccaatcctgattactggggagatgtcactggtgcgctgcttcctcatccaaggatgttgatgactcctggagttgaaaggcataactgggctgaagaaatcaagtctctggcttcttcgccagctgaagctagtacaatagctccagcaaccagtaccaaaagcatctctgatgcccctcagaagccttcctacaggtttttaatctatggtaggactggatggattggtggcctccttggaaagatttgtgaa

SEQ ID NO: 74613 - DNA, 420 bp, Zea mays
  unsure at all n locations
  Clone ID: LIB3079-038-Q1-K1-F11
cccacgcgtccgcccacgcgtccgtccacgcgtccgggcgcccgttcaggatccgcatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaagagttcagctacagcaagatcctcaaagatctcaagaaagagttctgctgcaatggtacagtggtccangacccagaacttgnacaggtcattcagctccagngtgatc

SEQ ID NO: 74614 - DNA, 284 bp, Zea mays
  Clone ID: LIB3079-038-Q1-K1-F12
cgcacgcgtacgagccaccgcagcattcacagcgcccaggagaaagacgatgcaggtcatgatgcagacgttcacggggacgctgacagggatgaccgtcaccagcaaggtcgccagcaacaacgccatggacaatatccaggacaaggtccaggtcaaggaagggatccagccggtgcagtatcccctgatgtatgtcgaggagcacctgaaggatggccactctatcatggactatgacattacactggagtttacgcttaagctcgtgcttaggatcattg

SEQ ID NO: 74615 - DNA, 351 bp, Zea mays
  Clone ID: LIB3079-038-Q1-K1-F3
ggccgaatccgccggtgagaaggggagcgatggcgaggctggcggtggccgcgagggcgttctccgctgcggcctccggcggcggcgtgtccttggtgcagggggcgtcccgggggatcggcctcgagttcgtgcggcagctgctgcgcagaagcgatggaggccgcgtcgtcgctacgtgccgcacgccgggttccgcggccgagctccagaagctcagggaggagcacgcgcccgggcgcctcaccgtgctgccgctcgacgtcaccgacgagagcaccatagaggcagctgcggcctcaatcacggagacccacggttctcttgaccttctgatcaactccgccggca

SEQ ID NO: 74616 - DNA, 364 bp, Zea mays
  Clone ID: LIB3079-038-Q1-K1-F4
ccaccaaccacgaaccacgcaagcgaacccggccggcgcggggcagcggcgatggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcgcgcgcc

SEQ ID NO: 74617 - DNA, 369 bp, Zea mays
  Clone ID: LIB3079-038-Q1-K1-F6
gatctttttcccgctgggtaagatatctgtgatgatatacggtgggttggcatcgcttatgttctgtggatacatcatctatgacacggacaatgtcatcaagcgctacacctacgatgaatacatatgggctgctgtttcactctaccttgacgtcatcaacctgttcctgtctctgctgcagctgctgagggcagccgatagctgagctcgtcaagctttcacttcgatcttgttctcacatacatctgtgtatatcacaaactctgtaatggtcatggatactccaatttataactatactctgtcggtgttaccttggttcaaatggtatgtctggctttaacggatacccatgagagttttaag

SEQ ID NO: 74618 - DNA, 357 bp, Zea mays
  Clone ID: LIB3079-038-Q1-K1-F7
tttagttttggtgtaacttgaatgaaatcatcagaatatgagatgtggggggtggggagtgaatggctttcctgcccatactatctgtaggcttttggccagtagcagtcgggtttcgctgtttactggcattaacatttttactctttcttctgcagctccatacccttttggtatagcttgacatgccagcagtggcacagtgccgtaggttccctagaggtgaactagatgtttgtcagcatggtttgattttgccagcctatgcagaaaacctcacttggtctttgtaatgtggtaatgccatgtatcagtatcctagtctgatggagttttggttgagacagttctcaaaaa

SEQ ID NO: 74619 - DNA, 292 bp, Zea mays
  Clone ID: LIB3079-038-Q1-K1-F8
gcggaataagcgcgtaactgatgaagacttattatacgctattgtcagatgagatattccaggctaaggttatctggtcccttgctgatgtacatgcaacacgtggttcacttgctttatctactgcaacagtgaaatcggttgcaccagatggagaggagaaattagcatgtacagtcggagcacgttcagtcgatgcaagttacatggctgttgacaaaatagttcacattccaaccgttctacgagtatacagtttgacttcatggacagagcgcattgacgcaatctc

SEQ ID NO: 74620 - DNA, 417 bp, Zea mays
  Clone ID: LIB3079-038-Q1-K1-E12
gttgagcataagtacttagagtctggttggaacctaaacaacttgcctagactacagggttcagtactatcttttgaaggtggggacatctgtggtgttttggtcccttgtctgcatgttggaatgtgcttttcatcattctgctgacatgttgaagaccatcatttgtactcactgaactacatgcattggggtgctccaaagatgtggtatggagttccaggaaaggatgccgtaaatttggaggcagcaatgatgaaacatctacctgacttgtttgaggaacaacctgatttgcttcacaacctgattactcaattttcaacttcattgcttaaatctgaacgagtaccagtctaccgatgtgtgcaccatgagggacagtttgttctaacattccttcgggcataccatgct

SEQ ID NO: 74621 - DNA, 360 bp, Zea mays
  Clone ID: LIB3079-038-Q1-K1-C6
gcagctatcccggccgggctggggccctctcctaccggccccactcacatggttccccatggagagccccaccctctggctcccaccggtcgtgcttctacgatggcctccggcggcgttctccggcccactcgacacactacccgccgcgctctacgcgttccactacgtccaccgtacgctggtccacccggtccgcctcgcccgactgcgccgcgccccggcccccgtgccgctcctcatcgacgcctgcgccttgggattcaatatcctcaacgcctacctacatgcccgctccttcgccctacactccagccgccaggcgtccaccttccgctgactcgctgggctggccctctt

SEQ ID NO: 74622 - DNA, 371 bp, Zea mays
  Clone ID: LIB3079-038-Q1-K1-C7
cggaggtaccgcaaggaggttgtagagagagtactttaatgtggacataacacaacatacactttctgagccagatgatcctgcgacaaggaagcatcggattgaaaacatattcaggctctgtggcaaccatcgtgaaatagctaagaaaccaaaggtccagtcaccagcaaaggaaatgttctgcagcgagaacaagtctccagcaaagcaagtgtttggggatcagaacaaatcgtcatcaaaccaaatttttggagatgaaaacaaggagccgtcggcatggggtgctatagagacccccatgtgcgatgttagagtgactgacagcccagtgtcttctcagctttctccaatcgtatgccaagttg

SEQ ID NO: 74623 - DNA, 353 bp, Zea mays
  Clone ID: LIB3079-038-Q1-K1-C8
ggcaccggcagcgctccacaggcccaacctgccgtccacggcgcgaaagaagagccgcgaacccgggagtcctgcctgtcctcgtcctcctcccccttgccatccgccgcccatggcgtccgcgtccgcccccgaagtggtggtggtcttcgacttcgaccggaccatcatcgactgggacagcgacgactgggtcatcaccaagctcggcgccgccgacgccttccagcgcctgcgcccaaccatgcgctggaacccgctcatggacaggatgatggcggagctccacgccagggggaagacgcccgaggacatccgcgactgcctcaggagcgcgccgctcgacacgcacg

SEQ ID NO: 74624 - DNA, 433 bp, Zea mays
  Clone ID: LIB3079-038-Q1-K1-C9
gtttttgtctgcgtcctacttttgctgctgcacatatgctggcactatgtttggggttgctggctgctgcccatgctgagcaaagatcagtgacctaatgaggaagttgcagcacaagccaaagccctcaggcagagttttataaagcaacacgaagcaaggaccgcattgcaagatttcagattagagaactaactgtagagcctggaacgtggtttagcttaaccatgtatacataacgttcaaacatcgttctgacttctacaaaaagttaagaggatctgaaattctaaatcttgcctacgcctttttagttagattggaagcaaagatagcttccatgaccacagaaaaataactattcttttcctggtgtaatttctagaagttttgagataaaataaataaaatttttttttattatttatttaat

SEQ ID NO: 74625 - DNA, 333 bp, Zea mays
  Clone ID: LIB3079-038-Q1-K1-D1
cccacgcgtccgcgccgagaaggacgactctcagggacaggggcgtctggtactacgagagcctcaaggccagcggctaccctggcgaggtggagctgctcgagtccatgggcgagggccacgtcttctactgcatgaacccgcgctgcgacagggcgcgggagatggaggagcgcgtcctcggcttcctgcgcaagtgagcgagcgactgatcgcgcgccttgctacgcgattgagatggaataatttcaccgtttccagatgtggaggcgtttgagcatgaggccatgagggtcttatttgtttgcttaagatcaattgattgaagtttcg

SEQ ID NO: 74626 - DNA, 240 bp, Zea mays
  Clone ID: LIB3079-038-Q1-K1-D10
aggtgatggaattatcacaataaagatgtagacataaatgtgtgtatatacattctgtgacacttcaaagtttcagtatatgcaaaactgaatatgctgcttcaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaagaacgaaaaaataggtgttttctatcgtgaccccaatttaa

SEQ ID NO: 74627 - DNA, 59 bp, Zea mays
  Clone ID: LIB3079-038-Q1-K1-D11
cctatgtcaaactacaatatgatatgtacccttgctaaataattgtttcgtttgctggt

SEQ ID NO: 74628 - DNA, 442 bp, Zea mays
  unsure at all n locations
  Clone ID: LIB3079-038-Q1-K1-D12
gcgaagaagcccgcagaggaggagcctgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgctacaacangaagcccaccatcacctttccggagatccagaccttcgtccgnctcgttctacccggcgagctcgccaagcacgccgtctcggagggcaccaaggccgtcaccaagttcacctcgtcctaagctccttttctag

SEQ ID NO: 74629 - DNA, 359 bp, Zea mays
  Clone ID: LIB3079-038-Q1-K1-D2
ttcttataggaagtattcaatgcatgtttatttgccatcctatcataacaattttgcgttacaaatggaagtggtggtgtagtaataaagaattgcacagtgataattaggtcccctccatgacttctaatatctaaaacatgggattttgtagctcctagttcatgactacattcatccatatgcttcttcccaagtactagtcaatacaaaaacgctcatgtgaggctgtcctctttccgagtactagccatatgcttctttgtagttgtactttctttgtaaggtttatgaactctcttgaactccctgcatctgcagcaatttctgctgctcctcgtcgttctcttccttcggct

SEQ ID NO: 74630 - DNA, 362 bp, Zea mays
  Clone ID: LIB3079-038-Q1-K1-D3
gacctaccaaggaagaaacgccgaagattagaggcccagcgagagatgctggaagatgaggatgaagatgacgaggaagcaaaggaaagtgatagagggaagaaactgaagaaaggccagtctctagtggatgctgcttaccgaaaggcaaagtcattgaaggcggctagcaaacggggtcctggtgcaagcaaaggaaagaaagagaagaatgcaagacaatattctgagaagactcctaacaggcatgaggagatgcgtgagctgttccagaatgatatgagtgaatggaaacagggacgctcctcaaagaaaaacaacaatttcgcgcacaaaaaatcaaaagcttttaatagcaaagc

SEQ ID NO: 74631 - DNA, 360 bp, Zea mays
  Clone ID: LIB3079-038-Q1-K1-D4
gcacaaagcaggagattgcatttggacagttctcaaaggccgcgtgtacaacattgctccatacatgaaatttcatcctggaggtgttgatatgcttatgaaagccgctgggaaagactgcactgctttgttcagtatccttctattattatttctgcactgtgatacattatcttgctgcttgtgggctcatactggaacaccattcttattattatgcaagctggtgtggcctaaaggcatgatatacaaacagcgatcactatgatgcctttgcagcttttgctcaatctcttcgtgattgttgattgtgcatctgcttataattcttgattgctccttgactagactattagataa

SEQ ID NO: 74632 - DNA, 144 bp, Zea mays
  Clone ID: LIB3079-038-Q1-K1-D5
gtggtggtggcactggctctggccttgggtctctcctccttgagcgcccgtctgtggagtacggcaagaaatccaaactgggctttactgtgtacccatctccccaggtgtcaacacttgttgtggagccttacaacagagtgc

SEQ ID NO: 74633 - DNA, 246 bp, Zea mays
  Clone ID: LIB3079-038-Q1-K1-D6
aaaaaaaaaaaaaaaaaaaaaatagattttttatacaaataaaaaaaaaaaaaaacaaaggggcgcacgttgtggggtgcctttcttctcccacgttcttcccacgtcttgctcttttagtgccacctattttcactcatttgccttcactgaccacgtctgactggtaaaaccctggaaatcctaacttaaccgaacttaatccatcccccttttatccagctttcgtcatttggaagatgcccg

SEQ ID NO: 74634 - DNA, 353 bp, Zea mays
  Clone ID: LIB3079-038-Q1-K1-D7
cgaagtcactttgtcaaagcgcttgaggttgctctcctcctgatcgtttacattgcatatggatacacaaaaggcggttcatcttcatttattctgattactatcagtagttggttcctcgttatgtcctggcttttcgcgccttacattttcaacccttctggtttcgagtggcaaaagactgttgaggactttgatgactggacaaactggttactttataaaggtggagttggtgtaaagggcgacaacagttgggaatcttggtgggatgaggagcaggcgcatatccagacattcagaggacgtattcttgagacaatcctcagccttagatttctcatgtttcagta

SEQ ID NO: 74635 - DNA, 434 bp, Zea mays
  Clone ID: LIB3079-038-Q1-K1-D9
gatcgccaataatggagtttccgcactcaccaccaccaccacggccatcgccgcgaggacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcggtggctccgagtacgggcacgagggccgaccgtaccacggcggcggcggatcccagtacggtcacgagacacg

SEQ ID NO: 74636 - DNA, 359 bp, Zea mays
  Clone ID: LIB3079-038-Q1-K1-E1
cccacgcgtccgcccacgcgtccgctcgtacatccacgacctgatgctcaccatagtgaagttcctgagcgacaacggcggtgccttcaccgtcaacatctacccgttcataagcctctacatcgacccgaacttccccgtggactacgccttcttcgagggggcctcgtcgccgattgtggacggctccttcacctacagcaacatgttcgacgcgaaccacgacacgctgatatgggcgctgaagaagaacgggttcgggaacctgcccgtgatcgtcggcgagatcgggtggccgacggacggcgaccggaacgccaacgcccagatggcgcagcgcttcaaccagggcttcatga

SEQ ID NO: 74637 - DNA, 368 bp, Zea mays
  unsure at all n locations
  Clone ID: LIB3079-038-Q1-K1-E10
gcctgagactgaatatggcaggatgaatattggcagccgtccatcaaagaggaagcctagtgggggaatagaatcgctccgcgcaatcccatggatctttgcttggacacaaacaaggttccatctgcctgtttggcttggatttggcgcggcgatcaagcacatcatgcagaaggacatcaggaacatccatatactgaaagagatgtacaatgagtggccattcttcagggtcacccttgatctgctcgagatggttttcgccaagggtgatccaggaatcgcagctgtgtatgacaaattgcttgtggctgatgatttgcaatccttcggcgagcaactgangaagaactatgaggagacaaagg

SEQ ID NO: 74638 - DNA, 436 bp, Zea mays
  Clone ID: LIB3079-038-Q1-K1-E11
aagaaccttcgtgtcaaagaactgtaacctgagactgcattaacgtcaataaatgaggatgttgaggaaatcctagaacaaataaagcccaccccaactcttgtgtttggatctcttctgggcctctcagcactttcctatgctttactggaatgggagatgactttgcaatacatagctgttttaagcgttgggctgactatctacttgcgattctctacatatgaggactccgaggatttggagaaagacctaaagctgttgctgtctccagtaagagtaggcgcagacgccttgtcatgggcagctaagaagatagagccaaacaaggtgggcctgccaacgtctccttccacgacggcggtgaaagaccgggttcttcaaggccgcgcgaaacacgagtcgcagccatcggatgccgacgagtcgtcggtcc

SEQ ID NO: 74639 - DNA, 365 bp, Zea mays
  Clone ID: LIB3079-038-Q1-K1-C5
accctacaaaccattgcaacgcaacaacaacaacaacagtttctgccatcactgagccacctagccgtggtgaaccctgtcacctacttgcaacagcagctgcttgcatccaacccacttgctctggcgaacgtagctgcataccagcaacaacaacagctgcaacagtttatgccagtgctcagtcaactagccatggtgaaccctgccgtctacctacaactactttcatctagcccgctcgcggtgggcaatgcacctacgtacctacaacaacagttgctgcaacaaattgtaccagctctgactcagctagctgtggcaaaccctgctgcctacttacaacagttgcttccattcaacca

SEQ ID NO: 74640 - DNA, 395 bp, Zea mays
  Clone ID: LIB3079-038-Q1-K1-B1
taccggttcgattccgggtcgacccactcctccgaaaaccataacaatgtgcgtgattttcttaaaaaagaggcattgcaactagcaagggaaaatttagaaaaggagcagcggattttgaaacttaggaatcattgcacaataattagaaccgcggaactgtctgctggtcaagaccatctaactgatttggagaggcaaaaggatgatattatgaggccctattcccctgccgctctgctcaacatgctacatacatcaatggcaaaagcggatgaggagcccgaggagctgcaccagatgttcctggagaatgacatagtccttacaacctttgtgcagaagtacaagaagcttcttacggattaccacaagcaggcattgcttcatgtcgc

SEQ ID NO: 74641 - DNA, 436 bp, Zea mays
  unsure at all n locations
  Clone ID: LIB3079-038-Q1-K1-B10
cggagcgccagcccatcggcacggctgcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgncggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcangggctgtacat

SEQ ID NO: 74642 - DNA, 429 bp, Zea mays
  Clone ID: LIB3079-038-Q1-K1-B11
cacgcacgcgcggcaccacatctagtagagcctgcctaccgccccactgtcgtcgggattaattcaccaggctagagctagctagctggctctaccgccgttccccgatcgagcgtccgtcatggagattgatgagatggagagcggtgtcgtcaatggaagcggcggcggcgggtcgttccggcgggcgaggtgctgggagctgctgtgctcggcggcgggcatgctctggggcaaggtcgtcgggttcgcccgcaagctgggcaggatcgcgagggacgacccccggcgggtggcgcactccatcaaggtcggcctggcgctcacgctcgtgtccgtgctctactacgtcaggccgctcttcaacaactggggggtgtccaccatgtgggccgtgctcaccgtcgtcgtcgtcatggagtacaccgt

SEQ ID NO: 74643 - DNA, 401 bp, Zea mays
  unsure at all n locations
  Clone ID: LIB3079-038-Q1-K1-B12
gacagttccctcaccttcaatgtctcctccagtgaagccaacccgctttgtggagattttccgactccaagaaggtgacccctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggccgtgccctccaggcgagcacnctcaagcctgngcttgcaggtggagaacctgnagaaggctagagctgccttcctcgccaggtgcaaggccaactctgaggctacccttcgcacctacaagggtgatgctgccgccgacaccgagag

SEQ ID NO: 74644 - DNA, 141 bp, Zea mays
  Clone ID: LIB3079-038-Q1-K1-B2
gggagatgtgcttccagttttcagcattataaagatggggggtcagtacttggggtcgcttggctcaaaaaaaaacttatgtctgcttacccaacatctgttgaaaaagccaggggaaggattttttggaccatttcattg

SEQ ID NO: 74645 - DNA, 369 bp, Zea mays
  Clone ID: LIB3079-038-Q1-K1-B5
cacattacaaatatttggaagatcccatatcgtactaagagggtgtaccctccatgcgatacttctgctcttcagatgcttcccctggaaagaccaacaacacctcctgttcttatttcagttgcacagttccgcccagaaaaggcccatggccttcagctggaggcatttgcacttgctcttcaaaagctagaccctgactttcctaagccaaagattcaatttgtcggtagttgccggaataaagaggatctggacagactacaaaagcttaaggacaggtccactgaactacacatagatgagcttgtggagttccacaaggatatttcttacagggacctggtacaatttcttgggggtgccatt

SEQ ID NO: 74646 - DNA, 361 bp, Zea mays
  Clone ID: LIB3079-038-Q1-K1-B6
agagcagtttgaacgatcggatggatttcagcagcaattaataattaaagtacgtgaaattttgaccgacaaagaatggcgtaggagaaaaatgcaaatgaggatatcagaggaagaaggaagacttaagaaggatgaggaggaaacaaaagagatgtggaagaggaagagagagcatgaagagaagtgggaggagaccagagacaagcgggtctccagctggagggatttcatgaagacaggaaagaagggacggaaaggtgaaatcaagcccccaaaactgaagactgaagatccgaacaaatcttatgtgcaaaggccagtaaagcgaaactgagtggaatgtcagcaatcaaagaac

SEQ ID NO: 74647 - DNA, 371 bp, Zea mays
  Clone ID: LIB3079-038-Q1-K1-B7
cccacgcgtccgcccacgcgtccgccctctcgtccgcactgaggctatatccactatccagcaaagaaggcaaaatgcaaaatagggtatcgcacggcactttagcacaatggcatgtctctaatagggtatgcattaggaggtaaaatgcatatgagaggggatatgcaaaatacagtattgatttgcatatgcatgatctgttggaggaatctatactatatgttttttttgtgaaattgaaagaaaagaaactaccgatctgaatttattaactagcatgatgcggatcaaccgaagacttaggctgctgcaaaagttatagtctatggcgggaagctatatgcaggagggtggttccggttccctcc

SEQ ID NO: 74648 - DNA, 359 bp, Zea mays
  Clone ID: LIB3079-038-Q1-K1-B8
agcacgtacccgccaccgccggagtcaggctcggcctactcagtttatccaaggtcggcgacgccaggcacactggaccgtgcgctaccgtactatccggcgcctcccgtcggctcgtattaccctccgccggggacacggtacttcgaggtcgacggcgcggccaggacgccgtcttactacccaccgccgagtcaatacccgtaggagttcggcggataatctgcaacgttgtggaacagtggacgatgtttccaaggttgctccgccgcttcccgccatgattgccattgaagacaggtcatattgccgcggtgcgtggcgtgggtgctaggctgcaatatgccggcttgttcggg

SEQ ID NO: 74649 - DNA, 440 bp, Zea mays
  Clone ID: LIB3079-038-Q1-K1-B9
gagcgagcgagcgagccaccgcccgatagagagagagagagagagagagagagagggagagtgagagtggggattcaagtttcaaactcactatcgaggggggataggaaggtggtcactcatcggtccacagctagctcgtcgccccccatggctgactggggccccgtggtgatcgcgacggtgctgttcgtgctgctcacgccgggcctgctgttccagctgccggcgcacggccgcatcgtcggattcggcaccatgcacaccagcggcgtcgccatcctcgtccacgccgtcctctacttcgcgctcatcaccatcttcctcatcgccatcggcgtccacatctacgccggctagctagggccgggtgtcttctattccacacccccttcgtctcttcctctcattatcggcccctgctagcttcctagtcatgt

SEQ ID NO: 74650 - DNA, 362 bp, Zea mays
  Clone ID: LIB3079-038-Q1-K1-C1
aaacatccgagccaggtctgggagatcccggacttcttcgggtgaagaaaatcaccatgacatccagacagtcttgaccaacggtgacacttcttccaatggagctgacaattcaggtcccaccaaggatactgagtagctgaactgcagcttgctgcatcgctaaccacaaaggcccaagttattactttttgcagacctattttcagttctagcccctcccttcccatttcgattttgtttgttaagtcctcccgatctgtatttattaacttgcatgatgcgggtcaccgaagacttaggctgctgcagaagttttgtctctggcgggaagctatatgcaagagggtggtaccggttcg

SEQ ID NO: 74651 - DNA, 262 bp, Zea mays
  Clone ID: LIB3079-038-Q1-K1-C10
ctcatgccctatttatacacgtaattttatacatgttgtgtaagcctggggccaccggggtccaaggtgtggtcttggggtcctgtaagtcacgacatgacggtgcactgtattgttgacttgggtccgctgattttctgctgagagccgatgtcgaggactaatggatgtccgtactcccgagcccttagaggaggggtcgtccataccgtagttgttgttacaactccgatggattagcttgtgagccactgtgcttctc

SEQ ID NO: 74652 - DNA, 395 bp, Zea mays
  unsure at all n locations
  Clone ID: LIB3079-038-Q1-K1-C11
ccctgagattgctcacatgtacaagaccgacagggccaagtatgagtccaccggacgctcctggacacagaagtatgccatgggctagaagcaaggctaaaagctggccaaactggtgaatgtgccggaccccaaatcgttatcacctaaataaccagtcaagtcgcaagtatgaatggacttttgaggaccattgtgccctgttgaactcatgtattaccttgtgaagtccgttgtgtctggtttctacctgaccgtttcgttatctgatgctgtttctntaatatctgatgctgcttcattaaccatacttctatatggtttgtggtgttgctgtttgtttaatctgtcagctgcttgacgtttcactgaaagaaagacgttccagtgagcgc

SEQ ID NO: 74653 - DNA, 419 bp, Zea mays
  unsure at all n locations
  Clone ID: LIB3079-038-Q1-K1-C12
cggacgcgtgggcggacgcgtgggctccgtgatgtatggtgacacatcacctcaaataagccatagctctagcgtgtggaagtaaagctggctttgcgtgtatgacatgtctaatgccaacccaatcgtcagctttggaatgaagcgtgccattgatgatatactgaaatgagttgatcagtgcaattctttgacatctaactatttattattatatgagatgggaggaactgatggagaataaatgctgctgtagatntgtagaagttcaaaaaaaattgggtactccttgacaagtttgtagcccaaggggtacatcatacagtttgagatgaggacactatgtatactgtttgagacgaggacattatggatactactctagaaggctaccgaaaccaaatttgcatctgtttatt

SEQ ID NO: 74654 - DNA, 358 bp, Zea mays
  Clone ID: LIB3079-038-Q1-K1-C2
gacaaaaacacctatgaaaaaacctgtttgtaatgaaacccaaaaataatatgaacagtggtataacacgtgaacacattggtgctgatgtaaagtcgagcaggaaggaacaatacagagatcattcaggctagtggtgctctgatcaagatatcagataggggtgactatatatctgggacatctgacaggaaagtgactattactggaacacccggagctatccggaccgtggagtccatgatcatgcagagggtgtcagccagataacagaggtgatgagccccttctgaaggaagggcgtaagccattgctgtgtccgagcacagaatcgtgtttgatgcaagttaggaggatg

SEQ ID NO: 74655 - DNA, 364 bp, Zea mays
  Clone ID: LIB3079-038-Q1-K1-C3
gccaactacacctatgagatcacctgctagtaatgaagcccaagaatctttgaccattggtatagccgatgaacacattggtgctgttgtaggtcgagcaggaaggaacataacagagatcattcaggctagtggtgctcggatcaagatatcagataggggtgactatatatctgggacatctgacaggaaagtgacgattactggaacacccgaagctatccggaccgcggagtccatgatcatgcagagggtgtcagccagttcagagaggtgatgagccccttctgaaggaagggcgtaggccattgctgtgtccgagcacagcagcgtgtttgatgcaagttaggaggatgtgggaact

SEQ ID NO: 74656 - DNA, 356 bp, Zea mays
  Clone ID: LIB3079-038-Q1-K1-C4
cccacgcgtccgacgagacctcggccttctgcaacttcaccaaggaaacggctgccactaaccccgcgttcgcgtggctgctctgcgacagggaggacgtggaggactgcgcgagcttcctgcgcggccacgggatcctgacgcgtagcgggagccagttcggctcggacccgaggtacgtccgggtcagcatgctcgaccgggacgatgcctacgacatcttcgtcaagcgcctctcctccctgcactgaacaggccgggtcggctacacgcatgcatggcatggagatgggaggaggatcgatgccatgccgcccggccggcgtcggcattgccggtccgtggaacagtgtgag

SEQ ID NO: 74657 - DNA, 423 bp, Zea mays
  Clone ID: LIB3079-038-Q1-K1-A9
gacgaggagatcaccgtcgagtccgatggggtcccgatccgccacgtctccggggggtactcgccctcgccgttctggcccgagctcgagcccaacggcggcgacggcccgatcctaccgccgcccaccgagatggggcgggacgagggaatcctcctccgcgagtggcggagaaaaaatgctatggaacttgagaaaaaagaacagaaggagagggagctacgtgcccaaataattgctgaagccgaagaattcaagaaagccttttttgagaagaggatacagaactgtgcgtcaaacatggtgaacaacagagagagggagaagatttttgtagccagccaggagaaattccacgccggcgcagacaagcagtactggaaatcgatttcagatctcatcccacatgaaatagccaccatc

SEQ ID NO: 74658 - DNA, 453 bp, Zea mays
  Clone ID: LIB3079-043-Q1-K2-C2
gcgcaactagcaacataaaaggcacaatagtgtaccaacaatgtgcagccaaaatattttgcttccttatgctcgctgggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattc

SEQ ID NO: 74659 - DNA, 413 bp, Zea mays
  Clone ID: LIB3079-043-Q1-K2-C3
gtgcgccacaccgtccgcccaacccaactttcctaactccctgcttctctctctatctccctctctctagcacccggtgcagcatcaacccccctccaatggagctggcgaccgagccctcccaagctcctctctcaccttggcaagctctcccatggcgtctccccctcctctacggcagtaaggaccgagagatgatgatcgagccagtgatgtggtggtaacaacaaggtgcagttggtggacgtactgaaggatgatggacttaaccagtggatgctcgccgagcaagtacctcccccaacaaacactatctaagtgttaaattaaaggtactctttaggatgtttggttgatggtgtgacttggcctccatccctgccaccgggatagacggtcgagtgggttactgc

SEQ ID NO: 74660 - DNA, 259 bp, Zea mays
  unsure at all n locations
  Clone ID: LIB3079-043-Q1-K2-C5
tttgccctagcctcggttctcagttatctctaaaaaaaaaaaaaaaaaaaaaaaaaaaaaaaaaaaaaaaaaaaaaataaaagggggggaaaaaaaaaaatttttttaatatatagnccaaaaaaaaaaaaaaaataatttttaactccataaaactaaaacggccatgctctaaataaaaaaaataaaaaatacccaacccttctaaaaaaaaacaataaacaaatactaaaaaaaaactttatagggaatccttttt

SEQ ID NO: 74661 - DNA, 328 bp, Zea mays
  unsure at all n locations
  Clone ID: LIB3079-043-Q1-K2-C6
aaaaaaaaaaaaaaaaaaaaaaaaaataaaactggttttttaaaaaaaaaaaaaaaacccaaaangggaaatttttaaaaaatttttatggcccaccttcctccccttcatacaaagtcgccccccttttatagggtcccaaaatttcattcccttccccccgggttaacaacttcttttctgtttaaaaccatgccaatacaaaactcaattttttaaaaccacatccctttaaaaccacctgcctaaccaactaaaatccccttacaaatcaccctttttaacaattttccattataaataaaaaatccaaccccccttttatttc

SEQ ID NO: 74662 - DNA, 422 bp, Zea mays
  Clone ID: LIB3079-043-Q1-K2-C7
gtggcctgctttccttttgatgatcataactgccccccgatacaacttgtcatatcattctgccatagtgcgctactcatggttgaaggaggatatagaaaatgtggtggttgtccattgcaaagctggtaaggcaaggacaggattgatgatctcgagtcttctactatttctaaagttctttcctactgctgaggagtccattgaatactataaccagaaaagatgtgtagatggaaaagggctgattctaccaagtcagattagatatgtgaagtattttgagcgcatcttaacttacttcaatggtgaaaatcagccacccaggaggtgtatgcttagggggtttcgtcttcatagatgcccctattggattaggccatcaattacagtctctaaccacaatggtgttcttttttcta

SEQ ID NO: 74663 - DNA, 474 bp, Zea mays
  Clone ID: LIB3079-043-Q1-K2-C8
gttttcatgcagaaaggaatgaagaaagctctgataccttattttgagctcacaaatgctgtcagggttggggaccttgaactgttcagggctgttgcagacaaatttgcaagcacattcagcgcagacaggactcgtaatttgattgtgaggctgcgccataatgtcattcgaactggactgcgcaacatcagcatttcttactcaaggatctcccttgctgacattgctaagaagctaagactagactctgagaaccctattgctgatgcggagagcattgtagccaaggccataagagatggcgccattgacgccaccatagatcatgcaaatggctggatggtatccaaggaaactggtgatgtctactcaacaaatgagccacaaattgcattcaactccaggattgcgttctgcctcaacatgcacaatgaagcggtcaaggcgatgagattcccccctaattctcac

SEQ ID NO: 74664 - DNA, 428 bp, Zea mays
  Clone ID: LIB3079-043-Q1-K2-C9
ccatgacaggattatcatgcagagtttctttgataggaaaaaaccaaaaatgaatctcaagaaaaaattggggaacttagtcagtcacgtgcagtgaaggctattcaaggcagatttcaaacaccacgtagcaaagtcatttggcagacagctattgcttttgtcttgcttggagtgcttacccttgctttccctaccgaagaagggccaaccctccaggtggccatctcttgtgcagcaaatatctatttcatttatcagagggtcaaaagtggatggcgagcattcttttatgggtttggttctttctttgcttcctggttccttggcaccttcttgatggtatctgtaattccccctatactccccggtccaagaaacttggaagtgagcaccgcgtgtgttacttatgtgctccttttcatatc

SEQ ID NO: 74665 - DNA, 505 bp, Zea mays
  unsure at all n locations
  Clone ID: LIB3079-043-Q1-K2-D1
gcacttcttaacttaatcttccgaggagccaaacccgcaggaggagggtccgagaaaatcccaagcacccggggcgcgagccggagccggaggcctagtaaatgaagacgttcgatccgtggcccgtcttcttccgccgggagtggaagcgcaattggcccttcctcacggngttcgccatcaccggcttcatcatcactaagatgacggccaacttcaccgaggaggacctcaagaactccaagttcgtccaggagcacaagaagcgctgaccaaccagtaatctatgacatggacgccggatggcactggcagagggatggtgtacggtgttgtccgaattgcctgtctggacagccagttatgttatgctgtttgaatgaaaaattagcttctttttcttcatctaaatgcgtgcagcctatgctccatctgtaatgtaataagaggcaactgacttgatccaaaagctaccagcttctgattatgaatgatacttcaagtt

SEQ ID NO: 74666 - DNA, 60 bp, Zea mays
  Clone ID: LIB3079-043-Q1-K2-D10
ctctgcgcgcgctgcatcggcgcccgccgggaggcggatcccgcccgcctcgtccatatt

SEQ ID NO: 74667 - DNA, 281 bp, Zea mays
  Clone ID: LIB3079-043-Q1-K2-D11
gcattccaaggtctgacagtgagatctccaaagacgataccccagctacagcaccgcttaacaaggggcgagggctacgtacttcacccagaccactaaaaggcagtgaagccataggctattcatcttcggattgtcctcagcaccaatccagtcattttcgcaacgtttaccgcaaagaccgctaccttgggcaccagttctgtgatccagttgaactggcatcgacgcctgagttatcaagcatcagtggtgcgaagacagaaacgtctattggtgca

SEQ ID NO: 74668 - DNA, 414 bp, Zea mays
  Clone ID: LIB3079-043-Q1-K2-D12
gttcgacccgtccaagaggatcagcgtcaccgaggcgctggagcacccgtacatgtctccgctctatggggcgagcgcgaaccctcccgcgcaggtgccgatcgacctcgacatcgacgagaacctcggcgtcgacatgatcagggagatgatgtggcaggagatgatccactaccaccccgaggtcctcacgagaatcagcatgtgagtatgtgatgtgaccagacaggcagcaatgaaacatgtggacagaggtctgctgcgccaggatcatcacatgttcgcccttcttacgagcttaactgcgattactgcaccgagtcgaggtatcactacatgtatcggaaccgtcaagcggtctcttgtgtaaatatgcgctgaataaaatgtgtggcaatctcttgttttttgggt

SEQ ID NO: 74669 - DNA, 461 bp, Zea mays
  unsure at all n locations
  Clone ID: LIB3079-043-Q1-K2-D2
ggcgggcccttccttcggtgaacccttttcaattctaccgccggcaacgccaaagttcttgggcctcctcatcggcgacttttccgccggcgacaggaaacaacgaaccaaaccacttctctgtcgagaggcgtcgcgctcctctcttcgccctctgctgttatttttcttaacccggctntctctcgattgctgcgtaaagttgaagatgaggaagctcaagttccatgagcagaagctcctcaagaggcacaatttcttggagtacaagagggagggcggccaccgcgaggcgctcgtcacacagcgctaccgcctcgtggagagggacgactacaagaagtacaatgggatatgcttaatggtgcaaaagctcgttaacatcataaagcagatggacccaagagaccctntcagaatccagatgacagacttgattctcgataagctgtataatatgg

SEQ ID NO: 74670 - DNA, 143 bp, Zea mays
  Clone ID: LIB3079-043-Q1-K2-D3
ttttttttttttttatattttttttttttttccacaatttaaatctttcccactaccggggggggtttcttttacggggtcgaaaaacacttttccgataaatcaatctaataaaaaacaatcgatatatttaatacattaag

SEQ ID NO: 74671 - DNA, 104 bp, Zea mays
  Clone ID: LIB3079-043-Q1-K2-D5
tagctactacacctttcctatcctatgttctcagttaactttctggcagacagtatttaagttttccttcgtgtaatcgcctagatatatatatttccatttct

SEQ ID NO: 74672 - DNA, 347 bp, Zea mays
  Clone ID: LIB3079-043-Q1-K2-D7
tctgtatgcattttgcccatagacttggcttgctgcactggggaagacgacaatggtgaccgacaaagaggaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaaaaaaatcaaacttaactaacccttaattccaaataaaaacttttttaaaagggcaactaaaataaaattaattgcccttttttaaaaaactccgaaattggaaaaaccttgcgttaaccaaattaaatccttttaaagaaaatcccttttttccaacttggttaat

SEQ ID NO: 74673 - DNA, 313 bp, Zea mays
  Clone ID: LIB3079-043-Q1-K2-D8
gtttgcttggtggcttgggtaattatgttatggccttggcagagcaacaggaaaaaaaaggggccttaggagaaggtcatgataattattttgtatctaccatagtagttgtttgatatcgacgcctctctctctctctctctctctctctctctctctctgttattactttatatttttgttactgtcctttcatttgaatctataggatggtcaaagtggctgatgaaagaggagaaagaaacaaaacagttggtttcttgttacttgtaagtggttaaactgaaatacaaatggatgtaagattgaatga

SEQ ID NO: 74674 - DNA, 454 bp, Zea mays
  Clone ID: LIB3079-043-Q1-K2-C12
gctcccgcatcatggctcagccttgaaggaacagatttcttcaaccaagattcctgcccgtctcaagaggggcagcggactatgctcggcctgtgaaaacttcacgagcgaagccgtcacttatctcggcaaggaacagacacaggacaggatcatggagttccttcatgatgcttgctcccaatcattctcctttgaacagaagtgtgtcgagctgatggactcttatgcgactctcctgtttgccaagatcacggagatcagaccggaagcgttctgcaaacggtatggcctgtgcagggacacggctcttctctccggtgtgggaagtgacagcacgtgtgtgttctgccaccatctgctcgatgaaatcatgtccaaactgaaagatccagatgcggagtttgagataattcagattcttgtcaaggagtgcaataagatcgaggtcacg

SEQ ID NO: 74675 - DNA, 285 bp, Zea mays
  Clone ID: LIB3079-043-Q1-K2-A7
cgaccgtcttccacagcccagctcacgcacaactttccttgcccttttcttcgactctaccccatctcgcgggcatgggagaccccacccgcgcggggagcagccgggctcgagatcgcacccgctgcggtgcgggcccaagcgggagctgtccgcgtatattggcgcgcgacgacccacgcgggggcgctggaacctcgggcacgcttcacgtacggcgccgaccgagcgaccccgcgggcgcaggcgagctcgcgcgctcagtcgcgcgcgcgcatgccgctc

SEQ ID NO: 74676 - DNA, 402 bp, Zea mays
  Clone ID: LIB3079-043-Q1-K2-A8
ggccgtcagctgctgacctatggacgaagaattcctacccccgagctttttgcaagaatagatgctgtggaggcaagcactgtgaagcgtgttgcaaaccgcttcatctttgatcaggatgttgctattgctgcgatggggccgatccaaggacttccagactacaactggttcagacgccggacctacatgctccgttactagattaatcagccggtgtacccatgtttaccgtctgcaaaagacaagataaaatttgcctcttttagcgtcagtatattaaggcctcagcactgcacattacgtgctgcgatggaggaattttttgagaatttgttttatttcttgtcgtgtccaaaatccacaaatctgtcaataatgataggcaagttcgactgacgt

SEQ ID NO: 74677 - DNA, 431 bp, Zea mays
  Clone ID: LIB3079-043-Q1-K2-A9
cgccttcctggcttcttcctccccagcacgcacacgcacacgcacacacccagccttttggctgcccgtggggccgtcagagagagaaaccgagctctaactaactgaagtggcggccacatagctagctactcttctgatcctgagcgcgcacgcgccatggctcaggaggacgtgcacctggacgacgcaggcctcgcgctgggcctgtccctcggcagcggcagcggcggcgcctctggtgcggcgcgccacggtggtatcagccgccggctgagcagggaggtgcggctgccgtcgccgcacccgctggagccgtcgctgacgctgagcttgccggacgaagcgaccgcgaccgggtccggcgggggcggggccgcgcacagcgtgtcgtctctgtcagtggccggcgtgaagagggagcgcgtgga

SEQ ID NO: 74678 - DNA, 491 bp, Zea mays
  unsure at all n locations
  Clone ID: LIB3079-043-Q1-K2-B1
gcggcgggatcacggcgccgccctgcccctcatcgcggaccaggcgaaacatgccgccgccggtggcatcgtgcggagcgggagcatgtggacggcagcggcacacgtgatcacggcggtgatcgggtccggcgtgctgtcgctggcgtggagcatcgcgcagctggggtgggtggccgggccggccgccatgctcgtcttcgcggccgtgacggcgctccagtccacgctcttcgccgactgctaccggtcgccggaccccgagcacgggcctcaccgcaaccgcacctacgccaaagccgtggaccgcaacctaggtagcaacagctcgtgggtgtgcatgcttctgcagcacacggccctgttcggctatggcatcgcctacaccatcacggcctncatcagctgcagggcgatccttgaggcgaactgctaccacgagcatgggcatgacgcgcactgcgactacgatggcaactactacatgctca

SEQ ID NO: 74679 - DNA, 429 bp, Zea mays
  unsure at all n locations
  Clone ID: LIB3079-043-Q1-K2-B10
atgcacagtcccggagaatattggtgaagcattaacttgatattgggttctagaccaaanaaggaatggattatgaatgatctgcgcgcatacnaaccaaaaangaacagttaaataagggtttttgagagttcagatgagatttcaacggatctttcttagtgtatctcacaagtttcagatanttctttcaaagaaaggagatactttaccatcgccttatctggaggtcccctagtcagttttttggggaaactttgtgaatctccatacaacaagacacttgatttgtccaaattgtacatcttctggtcttatgaacgttctttggcaaaaaaccattcatagagtaactatattttaacaaaaaaaggattcctctccaaggtacctattcttaatgtccatgtttactccataaattacaat

SEQ ID NO: 74680 - DNA, 328 bp, Zea mays
  unsure at all n locations
  Clone ID: LIB3079-043-Q1-K2-B12
cccacgcgtccggtcgctgtcgtggagcacagccgcaccgcactcacaccatttcaccatctctccngcggggcagatcctctacggtcgccagcctccccctcctgctgctgcctcctcgcttcaagcaacacccgaagcggcaacaaccaccaccaccaccaccaccggacctgcctgagcgaccccttggcttcccactccactgaagcagggcgagagagagtaaggaggaggaggagaagccatggcgagcgacggcgactgtaagggccgcgtcgctacggcgccgggggcaaggtacgggtacgcggcgtacggcggctac

SEQ ID NO: 74681 - DNA, 384 bp, Zea mays
  unsure at all n locations
  Clone ID: LIB3079-043-Q1-K2-B2
gcgcccacgcgtacgaaccctgccagcggccccccaactcctaacccaaccactactccagctagctcacggcncggcgcagctgccatggccttccggctgatcaacaacctgatcggngtcctaaacttcgtcaccttcctgctctccgtcccgatcctgggcgcgggcatctggctgggccaccgcgcctactgcacctagtgcgagcgctacctctcggcgcccgtcatctcgctgggggccttcctcctcgccgtcttcctggcgggcctcgtcggcgcctgctgcctcgtcacctggctgctctgggcctacctcctcgccatgttcgtcctcatcctcgtcctcttctgcttcaccgtcttcgccttcgtcggcacc

SEQ ID NO: 74682 - DNA, 349 bp, Zea mays
  unsure at all n locations
  Clone ID: LIB3079-043-Q1-K2-B3
ggcggccacaacatncgcccacgcgttcgccaacgcgtccgcccacgcgtccgcccacgcgttcgcccacgcgtccncggcattaaaacttattgttaaaaaaaaaaaaaaaaaaaaaaaaaaaaaaaaaaaaaaaaaaaaaaaaataaaaaaaaaaaaaaaaaaaaaaaaaaaaaaaaagggaaaaaagngggaaattttaagtggggggggtctttaaaaaaaaacaaaacattactatcctgtgtattcaaaataaaaattattttatggggtcatttaaataaaataaactgcccctcttttaaaaaagttgagaaataaaaaaaccttggcgtaaaaaaaataa

SEQ ID NO: 74683 - DNA, 309 bp, Zea mays
  unsure at all n locations
  Clone ID: LIB3079-043-Q1-K2-B4
gcgaggcccttcgcccagacactccagcagtcccgcgggtgtggcagcgagttccggttccccgaccaaccgacgncggctgctgctgaggcggatcccttcgcatccgctgcagcagcagctgacgatgatgacttatacagttaaattagcagtcctgtgttgtgacgcatattgagtactttgcttcgttatatgcttattatagtagactacaagcaagacgcggagtcgctgtacctatataatacttaagttaatattttggtacgatcctctgaatcgtgccatgagccatggtttgtgttc

SEQ ID NO: 74684 - DNA, 496 bp, Zea mays
  unsure at all n locations
  Clone ID: LIB3079-043-Q1-K2-B5
gcgagcgaggcgacnccnaggcacctcatctccggcgaagggaaatggcgaccgttccaggggatctgatctggcggatgtgatgaagagcgactccttcctggtgaagcagtttggcaacggcaatgccaaggtgcagttcaccaaggagcccaacaacctctacaatgtacactcctacaagtactctggcttatcaaacaagaaaactgtaacgatccagccagctgctggaaaggactcggctgtggtcctctctactaccaagaccaagaagcagaacacacccgcgaagctcagccacaagtctgtaatgcgcaaggagttccgcaagatggccaaggctgtgaaaaaccaggttggcgacaactattacaggcctgatctgaccaagtcggcccttggtaggctgagctctgtgtaccgcagcctccaggttgccaagtctggtgtcaagaagaagaacaggcagcctacgcactaagcctgtgttctg

SEQ ID NO: 74685 - DNA, 483 bp, Zea mays
  unsure at all n locations
  Clone ID: LIB3079-043-Q1-K2-B6
gtgcgttcttaccccataccttccatcaattatagcttcaatatgtgaaaacccagctcttcaaccatatangcttcagcaagcaatcgcagcaagcaacatacctttatcgcccttgttgtttcaacaatcgccagccctatctttggtgcagtcattggtacaaaccatcagggcgcaacagctgcagcaactcttgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatttagccagctagctgcagcaaaccgtgcttccttcttgacacagcaaca

SEQ ID NO: 74686 - DNA, 367 bp, Zea mays
  unsure at all n locations
  Clone ID: LIB3079-043-Q1-K2-B7
ccggtcgagccgcgcgtgcgttaatttgctgggtttgatgggaaacctgaagatgttctaaatacaaagaaaaaccatnctatacaacagtaccctttatcttcgtaccgaccagaatcaaattgcaatgttcaaaggtgttccctttactacatcagctggcccatgtatatcttcgattcacaacggaaatgttaagtgaccacctcattagacatggttgcatacattgacatcaaacttatgcatgctgtctgtgtaccattttgtcatacatcatgttttgcccatatttagcgttgcaaaatttgaacacagttacactatctgtaagcaattttctactaatggttggcccatagtttgc

SEQ ID NO: 74687 - DNA, 405 bp, Zea mays
  unsure at all n locations
  Clone ID: LIB3079-043-Q1-K2-B8
gcggctccggtacaggccatatcgcccttcacgccaccctcagcagtcgggacgtcgactgctgcttgatcccaganggggatttctacctggaagggaagggtggcctgttcgagttcctgtacgaacggatcaagaagaaggggcatgctgtcgtcgtggtcgccgaaggagctggccaggaactgattccccttactgacgatcagaagcgggagcaggacgagtccggcaacaccgtcttcctcgacgtaggaccctggctgaagtccgagctgggcagatggtggaagagggaacatcccgacgagcttttcacttgtaagtacattgaccctacgtacatgatccgagcggtccctgccaacgccagcgacaacttgtactgtactttgctggctcatt

SEQ ID NO: 74688 - DNA, 426 bp, Zea mays
  Clone ID: LIB3079-043-Q1-K2-B9
ggaaccattgattgatagttacttattattgggcatggagcacgtcatctcaatggaggagatcctgcggcccttctgggagctgctaccaccgccagcgccagagccagagccagagcgagagcagcctccggtaaccggcatcgtcgtcggcagtgtcatagacgttgctgctgctggtcacggtcatggtggcggcgacatgatggatcagcagcacgccacagagtggacctttgagaggttactggaagaggaggctctgacgacaagcacaccgccgccggtggtggtggtgccgaactcttgttgctcaggcgccctaaatgttgaccggccgccggtgatggaagaggcggtaatgatggcgcctgcggcggtgagtaatgccgcagtatgggaccccatggagtacaatgccatact

SEQ ID NO: 74689 - DNA, 419 bp, Zea mays
  Clone ID: LIB3079-043-Q1-K2-C1
cgctaccagcccgacagggcagttaacgtgtgcaggcaggggccaagatgatggcggaggcgtggacgccggtgccgttcccgccgacggcgccctgcttctggctgcacgacacgcactcggttttctggcggggaggagacgcgtggacggcggcggagaacaaactgttcgagaaggcgctggcgcagatcgaccgtaacgcgcccgacaggtgggagaaggtggcggaggtggtgcgcacgaagacggtcgacgacgtgaggaaccactaccacgacctggagaacgacgtcggcttcatcgaggccgggctcgtgccgttcccgcactacagcggctcggttccgtcgttcgggttcacccacgaggattgggacggagggttcaagcgcggctactgccttaagcgcgcgcgc

SEQ ID NO: 74690 - DNA, 281 bp, Zea mays
  unsure at all n locations
  Clone ID: LIB3079-043-Q1-K2-C10
tcctcccctgnttaacattaacaaacactatctatataaatccaagacaccttacctagctgctgcccccaaccttaaataattttctcctcctctctaacaaacaactatctttgtcttcgcttcctcccttcctgaatttactaataatatataacatccatttactgctaacaaccatttctcaatgacatcttcattactcctccttcttctactgctacctctccttttgaccttttaaaatactcttattattgcttctcaactctttcatttca

SEQ ID NO: 74691 - DNA, 78 bp, Zea mays
  unsure at all n locations
  Clone ID: LIB3079-043-Q1-K2-A5
gcggnnnaaaaaaaaaaaaaaaaaaaaaaaaaaaaaaaaaaagaaaaaaaaaaaaaaaaaaaaaaaaaaaaatcgcga

SEQ ID NO: 74692 - DNA, 363 bp, Zea mays
  unsure at all n locations
  Clone ID: LIB3079-043-Q1-K1-G5
ctgaaaatgaagatgatgaccacttatctataatgttctgatcagatttcatgattttgacaagagtcgactgaggaatgtntccaaagtgatcaaatttgggctacatatgatgatgaagatggaatgcctcgttattatgcatttattcagaaagttctttccttgaaaccattcaagctcagaataagctatctcacatcaagagcaaatagtgaatttgggcctttgaattgggtttcttctggcttcataaagaactgtggtgatttcaggattggtaaatatgaaagctgtgatatagtcaacatgttctctcaccagatgaaatgggataaagggccgcgcgggcttatcaaaatt

SEQ ID NO: 74693 - DNA, 95 bp, Zea mays
  Clone ID: LIB3079-043-Q1-K1-G6
caagcatcaccggcaggagctctgggcagcgtgcgcacgtggggtacctatctcgctctgctagcctacgatggctgatcaccaccggggtgcga

SEQ ID NO: 74694 - DNA, 413 bp, Zea mays
  Clone ID: LIB3079-043-Q1-K1-G7
cccacgcgtccgctcggcccaggtttaggtaagttccccttcttttttattattttttgctgttttgaatgtcaagttttgatttcaaattttaaatctgtgtttaagctctcaaattcaaacaaatgcagcaaacaaaaatataccagcatgagatgcaaatacctaatgttattagttaatttactatcctattttaagcaaatgcctttacacatgcaactcctacactaaaaaataggcatttttgagaaaaatgatctctagtatattaaaatccctaagagagagcttataaacatataattcaacaaacggatgactggactttatgtagagatcattttattttaatctgtattaggaacatgtttattttgggaaatgtaacttcagaagtatggagattcttt

SEQ ID NO: 74695 - DNA, 375 bp, Zea mays
  Clone ID: LIB3079-043-Q1-K1-G8
cccaagtgcgcttcacgcaaatgtcgatctgggttcttgaggactatgatacagaagcatggatcctaaagcacaatgtgagctcttcgcagttctttgaattactgagtcacccaatcaaagacttccatattgtggccattcatccagatcacaattcgttcatccttgttcagcactggaaccagaaactggtatcatataacatggatactcaggaactgcatggtctctgcactcttggaaagggctatgtgattattaccccatatgttccctgtttcttggagtcatcggttcttgccaccaaacactgaggttgttgtttctggggacttctctgcatgttcaacaagagcctgatcatccaagtgt

SEQ ID NO: 74696 - DNA, 354 bp, Zea mays
  Clone ID: LIB3079-043-Q1-K1-G9
caagcaacatagaaagtggaatccagtagcaacaacagagcaacaatggcgaccaagatattttccctccgtatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatc

SEQ ID NO: 74697 - DNA, 332 bp, Zea mays
  Clone ID: LIB3079-043-Q1-K1-H10
ccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcct

SEQ ID NO: 74698 - DNA, 265 bp, Zea mays
  Clone ID: LIB3079-043-Q1-K1-H11
cgtcgccaccacctctgactttacctcttctgactatcattccctagcgatgcatatactataaatctgctatgcaccccaggtatctgtgtatatacatcccatgcacccttcacataatgtcaacttagaaaccctgccctcggactctatttgtgctgtcttaatacatacggtatctttcagaactgccaaaaccagagcagccttgtgatgtctagaggagctctccgctcagtgacggcacatgagtgtgcactataga

SEQ ID NO: 74699 - DNA, 355 bp, Zea mays
  Clone ID: LIB3079-043-Q1-K1-H2
ctcctgcgcgcggtgtggtcgcgccagccgccgtggcaccgtcgcgtgcggtgggccggcggcggcggcgtgacaggcaggcgggacgagccgtcgtccgtcgtccgcggcgacgggcggcggtgcctgggcctgccgctcatccgcatgctccccgtcgtcaagttcactgccgcctcctgcgacgccggcgccggcgctggtggcgtggcgccgaggatatccgtgtcggagtgcgccgtgtgcctgatcgagttcgtggagcgcgagcgcgtccggctgttgcccaactgctcccacgccttccacatcgactgcatcgacacgtggctgcagggcagcgcgcggtgcccct

SEQ ID NO: 74700 - DNA, 357 bp, Zea mays
  unsure at all n locations
  Clone ID: LIB3079-043-Q1-K1-H6
cccccttttgaaaaccctcccaacctccggcggggggggcgggcttggcgaccgggtgtcttttccggcgagtctcccccctagtaacaaaaaaatatggatgtacctgttgatgaccctgtggagaacctcactggaagtcctagtccccttggcaatgaggaagaagccactacttatgctaatgtgcaagatcagtccaagggaagaaccaagaaagctttacgaggaacccaaagacccaatgcaagacgagttgtgtaaccaagggcatgtgagcatgaacaatgaagatgtgggaggccagaacaaagtggaccaagctacccncacagagcacggcgaggaagctggggt

SEQ ID NO: 74701 - DNA, 396 bp, Zea mays
  Clone ID: LIB3079-043-Q1-K1-H7
cccacgcgtccgcgagcctggaaggtgtgagggtactatattcttatctactgaattccaagttctgttgcccctgtcaattatggtattcaacaaagatggatagctgaaggtggtggctcagagattggtttttctttaattttggaggtaaatcatacgcattattgaggtcccagtaggttaaaagaatgaagttcctcgtctggggttgttccaaggccaacccaggtagaactgcaccccggcagcatcggtctcattgattgaagttctctgttttgttaattaacccctgttaagaaaaaaagaaggcgtgttcgccgtgtcggaattctttccttcctcccctagtgtttatttcaatatgatatcgatacctgatgtactactggt

SEQ ID NO: 74702 - DNA, 359 bp, Zea mays
  Clone ID: LIB3079-043-Q1-K1-H8
cccacgcgtccgcccacgcgtccgcttcgtagcgccggcgctccatcttccgctccctcccttagtggcgctcggcacgcgggtgacggcggcagtggcggcactcatgatcgggctctcagcgacggcatcagcggtttcccctcccgcttctctccagtcgcctcgcgccctcgcctccggtcctccgcacaccagccggtgaccctccatatagggtgtgagactaccaaaactcgaaaatgaacaagggaaagatttttaagctagccaagggattcagaggaagggcgaaaaattgcataaggatagcaagagagagggtggagaaggcgctgcaatattcatatagggatcga

SEQ ID NO: 74703 - DNA, 261 bp, Zea mays
  Clone ID: LIB3079-043-Q1-K1-H9
gatcacactcgtagagagaaggaaaaatatccccaaaccctagctcccgatctcgatggcgaaccctggcgtcttcttcgacatgaccgtcggcggcgccccggcgggccggatcgtgatggagctgtacgccaacgaggtgcccaagaccgcggagaacttccgcgcgctgtgcacgggcgaaaagggcgtgggcaagtccgggaagccgctccactacaagggctccaccttccaccgcgtcatccccgagttcatgtg

SEQ ID NO: 74704 - DNA, 447 bp, Zea mays
  unsure at all n locations
  Clone ID: LIB3079-043-Q1-K2-A1
cttgaggctgtcatccatctagagtcgatttttccatgcgaaaagcgtattgaatttttagactcacttgtggagaagtttgttacacctgaatcatctcanggagagttggcaagtctagttgacaaagaagaaatatcttccatatttttagagtttttggatctctttggtgatgcaaagtcaatcaggaaagcttcaactcggcatacaacttttttttcatgtaagagaagcattctgccatcaaagaaacggaaggctgatgatgctgttgtgtcagacagggacaagtttgctaaaactgggtctgttcagtcagccacaggaactgatccaaatgcttccaatccttctgtttggcctgcgacttctgaaacatctggacatcaatggggagcttcttatgctcagcaggctgcatatcctgcatatggaacttatgac

SEQ ID NO: 74705 - DNA, 327 bp, Zea mays
  Clone ID: LIB3079-043-Q1-K2-A10
cggacgcgtgggcggacgcgtgggttttggtggacttttactctccatgggccttattggatttctcttcgggaggagccctgcgagtcttacctttggcgttgcacctggccttgccatattggccctggctgtacttagcctcaatgtctggaggagcgggaagtccagcttaccgttcatactgtcgcaagcaggcattgccgctgccgtagcatggaagcacggccaggcgtacaccactacgaggaagctgcttccgtggggattctacgtcgcgctgagtgccgcaatgatctgcttctactcctacgttcttcttgccgg

SEQ ID NO: 74706 - DNA, 276 bp, Zea mays
  Clone ID: LIB3079-043-Q1-K2-A11
cccacgcgtccgaccgcaccaccgaccactgcctccgtacgcgtccctctggcggaaaatcggtcctagtgcggagctcgttttgtttggatcttctgtatatctattaaagaggcttctccatctcctcggaacagcaaagctgtgcagcaatggagaagtataacagcggcactcaatttgcaccattgagagagactccgtttgccctcccgggggctcttggtagttcaagctcatatcttgagcaagccaggggctacacatctttccctg

SEQ ID NO: 74707 - DNA, 413 bp, Zea mays
  unsure at all n locations
  Clone ID: LIB3079-043-Q1-K2-A12
cccacgcgtccgcgggaagcttccgactccatacggcgcacacgagcgctccctgcagatgacctcngctgtggtggagcgcgtaaccaacgacgaccggagcgtagcctcgttgcttgatccaacgctgggtggagaccacagggaagacgagctagcggtcatcggcgaggtgatccgggcctgcatgcanagcgacccgaggcgaaggccgagcatgagggaggtcgccgccaggctgagggaggccgtgggtatctcgccggtcgctgcgacgccgaggctgtctccgctctggtgggccgagctggaggtcctttccgccgcggaagcaagctaataatagtgggcgagaggacaggacaggaacagggcangatgatgtcgcgcaatctgaccagtttgttctcaag

SEQ ID NO: 74708 - DNA, 458 bp, Zea mays
  Clone ID: LIB3079-043-Q1-K2-A3
agcaactctccgaatgaagcaggatatgcaaaatgagaacaaaaatatgtctgacttaatagcatatagagtaagattcacccctcatccacatgctggtgataattggtgtatctatccgagctatgactatgctcattgcatggtggattctcttgaaaacatcacgcattcgctgtgcacacttgagtttgacatacgccgcccttcatactactggctacttgttgccttgggtctttatcaaccatatgtgtgggaatattcgaggctaaacatatcaaatactgtgatgtctaaaagaaagttgaatcgacttgtgacagagaactgggtagatgggtgggatgatccccgcttgttgacactggctggactccggcggcggggagtatcatcaaccgcaataaattcctttatccgtggaatcgggataacaagaagtgacaacagcttaa

SEQ ID NO: 74709 - DNA, 444 bp, Zea mays
  Clone ID: LIB3079-043-Q1-K2-A4
ggtgcggttcaatatcactgtacgactcttgtatggaagcaacagacagtgatcataaacctgtcaaatgtgtgttcgagttagatattgctcatgtggacaaacaaacaatgaggcagaagtatggagaaataatgggttcaaataaggaagtgcttgactcacttcagggcttggaggctttgcctgaagtagatatcagcacgaatgacatcattctgcaagatcaaaacccttttgttgtgaaactgcacaacagaagtacaaaagagttggcttgttttgagatcattggtcagacaccaaagtcatctggcacacctttctcaggtttcccttcttggctgaaggtttctccggcagtcggtataatttctcccagacaatctgttgaagtgacgttgcaacatggacaaatacgaagtcaagaatattttactggga

SEQ ID NO: 74710 - DNA, 333 bp, Zea mays
  unsure at all n locations
  Clone ID: LIB3079-043-Q1-K1-G4
tcgtcatcgctgctctgctgttcctcgtaatcccttgatcacctcaactccccatgacatatcttttcataaaccaaatcaacagatatgattgattntagttaaaacttggtttaccatgtattgagttacgtatagtgcgatagtatcacattcttttggcttgtgtctacagttccagtaggagttaggatagaacacaggatgagtccatagccctttttttgcacgttcataatgtactcataatgtacctggtgggtgtactgtgtacatattagatatgacttcaggatgtnatggatttataagataatngaataatgatgctcg

SEQ ID NO: 74711 - DNA, 411 bp, Zea mays
  Clone ID: LIB3079-050-Q1-K1-C6
ctccgaagccagtgctaatgtggttccatgatgatatatgattgtgtattggtaatggacccttataaggcgattacagttgctcaaaaagggaactttggaaaatgcattccgaataatttcaaatagtgcctataaaagccctttatcaatcattgactttttctaattatttcatttaatccttaattttccctttattaatatttttactttctatttttttttattttaccttatatatttcttttaaattttttttttatctattttttaatttatattttttttatattgttttatttttagtttttataatttatttttcttgttttttaattatttattttataatttttttatttattttttttattttattatatatcttttttatttttttttttttta

SEQ ID NO: 74712 - DNA, 443 bp, Zea mays
  Clone ID: LIB3079-050-Q1-K1-C7
tgcaaagcactggaaatccaatcgaggtagatatctgttgtaaacagcctcaaggactcgaactcacgctttatgttaccttttcatgatagctcactactgctattgctataataacactataatacttgataactaatataatcccattttcctgattaatttatactttaaatatcctccatgtattgtcatactttaactatcttcttcttttcatttataaatattattattttaattttttctcttttatttctttttaatattcttttttatcatttattttttttctttattttttatttttatttattttttttttttattttttttttttattatttattttttttttttttttttttttttttatttttttttttttttatttctttattatattttctttttatatattttatattaatttttataatttt

SEQ ID NO: 74713 - DNA, 147 bp, Zea mays
  Clone ID: LIB3079-050-Q1-K1-C8
tcttcctcttttgttgatgtcctcaaggatttaggcttcctccctagcatcaaagtttacgataacgccaaaaattttatttgcactccacatcacaccaccatccaataccattactaccttatcaaacattactccaaatactac

SEQ ID NO: 74714 - DNA, 198 bp, Zea mays
  unsure at all n locations
  Clone ID: LIB3079-050-Q1-K1-D10
gcgggagtgcntanagaggatcgtcgaacataacagcatgaagatggtcatcgttctcaacgggtcttggctctgtcagctgccaccccctctgcaatgcaaatgccctgcccctgcgcggggctgcagggcttgtacggcgctggcgccggcctgactactatgatgggcgccggcgggctgtacccctacgcggag

SEQ ID NO: 74715 - DNA, 238 bp, Zea mays
  Clone ID: LIB3079-050-Q1-K1-D3
ggcgtcggcaatcctgaccggatcaacaaatacgtagctaccccctcccgcgtgcgtctagttcgcctccgccgcctgctcgatccggtgggaattcgccgctgccgggttgttttcgctggggtgattaaggctcgggattcgagatctacgcgagtcgcgggcaagcagccatgagcgaggtgttcgagggctactagcggcagtactgcgaggccttcgtcttgctcttccgcaa

SEQ ID NO: 74716 - DNA, 173 bp, Zea mays
  Clone ID: LIB3079-050-Q1-K1-D4
taccgactagaccccctttctgattccgctgagccacgtgctgtccacgaatctgttcactctcctcaccgaggtccgcaagaactgcacctgctccttgcttatgccctactgcaagacccatgttactttttattacttatactaattcatttttttatttcctttttttt

SEQ ID NO: 74717 - DNA, 343 bp, Zea mays
  Clone ID: LIB3079-050-Q1-K1-D8
gcgcgcgtcgggtcaaaccctaagcagggagttgatttatccgctgcagccatgaggaagttggagtcttagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatattcctcgtcccaagatgaaagtgtgcatgcttggtgattcccagcatgtttaggaggccgagaagattggacttgactacattgatgttgaggctctcaagaaaatgaacaagaacaagaatc

SEQ ID NO: 74718 - DNA, 274 bp, Zea mays
  unsure at all n locations
  Clone ID: LIB3079-050-Q1-K1-E1
cgcggatgacatattgaaaaatgtggaatatgatgctctaagggttattttcaagaanttgcattctgtcatatcgtttaagcccacaatggtaacgatactgtcccctgaggttgcagaaaaagaagcagaagctggtgggaagacgggtgacctagattcttatgagattgaaggcggtgagacaaaagcagagatattgcaaaacctagctgagttccagttttcttgggtcatgtacaatggtgccctaaaaaatgcatgcagtgagctt

SEQ ID NO: 74719 - DNA, 321 bp, Zea mays
  unsure at all n locations
  Clone ID: LIB3079-050-Q1-K1-E10
caccgcancgggtgctaccagatgtgcctcacggactggaacctcagcaacctgcccacggggggcgtggtcgaccgcctgctcaaccagtggcngacgctncangcggccggccagaccgacgcgcacggcgcctacagcttcaccggctacctgggggagtacgtcctcactgtcagctacaacaacaggacgacgcaatccaccttctcgctgtcgccgggagacgagaccaggcacatcaacgttcaaatgtgatgcgccaacattatatttagggctcctcggatcggactacttattactagctgatgtagtgat

SEQ ID NO: 74720 - DNA, 197 bp, Zea mays
  unsure at all n locations
  Clone ID: LIB3079-050-Q1-K1-E11
gataagcgcttcatgaccaatgtgaagggagtctatgcaatcggggatgccatccctgggcccgtgcttgcccataaagctgaagaggatggtgtcncatgcgtagaattcattgctggaaaagaaggccatgttgactatggcacagttcctggtgtggtctatacacatccagaagttgcatctgttggcaagac

SEQ ID NO: 74721 - DNA, 209 bp, Zea mays
  Clone ID: LIB3079-050-Q1-K1-E5
gttgtgtcatgttgttgttgagatcacaaatgtaagcaaagttaaatatgaccttgaacaatgaaacggtactgattaaggttgatcgagtcctgtactcatcagttgtataccctcacaattatggtttcgttccaaggactctttgtgaagacaattacccaatggatgtgttagtcctgattcatgagcctgttgttcctggttcg

SEQ ID NO: 74722 - DNA, 221 bp, Zea mays
  Clone ID: LIB3079-050-Q1-K1-E8
ttttaatagctatctaggattcattatcttccacggcataaaataatagcccacgttaaattaaaaaaaaaaaaaaacaaaaccaaaaaaaaaaaaaaaaaaaaaaaaaaaaaaaaaaaaaaaaaaacaaaaaaaaaaaaaccaaaaaaaaaaaacacaaacatacaactacaaaactctacctacactttcaccaaaataaaaataacaaacaatcattt

SEQ ID NO: 74723 - DNA, 233 bp, Zea mays
  Clone ID: LIB3079-050-Q1-K1-F1
tcttcctaaagaaaaaaaaaaaaaaaaaaaataaaaattaaaaaaaaaaaaaaaaaaaaaaaggaaaaagttaaattttaaactcatacataccacaccctaacaacttctataactttactataaattaatttaaattcacttcactttacaacttcttaaactcttaaaacacttaaaaaaacctaacttaatcccaattcaatcacatttccactaaatccatctttctt

SEQ ID NO: 74724 - DNA, 517 bp, Zea mays
  unsure at all n locations
  Clone ID: LIB3079-050-Q1-K1-F11
aaaaaaaaaaaaaaaacaaaattaattttaacnccaacaaaaaaaaaaaaaacccgcagggatgtntatatataatannacccaaccaanaaccaannnnnnnaaaanaaaaaatataaaatataattatccacaataataataaaataatataaaattcctaaaataaactaataaatattattaaataaaataataaataaacaataaaaataaaaaaaataaaaaaaaaaataataacattaaaataaaaatataaaataaaacaaaataaatatataaattaaatatatatataaatactaaactaaaaaaatatataataaaacaaattataatatataaaaataaataaaaaattaatataataaaaattataaaacaaataaaaataaataaaataaaataaaaatactaatttaatatataatataataaatataaaatataatacaataaaaataaataataaaaaataaaatatacataaaaaaaatatactaattaatcatttata

SEQ ID NO: 74725 - DNA, 235 bp, Zea mays
  Clone ID: LIB3079-050-Q1-K1-F4
ttccctatcgaccactcgtcctcccactcgtaccaaaaactaaaataccatttctaatatttaaacacaacttaaaaaacaactagaaaatgtataaatataaacctctccatacctctaaacacacaccttacttcaaacacataccataaatatcatcctcctactaataactcacactttacttacattcaaactctaccatttaatttatcaaaatttttccaacataatc

SEQ ID NO: 74726 - DNA, 320 bp, Zea mays
  Clone ID: LIB3079-050-Q1-K1-F6
ctttgatcaacgagcatgggatacccgtactcatggagtcaatatgccgatcttgcaaatggtctgttaggacatgtggaagggtcatgggaatgaccattggtgcaatgcttgaagaaatccaaactctctaccaacaacacaaacagtcttgttttctttacttgtccagtgaagttatcaagatttttggatctgatccatcttgtgcgggctatcttactaacttgatacaaatacttttcagccatacagtgcaacttcttagaacgattcaagattttactgccagaccagatatagctgattattgctatttg

SEQ ID NO: 74727 - DNA, 181 bp, Zea mays
  Clone ID: LIB3079-050-Q1-K1-F8
aaaaacaaaaaaacaaacaaaaaaaaatcaaatccctaccaacaaacaaacacactaaaaacacacaaaccaaaaaaaaaacaaaacaacccaaacaaacaaccaaacaaacataaaaaaaacaaaacaaaaaaaaaaaaaaccaacaaaacaaaaacccaaaaaaaaaaaacacaacaac

SEQ ID NO: 74728 - DNA, 121 bp, Zea mays
  unsure at all n locations
  Clone ID: LIB3079-050-Q1-K1-G10
attactantaaaaaattatttctctaaattcccttcaatccttattcaataaaaaccccaatcttttttatactcnatcaaattttaaaattctttttttttcacaccaaattntcatttt

SEQ ID NO: 74729 - DNA, 399 bp, Zea mays
  Clone ID: LIB3079-050-Q1-K1-C5
ctcgcgccctccccgtccggccgtcccacccacgctttctccccctccgcgccgctcctacgggctcgaaccatggcggtcgccaccgagtcgcgcggcagcgaggacagggcttcagcccatgcgaaccaggagaagcggtgggtgctgtctgatttcgaggttgggaaacctcttgggaggggcaagtttggccatgtttatcttgccagagaaaaaaggagtagtgagattgtggctttgaaagttcttttcaagagccagctcaagcaatcacaggttgagcatcagctgcgacgtgaagtggagattcagagtcatcttcgtcatcctaatattcttcgcctgtatgggtacttctatgatcagaccagggtttacctaatcctggaatacgct

SEQ ID NO: 74730 - DNA, 375 bp, Zea mays
  Clone ID: LIB3079-050-Q1-K1-G11
cccgcgcttcctgcaccattggcatgcagatgaagctgggttcagatatttggatgcgagggaagatacctgatggttacagtgaaatgttatcgggatatcaaccacctaatgaaggtgcacggaattcgcagggtttctgttctttacctgatcagattgccgctggacgtcctaatttctggcacactgtaaactctcattaccaagaccagcaaggcaatcacaatctgttccctggttcatgggccatgatgccttcaagtactggctttgggatgaacagacagagctatccaatgatccaggaagtcggtgggatgtctcaaagttgtacaaacactcaagttgggaatgagtttatgctcactacct

SEQ ID NO: 74731 - DNA, 244 bp, Zea mays
  Clone ID: LIB3079-050-Q1-K1-G3
tcttcctgctgcctcccttttttttttttttttttattttttttattttttttattattttgtaaatgttaaatttaaaatttactttttctaacccttaaaataaattataataataaaaatttttacattaaaaaaaaatactttacaaaataaaaaaatactccatattttaaaaaatttcaaacactttttataaattactttaaaaaatccaattttaaaaaaaatataaatactattt

SEQ ID NO: 74732 - DNA, 428 bp, Zea mays
  unsure at all n locations
  Clone ID: LIB3079-050-Q1-K1-G5
cccagcgcgtccgcacccggtacgccttgtgctcctacaaccccgagtacgttgacgagtctgtgctggggacagagagccgcgacgtcgggcacggcttccgctgcgtgcgcatggtgaacaacatctacctcaacatggacgccttccacggcgacaaggaccacggcggcgtccacgacggcaccaccgtcgtcctctgggagtgggccaagggcgacaaccagcgctggaagatcctgccctggtgaacgtgaacagagacgagctagatgaatccaaggaaccttacctagctgctgccgccggcgcctaattcgtcctcctncgctctagctgttatctgtctgtgtcttcgcgtcctcggtttcctgaatggacgaattatatatagcatgcatgtacggctagcgaccatgtctgaatga

SEQ ID NO: 74733 - DNA, 192 bp, Zea mays
  Clone ID: LIB3079-050-Q1-K1-G7
tcttactctttactccttgttttttacttaccccgagtacttttactaatccgtacttgttaattttaaccttacctctcccaccccttcctcttctttctcattgttaacaacatctacctcaacatttactcctatcacttcgactattaccactttctcttccactacttcaccaccttctttctcttt

SEQ ID NO: 74734 - DNA, 318 bp, Zea mays
  unsure at all n locations
  Clone ID: LIB3079-049-Q1-K1-G9
ctcatctttggtcataacaaactcttctacgttctcttaaggcgagcaatccagccgccgtgcagatggccttaatatcagcgcccgagaactcatctttggtcataacaaactcttccaagttcacatcgtcagctaatgtcatttttgatgtgtgaatctggaagatgcgtcttctagttttaatatctgggagagggaattcaatcttccggtctatacggcctggccgaagcaaagcaggatcaagactttcaatgcngcttgttgctagaataactttaacatctccacgcgagtcaaaaccatctagctgat

SEQ ID NO: 74735 - DNA, 329 bp, Zea mays
  Clone ID: LIB3079-049-Q1-K1-H1
gaagaagcgaaagtatgagcttggtctcctgtcagccaacaccaagttgtcaagcagtaagacagttaggagggtccgcgttcgtggaggtaatgtgaaatggagggctcttcgcctagatactggtaactactcatggcgaagtgtagctggcaccagaatgacccgtatgcttaacgtggtctacaatgcgtcaaacattgatcttgtgaggacacatacccttgtgatgagtgccattgcgcaagtagatactccgccattcaagcagtggtacctcactcactctggagctgacattggtacgaagaagaaaacccctgctgcaa

SEQ ID NO: 74736 - DNA, 358 bp, Zea mays
  Clone ID: LIB3079-049-Q1-K1-H10
tgcgcccactcgtcacgcgtccgctttatgatcgctggtcatctgtggatgatatagggtccctctctggggtatatcaaatgttggagtcagataccgccaaaggagtttggtactttaggcaatctttgcttcttctcagattaaactgtcctgaggcggcaatgaggagtttgcaccttgctcgtgagcatgctgcgagtgatcatgaaaggcttgtctatgaaggatggatattgtatgatactggccactgcaaggaaggattgccgaaggctgaagcatccattgcaatacaaaggtcatttgaggcattttttctgaaagctaatgctttggctgattctagtcttgatcc

SEQ ID NO: 74737 - DNA, 174 bp, Zea mays
  Clone ID: LIB3079-049-Q1-K1-H11
ctcacgcgtacgttacaccatcgacataggtcagaacgacgtgtctgcttacatgcgccggggctacgagcaagtgcttgccaagatccctggatttggtgctcagatcaagtgcaccatcgacacactgtactcgcacggggcccgtaagttctggatccacagcaccggcgc

SEQ ID NO: 74738 - DNA, 382 bp, Zea mays
  Clone ID: LIB3079-049-Q1-K1-H3
caactctctcgagtcgattcctaagcagctagccagtgactcgatcttagcgtgctgcaatggcggcagctgctagtgccctgctcctcctgctctgctcagccttctgctcccttgcccaccgggcggccggcgtcgactacggctcgtggcagagcgcccacgccacgttctacggcggcggcgacgcgtctggcacgatgggcggcgcgtgcggctacgggaacatgtacagcacggggtacggcaccaacacggcggcgctgagcacggcgctgttcaacgacggcgccgcgtgcgggtcctgctacgagctgcgctgcgacaacaacgggcagtcgtgcctgccgggcaccatcaccgtcacggccaccaacttttg

SEQ ID NO: 74739 - DNA, 65 bp, Zea mays
  Clone ID: LIB3079-049-Q1-K1-H4
ccggctctacccactcgtccgtcaaactaaaattggtttattgtctccaagactcactcttatca

SEQ ID NO: 74740 - DNA, 371 bp, Zea mays
  Clone ID: LIB3079-049-Q1-K1-H5
cccacgcgtccgcacataggctctggttctctggcgctaatgttcgagcaaggcgctgctcctgttgctgtagaagggattttttgaccaaccctccaaccggtgcggcttcgatctttcctctcctatcacctgaatccctcgagtattcatcgccggcgcagcgcggtctcttcccttcgctggagaagggggaaggggacacgaacggagcagaaggccatggacacgatgcggggcgcgcttgagcgggccaagatgctggtgggcatggaggtcgacgaggagtccgcgttgccaccgtccgaggagcagtcctttttcgactacatcaatcggcacttcaccctcaacaccactcagaggctcta

SEQ ID NO: 74741 - DNA, 408 bp, Zea mays
  Clone ID: LIB3079-049-Q1-K1-H6
cgtgcggtgtttatagaatttagttgattttatttgcatggagagacttggtaatgacggcaggttttcaggtgatgccaaacccttgatcttgtctgcgaaaattggcatttgtgtttcccatggccaagacgatacgattccaaagctaacagatgctgctgcacagaagtaggctagttcctttttgtacctcaatacttttgatatggaaaatcatatacagttcagttggtctgcttaacattcgatttcactcgctccaaacgaaaaatgcgatccaatggtcgtgcgatttctgtgtaaaacttgtacacgtttgactgttctaaacaatccattttttattaaattttaatcacttttatatttctctttgtttttttattatcttttctttaataaaaa

SEQ ID NO: 74742 - DNA, 236 bp, Zea mays
  Clone ID: LIB3079-049-Q1-K1-H7
cccacgcgtccgtgccagtgaccatgggacctcaagcttccctgtatctgcagtgcgtaggattggcatccttgacattagaatcttcaacactgacaggcatgctggaaatcttctggtcaagaagcttggtcctggcgccgacaattttggagagcagacagaactcattcctattgaccatggtctctgtcttccagaatgcctagaagacccatacttcgagtggatccact

SEQ ID NO: 74743 - DNA, 355 bp, Zea mays
  Clone ID: LIB3079-049-Q1-K1-H8
ccacgcgtccggtcaaacttaaaattggtttattgtgctccaaggtgtcactcttgtgagtagagggagaacacggtaatattgcaccatgttggagttattttgtgtggttgaacttgaaaaacaattcttcaaaacatggataacccatactttattgcaatggtgtgacatgagtacatgacatgacatgacatgctaaggcagaaaattatgttgcagcagtggtatatgtgtggttgcagcttggtaggtaaaattttatgtcatgtgtcagccgaatcatgaaaatatggctatgtttagtcatgtactcctattgctcttttaatttggtattaaaatatgaattttc

SEQ ID NO: 74744 - DNA, 426 bp, Zea mays
  Clone ID: LIB3079-049-Q1-K1-H9
gggttttgctgctctccgaccccgagctccgaaggccgcagcatcaggcgcggcccgcctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatacgctggatttcaccacttactgtggtgagagcaaggtctactgttgggataccgcagggcaagagaagattggtggcctcagggatggagactctatacatgggcactgtgcgatcaccatgtgtgaggtgacctcaaggcgtacttacacgagatgtgcctacacggcatatggacctgtgcacggtgtgtgaaaac

SEQ ID NO: 74745 - DNA, 74 bp, Zea mays
  Clone ID: LIB3079-050-Q1-K1-A2
taaagaaaaaaaaaaaaaaaaaaaaaaaaaataaaaaaacaaccaatctaaaaaatgcaaacgtacattctcaa

SEQ ID NO: 74746 - DNA, 377 bp, Zea mays
  Clone ID: LIB3079-050-Q1-K1-A4
cccacgcgtccgcccacgcgtccgagagaaaaggctttgatgctgagttatcaaggtgcggaagacttggctagagcgtttactgagcgtacgatcctccaaatatttttggaggatgagatgaatgttccttctggttccctaaaggaggtactgggcttgctgagatctctatatgtcatggtgaacatagatgaatccacatcttttctaagatacgggcatttatcacgtgacaatgtaacccttgtgccgaaagaagtcctgaaactgtgcagtgaacttaagccccatgcgcttgctggtggtaggtctttcggaatacctgatgcctttcttagtccacttgcttttgactggattgaggcaaatgcact

SEQ ID NO: 74747 - DNA, 112 bp, Zea mays
  Clone ID: LIB3079-050-Q1-K1-A5
tcctgcccctggctcatgccttattttaagtctccaggttacagtcgagtacctcaataaggggtattgttataatttttcattcgccttcacaccctcctcatcttcaccc

SEQ ID NO: 74748 - DNA, 70 bp, Zea mays
  Clone ID: LIB3079-050-Q1-K1-B1
agtgttcatcgatgttttagactacacatttgtatattttgtcgagagcatcagtttctggtacactacc

SEQ ID NO: 74749 - DNA, 190 bp, Zea mays
  unsure at all n locations
  Clone ID: LIB3079-050-Q1-K1-B3
cccacgcgtccgcccacgcgtcctcccacgcgtccggatgaagagtatcaaaaagatccagaagatcacaaaggctatgaagatggttgcagcatcaaagcttncggctgttcagacgaagactgaaaattcacgcggcttgtggcagccgttcaaccgcctttctggggacactccctaatgtgacgtc

SEQ ID NO: 74750 - DNA, 52 bp, Zea mays
  Clone ID: LIB3079-050-Q1-K1-B4
tcccacacatccggtataccactatccgttttttaatttgagtcgtcttgtg

SEQ ID NO: 74751 - DNA, 61 bp, Zea mays
  Clone ID: LIB3079-050-Q1-K1-B5
gtcctcaatgatagcatggaatccagtgcttctgttataatctcatctggtccatcatata

SEQ ID NO: 74752 - DNA, 109 bp, Zea mays
  Clone ID: LIB3079-050-Q1-K1-B8
cggatatctcggctctcgcatccattaagaacgtagcaaaatgagataccagtgcttaatgtgtactataaaaccacgggccccaacccctcaagtatcctcaaaagtc

SEQ ID NO: 74753 - DNA, 370 bp, Zea mays
  Clone ID: LIB3079-049-Q1-K1-G7
agtccaagatctgaactccctcaaattctcgcaaccgggcccctaatcccttccgaagccaatctcccatctccgatccaatgccccctaccggcgacgacccgtcggccgccgccggcatctcattccccgatgcgggtggcggtggcgattctgaagacggcgacttcgccggctcccacctcctcgaccccaccgatccgggccttcccaaccccaccaccttctccgctaccggcctgccccacgcgatccctgcggccggtagcggcggcggcccggtcaccttcggcaacggcggtgagcggctgcccctgttccagcgcctttggaccgaggagggcgagatcgtgatccttcgcggcttttc

SEQ ID NO: 74754 - DNA, 244 bp, Zea mays
  unsure at all n locations
  Clone ID: LIB3079-050-Q1-K1-B9
cgggcgcgtggnctnactcgtgggttcgagtcagtcagtcagttgcgtgccatgncatggtctgatctgatatatgatnatnctcatnccnncntcntntcctcccctggcctcctggggcgcttctggcgagcagtgtgttgtgttgtgtgggtgccgcacgctagcaggctagccatgtgccctgctgtgttgtgtcaccatccatctataatcttatccataccccaccttttgtgtgatg

SEQ ID NO: 74755 - DNA, 458 bp, Zea mays
  Clone ID: LIB3079-050-Q1-K1-C1
gcaggctcgctgaaagcagtaggcaacaatatccggatattgtgtcttcaagtgtcaacggcagtttctagtggatcagctagcgagccaaagaagcgggcgtccgaggaaaggactagcaccctgaagaagtccaagcaagagggctctaaaccatctcctttcaagcagcaacaagtgcctaaagtgaatatcggatagaatatcacagcattgcaacagaacgaatctcctttttggaagacttattcagtgtcagttcttgttttaacctttaatttctttaatttttgtattttataatttttgttcttaatttttcttacttaatttttacttttttctatttttttactattttttattttttttttctttattctttattttttatcctttattaatcttatttatttttttattatattatttatttttttatttatattttttttatt

SEQ ID NO: 74756 - DNA, 173 bp, Zea mays
  unsure at all n locations
  Clone ID: LIB3079-050-Q1-K1-C10
aaacaaacaaaatcatcaacnactaaattccaaaaccccccaaacactcacccgccggtttatataaatatttaaccaaaccaccccacacaatacnnannncttattccaacaaaaaccaaaacaacttccatctaaaattacaccaacaaataaaacaaactcaactatca

SEQ ID NO: 74757 - DNA, 239 bp, Zea mays
  unsure at all n locations
  Clone ID: LIB3079-050-Q1-K1-C3
cagaggagtgctgctgctggactaaggcctattggagcagtggtcttcatgcagcgntgggtcctgaatgtttgcttgaggactactgacagtacagttaatacatcatagattgcaaaagcatattgcgggagtggaaaacgaaattcgagttcattcactctaaaaatggatgagttcaacatctggactttagtgaactcatgaattgaactgtataggtcacatagtgttcatac

SEQ ID NO: 74758 - DNA, 327 bp, Zea mays
  Clone ID: LIB3079-050-Q1-K1-C4
ttcaggcctccgaaaaaaaattaccaacctaccctctcttctcctccgctcctctactacgtgctctgtccatttcttactccacctacccactcctcatccattacaggtcttcatcccattctaaccatgataatctttttattctttcttatttctattttattaaacctctttttatattcaattttatccatttttatctttccatataaaaaactattttttaaattttatcttttaaaattcttttcaatatccatctcaatcaatcacaattttaacatcatcttctactttaattttatattcatattcatcttcttt

SEQ ID NO: 74759 - DNA, 154 bp, Zea mays
  Clone ID: LIB3079-049-Q1-K1-E3
cttaattcccgcctccagccacgcgtccggttgcgtgctccccccaccttctcctcttgtacctgccctcggtttctgatcagcgaacgttttaacccgcggcgtctccctgctgctcctcgcggcggtgctcctcctccaggccctcctcctc

SEQ ID NO: 74760 - DNA, 169 bp, Zea mays
  Clone ID: LIB3079-049-Q1-K1-E6
cgcacgcgtccgcgtcactcaacacatcacaggcagctcgagagagagagagagacgaagatgtcgtggttcgggcaccaccaccacaaccagccggctcccccggcgtcgggccccaaccaggtgttcaagatcttctgccgcgccaacgagaactactgcctggccg

SEQ ID NO: 74761 - DNA, 283 bp, Zea mays
  Clone ID: LIB3079-049-Q1-K1-E7
gaaagagttgagattgagatttgctctaacaccagtgatttagatgctattaagaaggctataacatcaggtttcttccatcactctgcacggttgcagagggatggtacatataagactgtcaagaaccctcagaccgtgcatatccatcctagttcaggattagcggaggtacgtccgcggtgggtagtgtaccacgaattagttctcacgacgaaagagtttatgcgccaggtgacggaactgaaacctgaatggctggtagagatagcaccacattatt

SEQ ID NO: 74762 - DNA, 353 bp, Zea mays
  Clone ID: LIB3079-049-Q1-K1-E8
gctctctctgtctccctccctctctgtcggggacaattcggctaccgctgcggcccgactccaggttcccagctcttcgccaggcccttctccggcgacgagcacccaccaggccaccagttgacacttaatactacctgaatctaatgcttatcaatatgcctaatatttgctggcggagctttactttgtgcaacacatattctccatctaatcaactacaaggaggttgtactcaaagaatggatttatggattacttcttgctcacaagcagcgagacatcatgcaaggataggttcagttgattttcctgttaagaagaacgtggagtcattccaagtgcaaaacgcg

SEQ ID NO: 74763 - DNA, 104 bp, Zea mays
  Clone ID: LIB3079-049-Q1-K1-E9
ctccgccacctcccttactgtctggtatgatgttatcagacatgatcaaccttgtgggcattacttcataacacccatatctatctttacttaacagcaatcac

SEQ ID NO: 74764 - DNA, 421 bp, Zea mays
  Clone ID: LIB3079-049-Q1-K1-F1
gggaagcctatctaccactttgttggtacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttatcggtttattagcctttggtttttcctgttcatatgtttcatcagtattgtttgctctttttgtctatttttaatatattttcgttttttttattttttctttatttttgtgcgttgttctttttattcatttattttattattattttttataattcttatttttatctttttatttattttttttttttttatttttttttttttctttgctatttttctcttttt

SEQ ID NO: 74765 - DNA, 226 bp, Zea mays
  Clone ID: LIB3079-049-Q1-K1-F10
cccacgcgtccgcaccctttcatcagcctgtctgtccactgttggcttggtgacttcctgcgctcgcgctccgctcccctccgctcccgaacggtcgatctttgcatggcagcagcagctggctccaaggggcgggcgatcgctggaagcttcgtcagccgcgtcctcgccggcaaggccgtctcgccgaggaaggccgtgcacgcctcggcgtacgacaagaacc

SEQ ID NO: 74766 - DNA, 399 bp, Zea mays
  Clone ID: LIB3079-049-Q1-K1-F11
acgagatagagctgctagaggctagagcagtttagctagaagaggaggacaacaacgatgggtgcagcggcggcggcggcggcgaggggagatacgaagaagaagaagatgcttgccaccctggtgggctgcaactacgccggcacgccgtacgagctgcagggctgcatcaacgacgtccacgccatgcgcgccgtcctgctcgcccgcttcggcttcacgcctgccgacgtcaccgtgctcaccgacgaccagcacgggcgcggcggcggcagcagcgtgctcccgaccggagcagccgtcaagcgcgcgctggatgacatggtggcgcacgcggcgcccggggacgtgctcttctttcacttcagcggccactgcacgctcgttccgaccgtcggc

SEQ ID NO: 74767 - DNA, 441 bp, Zea mays
  Clone ID: LIB3079-049-Q1-K1-F2
ggttattccaaaattgtgataaaagattactctctacgtgttgtatatttggactggggatgtctcggactcatgagaaaccaccgagactgctactgcaccgcggtgccctgacgtgttgctaacacgtgctaggtgactgagaatagttgggtattgcgttattttttttaatatgttctgaacatgagaatgccctagtatttcattaggatgtgtacattttacaatgttttatggacaattactgttgtatttttacttttgaactccagagccctgttttggtcacgcactatagtgttcacctaaactctttttcgaacgtttactaattaatttttttttcattttttttttttttatgtttttttttttctttttttatttttattttttttattgtttatttttttttttttttttttttattttattttt

SEQ ID NO: 74768 - DNA, 376 bp, Zea mays
  Clone ID: LIB3079-049-Q1-K1-F3
ctgatggcggtgatgaagagcagcactatcgtcgcgcttctattggctgttgccatgctggcctcactgtctccatgctacgaagccggcggctgcatcgggaaacccaagaagtcaccgccgccgccgagaaggccatacttctcgtcctattccgaggaccaccagaactgccgcttgatctgtagctccaagggtttcaaggacggtggctggtgtgacgaaagcgtggagcacaaagtgtgctgctgctcccattagaaatataatagcgtatgttatgttgatgcatatatatatgcatcgtccatctacctgtgtggtgcaaaattctgaataaaatctggcttttttccggataaaaaaataatttttt

SEQ ID NO: 74769 - DNA, 334 bp, Zea mays
  Clone ID: LIB3079-049-Q1-K1-F4
ggagatcccgcctggccccaggctcctcatacttgatcacattaaaagagatccatggtggacaaaagcaaattaagtgatcggcactgcggcactgcctcacggtgccagttcttttccccctcgagttgcagaaattggaccaggagaaccgtttaatttagctattcagtgacgacctctttggagcagtatttggttgtgcttactagtatatgttttctagtcatcattcacgcttttttttgagccgaagtgtttgcaaatcactctgatcttggaatgacagaattttgtattcccaaaggtttatgctgatcaatccagattttac

SEQ ID NO: 74770 - DNA, 270 bp, Zea mays
  Clone ID: LIB3079-049-Q1-K1-F5
ccggttgtatctggaaacccaataagtcacccgccgctccgataatgccatacttctcgtcctatacagaggaccaccataactgccgcttgatctgaatctccaagggtttcaaggactgttgatgatgtgaccaaagcctctagcacaaagcgtgctgctgctcccatttaaaatatactatcctacggtaccttgaatcatatatatattcgagcgactaactacatgtactgtagcacaaatcttaaataaaattggctttttttc

SEQ ID NO: 74771 - DNA, 214 bp, Zea mays
  Clone ID: LIB3079-049-Q1-K1-F7
cgcacgcgtccgccgtcttctcttctttctaccccaagcgcaacgcccgtgactcgctttccctgtgcttgcccctctccccatcgggtttgcggtgttcatggtccatctggccacgatccccatcaccggcaccggcatcaacccagtcaggagcttgggcgctgctgtcatcgacaacaacgaccaggcctgtgatgaccactggatcttc

SEQ ID NO: 74772 - DNA, 205 bp, Zea mays
  Clone ID: LIB3079-049-Q1-K1-F8
gtctcccagatctatctgttccccgactcacgaatcccaaagcctgctgtcgactcaccgccactgcctcccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggc

SEQ ID NO: 74773 - DNA, 429 bp, Zea mays
  Clone ID: LIB3079-049-Q1-K1-F9
cccacgcgttcgcccacgcgtccgcccacgttttcgcccacgcgtccgcccacgcgtgcggggagtggtggggccaatccaggtgttgttccagctgcaggatctggtgcccttgatgccttgcgacagcttccacagtttcaagcactgcttcagttggtccaggctaatcctcaaatcttgcagccaatgcttcaagaactaggcaaacaaaacccacaaatcctgcgtttgattcatgaaaatcaagctgagtttgtccgcttggtgaacgaaactcctgaaggtggtcctggaagaaacatattaggtcaactggcagctgctatgccgcaatcggtgacagttaccccagaggaacgagaggccatccagcggcttgagggaatgggcttcaaccattagcttgtgctagaagttttctttgca

SEQ ID NO: 74774 - DNA, 232 bp, Zea mays
  Clone ID: LIB3079-049-Q1-K1-G10
gatgctattatgtgatttcatatgattcagaagcattacaataactgcctacatgagctgtcaggactatactaatgcttaagaaacagcctacatcttatgtctactaaagtacagcgagctgcaatactataaggctgcaccaattactaactttaaagatggtcaacgtgtttcaaagagatcagagtgaaccaaaataggagatcgcagctactaaaatgctatgact

SEQ ID NO: 74775 - DNA, 426 bp, Zea mays
  Clone ID: LIB3079-049-Q1-K1-G11
gccgtttgggattaagccaagagccaggatctgattccatgggtgcatcatctagaaagtgagtcccaagccaggcttctctgctttgaggtgactgctattgcaaaattagcaacatgccacagtgagctgcttccgagggcacgcgtgtcattgggtaaggtcgctcgttcccgaacctcagacaagagggtctggcaacgggcctgtgactatatagggctcatgaatgaaccagacatctgtttatctgtactgggaccgttcaccgtcccaagaaaatggccccggattttgaatttgaattaaagagggaccaaaattggaacttaaggtcccttttaacctttaaaccaaccaaaagggtcacccgcttataaattttcaatttgccaacttcttccaaccgaatggagaaaatatttt

SEQ ID NO: 74776 - DNA, 139 bp, Zea mays
  Clone ID: LIB3079-049-Q1-K1-G12
ctctggtgcaactcatctttccagatccatttttttcctactcccttcacatctcatcagcttggcttccatcaggaccctccccacctaccgacacacctatatcaaacacacccatacccacttgccaattctaaat

SEQ ID NO: 74777 - DNA, 427 bp, Zea mays
  Clone ID: LIB3079-049-Q1-K1-E11
aatacaccttcggatagtactacagctgttttctcgagacaagtggtgtattaaacggtcgaaatgttcatttgcacaacaacaaatcagctatttggctcacattatcagtgcccgtggtgtagctactgatcccgaaaggtgtcagccatcgctaattggccttgtcctcaaatagtgaaggaactacgcagctttctttgattggctggctactaccgcaaatttgtccgtaacttcgaagtcatatcaaaactttgactcttctgctcaagaaacattcagtgtttgtgtggacgtcagtacatgatcatgcttttaacgtgctgaaacagtccttgtgcttggcgcatgtgttgaaattgcccaactttggacatgcattttcaggtgaaattgacgcagcaacaactggaatgggtgcaat

SEQ ID NO: 74778 - DNA, 372 bp, Zea mays
  unsure at all n locations
  Clone ID: LIB3079-049-Q1-K1-G3
cgcacgcgtccgctcacagcctcagcttgcggcgtcggcgtgcgcggccggngatagcgcggtctaccagaggtcctcctccttcggggacgatgtcatcactgcctacaggaccccaatatgcaaggccaagcgaggaggcttcaaggacacctacctagaggacctcctcactgttgttctcaaggttcccttcccttcaaggtcaaccgccagtgttcatctaggctacaggcagtagccgatgtcgtagctgctataaaggttggttactatgacataggtacatagtatctgaatatacatgctactttcgctcttgtgctttagtttggctgctgaatcgctgctcttccggtttgttcggttagc

SEQ ID NO: 74779 - DNA, 223 bp, Zea mays
  Clone ID: LIB3079-049-Q1-K1-G4
ccacctccacccacgcatcctaaaaaaaaaaaaaaaaaaaaaaaaaataaataaaaaaaaaaaaaacaaaaacaaaacgaacgaattaaaaaaacaaaaaacacaacaccaacaacaaaaacaaaaaacaccaaacacaccaactactcacaaccccacctataccttcatcatcaccaacattaactacaccctcatcttcactccctaccacttcaacctc

SEQ ID NO: 74780 - DNA, 292 bp, Zea mays
  Clone ID: LIB3079-049-Q1-K1-G6
agaacgtcaaccagtacccgttcatgtgccatgacctcctgcggcaaccagccgctcgaccgcgacggcaagggatgcggctcctgctacaagatcaggtgctccaagcacgccgcctgctccggccgcaccgagaccgtcgtcatcaccgacatgaactacaccccgggcgtcgcgccctaccacttcgacctcagcggcaccgtcttcggcaggctggccaagcccggccgcaacgacgacctgcgccgcgccggcatcatcgacatccagttcgccagggtaccctgcg

SEQ ID NO: 74781 - DNA, 353 bp, Zea mays
  Clone ID: LIB3079-043-Q1-K1-E6
aaactgtgcattgctgtctcaactctcaactcatctttgagatctagagaatgtaactgattctgcagactattttacatacaaagtagcccacctcgcacgggttctctatttcataacctttgttctttgcttctggaacttgggcgcaccacaatgctcctgcgtataaatccgtcatcttcataagcggttgtaaactctgaaccagctctttatatatctccatcagggccaaatcctcttatggttcaacctgttccatttccaggaaggtctgtccaaatgggtactttgttttctagtctgggttcacaaggatctgttctacatccgagagatgtttatatcca

SEQ ID NO: 74782 - DNA, 67 bp, Zea mays
  Clone ID: LIB3079-043-Q1-K1-E7
aaaaaaaaaaaaaaaaaaaaaaaaaaaaaaaaaaaattttaaaaaaaaaaaaaaaaaaaaaaaaaaa

SEQ ID NO: 74783 - DNA, 375 bp, Zea mays
  Clone ID: LIB3079-043-Q1-K1-F1
tcccggtcgaccgcgcgtccgcaatcctctgcaccacctggaagacgcataaaaactcttttggacagaagaagaagaagctgttttgagggagagggatggcaaaattcactccacagaataatgcgcaaattccatggattctgatactagaacatggccgtggtgtgtttcacaggacgcgcctgccatctgatttgagggtcaagtggaggagcatgcagaggaagaagtgggcaggctactgatcttacacgcccccgcgcacgtagctgttgtgtctcatgctaaattactaaccataccttcatttctctgtgtccatctgcagatctgatgccgttgacatggaacactgacgtggtacttgtacat

SEQ ID NO: 74784 - DNA, 304 bp, Zea mays
  unsure at all n locations
  Clone ID: LIB3079-043-Q1-K1-F10
gctgttccggcttgacataaccggacttcctcacctggttgctctagtatgatgtggagcgtctagttaaaaaaaatcagtntagtatgaagcaccgtgctgctctgaatattaacaggcaattaaggcaaggtgctgtttcggtttggtggaccgcatgttgcagataataaattagttgttttgtcatttgcgtctctatcgactttgctagtttgcttcttttggccaccgcccaactagtcgctttcaagagataaattaaatagaaacaaaaatgtaattatgctacaaattcacctct

SEQ ID NO: 74785 - DNA, 413 bp, Zea mays
  unsure at all n locations
  Clone ID: LIB3079-043-Q1-K1-F11
cggacgcgtgggctagccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttnctcattctagt

SEQ ID NO: 74786 - DNA, 72 bp, Zea mays
  Clone ID: LIB3079-043-Q1-K1-F12
aaaaaaaaaacaaatagcaaacaaaaaaaaaaaaaaaaaaaaaaaaaaagaacaaaaaataaaaaagagggg

SEQ ID NO: 74787 - DNA, 370 bp, Zea mays
  Clone ID: LIB3079-043-Q1-K1-F2
gcgccaccagggaacgttgcaggaaaccacacctgggttggtgccccccagcggcccccggacctgcgtgtgacgcctggacgccacgtccagctgacggttccgctggagcagctgatagaccggctggtgaaggagaacagggtggtggccttcatcaaaggatcaaggagcgctccccagtgcgggttctcgcagagggtggtgggtatcctggaagcgcacgccgcggatttcgtgaccgtggatgtgctcgacgaggagcacaaccacgggctgagagaaaccctcaaggcttacagcagctggccgacgttccctcaggtcttcgtcggaggggagctcgtgggaggctgcgatatcatttcgt

SEQ ID NO: 74788 - DNA, 332 bp, Zea mays
  Clone ID: LIB3079-043-Q1-K1-F3
cggacgcgtgggctttcctcaacctgctcatgggcacgctcaagatcgtcgccgactactaccccggccgggtgcaccgcgccttcgtcatcgacgcgccctccctcttctccgtcctctggaagggagtgaggccgttcgtggagctggcgccggcgacggcggtggtgtgctccctggacttcgaggactcactggaggacgcctccttcacggcgtacccgcggaccgcgtccctgcggttcgagccgccgccggcggcggtcacggtgaaggccggcgtggggtcagcctcgtcgcggttctccgtcacccccaccgacaaccccgtc

SEQ ID NO: 74789 - DNA, 449 bp, Zea mays
  Clone ID: LIB3079-043-Q1-K1-F4
gcggcctgctgcctttgtagctgcaaattaaattgagctgtacctgttggtcttcctcctcgctcttcttggttcgcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgatgcactcactcccagaacaagatcatcagctccaggagaacatcaaggtccatggcatcaacggcactttgcacgatgatcatcagtactgcggccatttggatcagctcggttcttcttcgtcgtca

SEQ ID NO: 74790 - DNA, 379 bp, Zea mays
  unsure at all n locations
  Clone ID: LIB3079-043-Q1-K1-F5
aaattaaattnacctgtacctnttnntcttcctcctcnctcttcttaagcagacttttttacaaaatcttgcacccaaancacttctnttgttctcacttctaaacttcttcttatacctttcatatataatgtcttcttcccaaatctcgccttcatatcatgttttctatttgcactgcatcttcttcaacacatttctcacttttaatttcccctttaatatcattctcaacatctttacagtttcttttttacacttctcatatctactttcattgaacctgatatcacttattcactcactcccataacaatatcatcatctccaatataacatcaatttccatttcatcatcttcactttcacgattatcatc

SEQ ID NO: 74791 - DNA, 454 bp, Zea mays
  unsure at all n locations
  Clone ID: LIB3079-043-Q1-K1-F6
gcatagatctcgtgctcgccactattattctgcacagcaacgcatcatccttctggaaccatctcgccggcgcgcaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgccgccgtcgcggcgtcgtcgcccttcgccgcggctctcgtcgcctccgccgccgccttcctcttcgccgccgtccgccactgagccgatggggcctcgtgcctgcaggctacctagcagtacnttccccgccgncgccgncgncgnctagatctatntattggagtgctatccagtagtactagtagtagtgagattttgtcggtgctgtcgtgtcctcgtcgcattttggtcggatc

SEQ ID NO: 74792 - DNA, 209 bp, Zea mays
  Clone ID: LIB3079-043-Q1-K1-F7
atcttgtgaccctccctcagccgcgtcgcgtcgcatcctacgatccaaagctctctctggtcgcaggtcgcagccatggcgaagaactacccgaccgtgagcgccgagtacagcgaggctgtggacaaggccaggcgcaagctccgagccctattggccaaaaaaagctgggcccggttaatgctcggcttggggtggaactccggggg

SEQ ID NO: 74793 - DNA, 421 bp, Zea mays
  Clone ID: LIB3079-043-Q1-K1-F8
cccacgcgtccggcgccgccgccgcgtctcctcctgtacaggtaaggagaggaagagggcgaaatggtgaggcacatcaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagccttgctccaaccattggtatttctgttgatcaccggcgcaagaacaaatcccttgagggactgcaggccaatgtccagaggcttaagacatac

SEQ ID NO: 74794 - DNA, 405 bp, Zea mays
  Clone ID: LIB3079-043-Q1-K1-F9
gatgccatatatggatccgccctcaacatccgcaaggatctcgatgcccaaatcctctccaggttccggaggccccctggtgctttgccgtcatctctgcttggatacgaggcactgacaggttccctggatgattttggatttgaagattatcttaacatgcctcatgattctgacagtttccgtcaacctgacatgcaccatggaatggaggttcgccttggtttgtccaagggacctatctgtcctagcttcaattgaggcagtaatgtaattctgctgcaagttcacctctcagtccagtacttcagtcaatagaccatattaagatggtgaaatatgaaaactggtagcttgcatctgttcaatgttatgttttaatcaacgctgaatttaatatttgtc

SEQ ID NO: 74795 - DNA, 301 bp, Zea mays
  Clone ID: LIB3079-043-Q1-K1-G10
aaaaaaaaataaaaaaaaaaaaaaaaaaaaaaaaaaataaaaaaaagtcaaacactataaaaaaataggaagttaattattcatacatacaacatacataactcttatataaaaaaacctaaaataaaaattcgctggccctctttttacaacctaattactgtaaaaaccctgtcaataccaaacttattctttttgcaccccataattcatttcactacctctcgttataaaaaataggcccttaaaaaaccttcttcccaacaaatttacagcctttatggaaaatcccactttccct

SEQ ID NO: 74796 - DNA, 305 bp, Zea mays
  Clone ID: LIB3079-043-Q1-K1-G11
gtttctctctcgaaatcggccgtctctctcccgtccggcacttcctccgatcgactagcctgcggcggcgccggcgccggcgaccagcggccatgcgggtggcacccagggtgctcttcctcgtccgcgacgccgcgggctacggcgctgccctcgccgacgcgctccgtccgccgcccgggctaactagggagtcctcgcccttcgagctcccccttggaaagtacggcctcgacggagagaaggcgtgcgccgagctcctgagcttttccgattccagtggctctccacaggtgaccattttt

SEQ ID NO: 74797 - DNA, 210 bp, Zea mays
  Clone ID: LIB3079-043-Q1-K1-G12
ggcttctcctccccctccggttcgggttcgggttcgtgaggttctccggagttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggag

SEQ ID NO: 74798 - DNA, 134 bp, Zea mays
  Clone ID: LIB3079-043-Q1-K1-G2
attcttgttgctgctaacatggatatatatcttattgtgtctgctaacatataaatcacatattttcccaatactgtttgcatctcgaaccagattgttcaatatcccaactcgacacatacgtcatattcggc

SEQ ID NO: 74799 - DNA, 432 bp, Zea mays
  unsure at all n locations
  Clone ID: LIB3079-043-Q1-K1-G3
ctccccagtcccactcccacccgcaggccgcgccgccccagcaaatctcacgcacagaaacaccaaagccggagaggcccaaactcaccacctcccaatggagaacggcgacgaaaccctcgcctcccccacggccgccgccgagacggacgcgctcaacggcggcgtcgcggaggaggagcaggtccccatcacccaccccgcaaagtcctacgtcacgctcgccgacgacaaccccgctcctaacggcggcgtcgtgaaagaggaggagggcggtgcccacaccaccgcgaagtcctacgcagctgtcgccgcccaagccgagatcgaggacctncgcgccgccaagctcgacctggaggagaagctcgctgaggcccgccgtgagaacaagtccctcgccgaggagacgcaccgcagcgaggggatctt

SEQ ID NO: 74800 - DNA, 464 bp, Zea mays
  Clone ID: LIB3079-043-Q1-K1-E5
gaacaggctggtgcattgctgtctcaactctcaactcagctgggagatctagagaatgtaactgattctgcaagacgaagggacattcaaagtagtgcagttcgcacgggttctctatttcagaaccttggttctttgcttctggaacttgggcgcaccacaatgctcctgcgtataaatccgtcatcttcagaagcggttgtaaactctggaccagctctttatatatctccatcagggccaaatcctcttatggttcaacctgttccatttccaggaaggtctgtccaaatgggtactttgttttctagtctgggttcacaaggatctgttctacatccgagagatgttgatatccatgtccgcacaagtgggtccgtgcctggagccagtactaacccaagtgattcagctggtgcgcaagcgcatcaaaatgtgaataggccaggagatgcttcgcatgc

SEQ ID NO: 74801 - DNA, 468 bp, Zea mays
  Clone ID: LIB3079-043-Q1-K1-C8
gttttcatgcagaaaggaatgaagaaagctctgataccttattttgagctcacaaatgctgtcagggggggggaccttgaactgttcagggctgttgcagacaaatttgcaagcacattcagcgcagacaggactcgtaatttgattgtgaggctgcgccataatgtcattcgaactggactgcgcaacatcagcatttcttactcaaggatctcccttgctgacattgctaagaagctaagactagactctgagaaccctattgctgatgcggagagcattgtagccaaggccataagagatggcgccattgacgccaccatagatcatgcaaatggctggatggtatccaaggaaactggtgatgtctactcaacaaatgagccacaaattgcattcaactccaggattgcgttctgcctcaacatgcacaatgaggcggtcaaagccatgagattcccccctaat

SEQ ID NO: 74802 - DNA, 348 bp, Zea mays
  Clone ID: LIB3079-043-Q1-K1-C9
ccatgacaggattatcatgcagagtttctttgataggaaaaaaccaaaaatgaatctcaagaaaaaggtgagggaacttagtcagtcacgtgcagtgaaggctattcaaggcagatttcaaacaccacgtagcaaagtcatttggcagacagctattgcttttgtcttgcttggagtgcttacccttgctttccctaccgaagaagggccaaccctccaggtggccatctcttgtgcagcaaatatctatttcatttatcagagggtcaaaagtggatggcgagcattcttttatgggtttggttctttctttgcttcctggttccttggcaccttcttgatggtatc

SEQ ID NO: 74803 - DNA, 499 bp, Zea mays
  unsure at all n locations
  Clone ID: LIB3079-043-Q1-K1-D1
ccacttctcacctcaatctcgcgagaagcgaatccggaggaggagggtgcgaggagatcgcgagcagccggagccggagccggagccggaggcctagtatatgaagacgttcgatccgtggccggtcttcttccgccgggagtggaagcgcaattggcccttcctcacggggttcgccatcaccggcttcatcatcactaagatgacggccaacttcaccgaggaggacctcaagaactccaagttcgtccaggagcacaagaagcgctgaccaaccagtaatctatgacatggacgccggatggcactggcagagggatggtgtacggtgttgtccgaattgcctgtctggacagccagttatgttatgctgtttgaatgaaaaattagcttctttttcttcatctaaatgcgtgcagcctatgctccatctgtaatgtaataagaggcaactgactngatccaaaagctaccaacctctgattatgaatgatacntc

SEQ ID NO: 74804 - DNA, 73 bp, Zea mays
  Clone ID: LIB3079-043-Q1-K1-D10
tcccctgcatctgccccgccgagcggatcccgcccgcctgtcatgtgagtctaatatcccgttctcacacgcc

SEQ ID NO: 74805 - DNA, 415 bp, Zea mays
  Clone ID: LIB3079-043-Q1-K1-D11
gcattccaaggtctgacagtgagatctccaaagacgataccccagctacagcaccgcttaacaaggggcaggtgctacgtacttcacccagaccactaaaaggcagtgaagccataggctattcatcttcggattgtcctcagcaccaatccagtcattttcgcaacgtttaccgcaaagaccgctaccttgggcaccagttctgtgatccagttgaactggcatcgacgcctgagttatcaagcatcagtggtgcgaagacagagacgtctattggtgcatcagtgaggacaagctcatctcctgaagaggtcgatggatcgggcgaactttcagcctctgtcagcaacgcaagtgacgaagagagggaatgggtagaagaggacgagcctggcgtgtatattactattcgagc

SEQ ID NO: 74806 - DNA, 347 bp, Zea mays
  Clone ID: LIB3079-043-Q1-K1-D12
gttcgacccgtccaagaggatcagcgtcaccgaggcgctggagcacccgtacatgtctccgctctatgaggcgagcgcgaaccctcccgcgcaggtgccgatcgacctcgacatcgacgagaacctcggcgtcgacatgatcagggagatgatgtggcaggagatgatccactaccaccccgaggtcctcacgagaatcagcatgtgagtatgtgatgtgaccagacaggcagcaatgaaacatgtggacagaggtctgctgcgccaggatcatcacatgttcgcccttcttacgagcttaactgcgattacggcaccgagtcgaggtatcactacatgtatcggaa

SEQ ID NO: 74807 - DNA, 388 bp, Zea mays
  Clone ID: LIB3079-043-Q1-K1-D2
cgcactccctccgctgcacccctttccattctaccgccggcgacgccaaagttcttgggcctcctcatcggcgacttttccgccggcgacaggaaacaacgaaccaaaccacttctctgtcgagaggcgtcgcgctcctctcttcgccctctgctgttatttttcttaacccggctttctctcgattgctgcgtaaagttgaagatgaggaagctcaagttccatgagcagaagctcctcaagaggcacaatttcttggagtacaagagggagggcggccaccgcgaggcgctcgtcacacagcgctaccgcctcgtggagagggacgactacaagaagtacaatgggatatgcttaatggtgcaaaagctcgttaacatcataaagc

SEQ ID NO: 74808 - DNA, 131 bp, Zea mays
  Clone ID: LIB3079-043-Q1-K1-D5
gccggcccgctagctattcaccatcgctagctactacacctctcctatcctatgttctcagttaactttctgtcagacagtagttttgttttccttcgtgtaatcccctagatatatatatttccatttct

SEQ ID NO: 74809 - DNA, 491 bp, Zea mays
  unsure at all n locations
  Clone ID: LIB3079-043-Q1-K1-D6
gccgacgtctacagccctggggctgggaggatcacacgcctcaccagccacaagttccccgtcctcaacgtcgtgcagatgatcgcggtgcgggtagacctgtaccaggacgccatcatgtcgccgttctggaacttcaacgcccacagcgccatgtacggcatcaggggcagtgcaagggtccaggtcgccagcgacaacgggaccacggtgttcgacgacgtgctccgtgcggtgcagctgctcatcgtaccccagggctacctcgtcgccaccaaggcgcagggagaaggcttccagtacatcgccttcgagacgaaccctgacaccatggtcagccacgtcgccgggaagaactccgtcctgagcgacttgccggccgncgtcatcgccagctcgtatgccatctccatggaggaagctgcagagctcaagaacggtatgaagcatgagctggctgtgcttactcctgctggcagtggcagctacca

SEQ ID NO: 74810 - DNA, 335 bp, Zea mays
  Clone ID: LIB3079-043-Q1-K1-D7
tctgtatgcattttgcccatagacttggcttgctgcactggggaagacgacaatggtgaccgacagggaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgtttaaaaaaacaaaagttaactaacccttgaatcaaagtaaaaacttttttaaaagggcaacaaaaataaaataaatggcccgcgtttaaaaaacttggaaactgaaaaaacccggggttaacaaaattaaatcgctttgaaaaaaatccccttttcc

SEQ ID NO: 74811 - DNA, 353 bp, Zea mays
  unsure at all n locations
  Clone ID: LIB3079-043-Q1-K1-D8
gtttgcttggtggcttgggtaattatgttatggccttggcagagcaacaggaaaaaaaaggggcctgagggtaaggtcatgataattattttgtatctaccatagtagttgtttgatatcgacgcctctctctctctctctctctctctctctctctctctgttattactttatatttttgttactgtcctttcatttgaatctataggatggtcaaagtggctgatgaaagaggagaaagaaacaaaacagttggtttcttgttacttgtaagtggttaaactgaaatacaaatggatgtaagattgaatganaaaaaaacaantacaanaaatacaaaanaatataattaa

SEQ ID NO: 74812 - DNA, 402 bp, Zea mays
  Clone ID: LIB3079-043-Q1-K1-D9
agtgaatcacatgcggcagactgtgaatcttgtatccaatgaacgccaaaagctgttggatagagcggcggctgcagagaaaagattccaaaaaggatggaatacactcagggaagaagggcgttccattcaacacgagttgcgtgagattagtgatattgaaaaccaagcagtaggtctgaagggaattcttgatcagcttcccagagcacatgcatctgaatttcggtcgaagatgtctggcctagcttctcaggttaagaaggagaagcgagtgctcaacgccgccctcacgaagattgtgaactacggtgtccccatctgactgccactccagccagttgttctgaaggtccattgtattgtatcaaatttttgtgaaagaagacatgttcgatgtgt

SEQ ID NO: 74813 - DNA, 206 bp, Zea mays
  Clone ID: LIB3079-043-Q1-K1-E1
cccacgcgtccggaggcgccagggtcaggaaagatgatgtgcgtttactctttattggttgattgaggagtgggggcatgctaatcgactaacaaatccttgacttcgtcgattcattaacctatgaatgtatctgggaactgatgactgaaaaatattgcatgaaaatacatggtggtcaaacagaatttgaaccatgtttccat

SEQ ID NO: 74814 - DNA, 316 bp, Zea mays
  unsure at all n locations
  Clone ID: LIB3079-043-Q1-K1-E10
ctatgtctagatcgcgagccggccgcccttttttttttttttttttttttttttttttttttttttgggtttttttttatattttttttttttttttttttttttttttttttttttttttttaaaaaaaaccanaaaataatttattttaagggttcccctattggggtaaaaaaagccaaattattatatcagtttaacaaaaaaaccccttctcctttctttattttttaaacacctccacaatttaaaaaaccttttccaaataaccggcccccaatccactttggtaaaacaaaaaaataaatcttttttt

SEQ ID NO: 74815 - DNA, 382 bp, Zea mays
  Clone ID: LIB3079-043-Q1-K1-E11
cccacgcgtccggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccattcccgcggcggccgtggaggcggcggcggtgggt

SEQ ID NO: 74816 - DNA, 236 bp, Zea mays
  Clone ID: LIB3079-043-Q1-K1-E12
aaaattaaaaaaaaccccacattttttttttttttccaatacaacaaaaaaaaaaaagtctaatactttttcttcactcactccacaacttttttatttttttctttaagaaccccaaaaccaaaatcatcctcgatcggtaaacgcaaaaatttttttttttttagttcgggaccttaatacacacaccattttatttttttccccctcgcccgcataaaaaaaaaaaaacaaaa

SEQ ID NO: 74817 - DNA, 84 bp, Zea mays
  Clone ID: LIB3079-043-Q1-K1-E2
aaaaaaaaaaaaaaaaaaaaaaaaaaaaaaaaaaaaaaaatttttaaaaaaaaaaaaaaaaaaaaaaaaaaaggggggtttttt

SEQ ID NO: 74818 - DNA, 247 bp, Zea mays
  Clone ID: LIB3079-043-Q1-K1-E3
ttcattttgtcattcacatagattcttattttacctccacgattacacgctgttttctggtgatgagtgggaggtgggggctagcctccaggtaaagatactttctgaacagaatatggttgctgaagctattgatagctgtacagttatggccgcttgggatggtgtgccatctggagttttgtgctaacatgcatgtgatttgacgctgcaatgtgtactagcaacagacttggttttcttggtt

SEQ ID NO: 74819 - DNA, 423 bp, Zea mays
  Clone ID: LIB3079-043-Q1-K1-E4
gtttggagggagttgatcgagagaaaaccagaagcaaagaaatggatgatgaagacgattgaccattatgatagcttaatggatctatttggtaagaatagggagaaacgtcaagacgttgagaactcaaaaggtacctcgaagaaaaaggcgcgaacagaaccgccaaaggagatacttcaacgtactccattaaatcggaaggggtcagctcttgccgaaagttcagataagacggtggacaaatgtgagatccatgatgagataaaaacaaatgtggaacttgatttgtcagaatcgtgcagaactgataatggcattgttgccatacctgttcgtgcctattcatacggtaaaggtttgccctatgctcctgaaaattggccacgtcatggagacatatggcactggaaaagtggaagc

SEQ ID NO: 74820 - DNA, 374 bp, Zea mays
  Clone ID: LIB3079-043-Q1-K1-C7
gtggcctgctttccttttgatgatcataactgccccccgatacaacttgtcatatcattctgccagagtgcgctactcatggttgaaggaggatatagaaaatgtggtggttgtccattgcaaagctggtaaggcaaggacaggattgatgatctcgagtcttctactatttctaaagttctttcctactgctgaggagtccattgaatactataaccagaaaagatgtgtagatggaaaagggctgattctaccaagtcagattagatatgtgaagtattttgagcgcatcttaacttacttcaatggtgaaaatcagccacccaggaggtgtatgcttagggggtttcgtcttcatagatgcccctattgga

SEQ ID NO: 74821 - DNA, 382 bp, Zea mays
  Clone ID: LIB3079-043-Q1-K1-A8
gaccgtcatctgctgacctatggacgaagaattcctacccccgagctttttgcaagaatagatgcggttgatgcaagcactgtgaagcgtgttgcaaaccgcttcatctttgatcaggatgttgctattgctgcgatggggccgatccaaggacttccagactacaactggttcagacgccggacctacatgctccgttactagattaatcagccggtgtacccatgtttaccgtctgcaaaagacaagataaaatttgcctcttttagcgtcagtatattaaggcctcagcactgcacattacgtgctgcgatggaggaattttttgagaatttgttttatttcttgtcgtgtccaaaatccacaaatctgtcaataatga

SEQ ID NO: 74822 - DNA, 332 bp, Zea mays
  Clone ID: LIB3079-043-Q1-K1-A9
cgccttcctggcttcttcctccccagcacgcacacgcacacgcacacacccagccttttggctgcggtggcgccgtcagagagagaaaccgagctctaactaactgaagtggcggccacatagctagctactcttctgatcctgagcgcgcacgcgccatggctcaggaggacgtgcacctggacgacgcaggcctcgcgctgggcctgtccctcggcagcggcagcggcggcgcctctggtgcggcgcgccacggtggtatcagccgccggctgagcatggaggtgcggctgccgtcgccgcacccgctggagccgtcgctgacgctgagc

SEQ ID NO: 74823 - DNA, 179 bp, Zea mays
  Clone ID: LIB3079-043-Q1-K1-B1
ctgctgacatcccactgggtggtggcggccggcgctgctctttccgcggacggctcagtcacctttgcgctgtacgtcgcgacccacacgcctacgaccgactcccaagcggccgacctagagacactcggggggctctttgacacacgcctgtcgtatgatcgctcacatacgctcat

SEQ ID NO: 74824 - DNA, 281 bp, Zea mays
  unsure at all n locations
  Clone ID: LIB3079-043-Q1-K1-B10
tccttattcccggtcgaccgcgcgtctcttaactaatgcacattcccggagaatattggtgaagcaataacttgatattgggttctaaaccaaagaaagaantggttataaaatcatctgccacatacnanccaaaaaagaacaatgaaataaaggtttttgaaaattcaaattaaatttcaacggatctttcttaatatatctcacaaatttcagtattttctttcaaaaaaaagggatacttttccatccccttatcttgaggtcccctaatcaatttt

SEQ ID NO: 74825 - DNA, 258 bp, Zea mays
  Clone ID: LIB3079-043-Q1-K1-B12
cccacgcgtccggtcgctgtcgtggagcacagccgcaccgcactcacaccatttcaccatctctccgcgggagcagatcctctccgctcgccagcctccccctcctgctgctgcctcctcgcttcaagcaacacccgaagcggcaacaaccaccaccaccaccaccaccggacctggctgagcgaccccttggcttcccactccactgaagcaaggcgagagagagtaaagaagaggaggagaagccatggcgagcga

SEQ ID NO: 74826 - DNA, 392 bp, Zea mays
  Clone ID: LIB3079-043-Q1-K1-B2
accgaggggtcggcccacgcttccgaaccctgcaagtggccccccaactcctaacccaacccctactcaacctagctcgcggggggggccatctgccatggccttccgcctgatcaacaacctgatcggggtcctaaacttcgtcaccttcctgctctccgtcccgatcctgtgcgcgggcatctggctgggccaccgcgcctacggcacctagtgctagcgctacctctcggcgcccgtcatctcgctggtggccttcctcctcgccgtcttcctggcggtcctcgtcggcgcctgctgccgcgtcacctggctgctctgggcctacctcctcgccatgttcgtcctcatcctcgtcctcttctgcttcaccgtcttcgccttcatcgtca

SEQ ID NO: 74827 - DNA, 304 bp, Zea mays
  unsure at all n locations
  Clone ID: LIB3079-043-Q1-K1-B3
cccacgcgtccgcccactcgtacgcccacgcgtacgcccacgcgtacgcccacgcgtncgcccacgcgtgcncggcattaaaacttattgttgaaaaaaaaaaacaaaacaaaaaaaaaaaaaaaacaaaaacaccaaaaaaaaaaaaaaaaacaatcctggacacaaaacaaaaaggctaaaccaccacgcactactataccgggcgcgaactcaaaaaaatccaaacctacaatcgcgctgatggcaaatcatactttttgtatgggtcgcctaaaattaaatcacctgccccccttttaaa

SEQ ID NO: 74828 - DNA, 294 bp, Zea mays
  Clone ID: LIB3079-043-Q1-K1-B5
atcgaggcgacgccgatgcacctcatctccggcgaagggaaatggcgaccgttccaggggatctgatctggcggattgtgaggaagaacaactccttcctggtgaagcagtttggcaacggcaatgccaaggtgcagttcaccaatgagcccaacaacctctacaatgtacactcctacaagtactctggcttagcaaacaagaaaactgtaacgatccagccagctgctggaaaggactcggctgtggtcctctctactaccaagaccaagaagcagaacacacccgcgaagc

SEQ ID NO: 74829 - DNA, 430 bp, Zea mays
  Clone ID: LIB3079-043-Q1-K1-B6
ttcttcccccataccttccatcaattatagcttcaatatgtgaaaacccagctcttcaaccatataggctgcaggaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacactgaaccctgctgcttatttgcagcaacaactattaccatttagccagctagctactgcctactctcagcaacaacaacttcttccatttaaccaattggccgcactgaaccccgctgcttatttgcagcagcaaatactactaccatt

SEQ ID NO: 74830 - DNA, 350 bp, Zea mays
  Clone ID: LIB3079-043-Q1-K1-B7
tttcatttgctgggtttgatgggaagcctgaagatgttctaaatccaaagaaaaagcagctggacgagaggaccccgcatcttcgtaccgacgagaatggaattgcaatgttcaaaggtgttccctttactacatcagctggcccatgtagatcttcgattcacaacggaaatgttaagtgagcagctcattagacatggttgcatagattgacatcaaacttatgcaggctgtctgtgtaccattttgtcatacatcatgttttgcccatatttagcgttgcaaaatttgaacagagttacactatctgtaagcaattttctactaatggttggcccagagtttgcttt

SEQ ID NO: 74831 - DNA, 387 bp, Zea mays
  unsure at all n locations
  Clone ID: LIB3079-043-Q1-K1-B8
gtacatgccatatctcccttcacgccaccctcagcagtctggacgtcgactgctgcttgatcccaganagaaatttctacctggaaggcaagggtggcctgttcgagttcctgtacgaacggatcaagaataaggggcatgctgtcttcatggtctccaaacgaactggccatgaactgattccccctactgaccatcagaagcgtgagcaggactagtcctgcaacaccgtcttcctctacctatgacccttgctgaagtcctagctgatcatatggtggaagaggtaacatcccgactacgctatcactgtgaagttcattgaccctacgtacatgatcctatccttccctgcgaacgccagcgacaacttgtactgcacttttc

SEQ ID NO: 74832 - DNA, 278 bp, Zea mays
  Clone ID: LIB3079-043-Q1-K1-B9
ggaaccattgattgatagttacttattattgggcatggagcacgtcatctcaatggaggagatcctctgacccttctgggagctgctaccaccgccagcgccagatccagagccagagcgagagcagcctccggtaaccggcatcgtcgtcggcagtgtcatagacgttgctgctgctggtcacggtcatggtggcggcgacatgatggatcagcagcacgccacagagtggacctttgagaggttactggaagaggaagctctgacgacaagcacac

SEQ ID NO: 74833 - DNA, 353 bp, Zea mays
  Clone ID: LIB3079-043-Q1-K1-C1
caggcagctcacgtgtgcaggcagcggccaagatgatggcggatgcgtggacgccggtgcgcgttcccgccgacggcgccctgcttctggctgcacgacacgcactcggttttctggcggtgaggagacgcgtggacggcggcggagaacaaactgttcgagaaggcgctggcgcatatcgaccgtaacgcgcccgacaggtgggagaaggtggcggaggtggtgcgcacgaagacggtcgacgacgtgaggaaccactaccacgacctggagaacgacgtcggcttcatcgaggccgggctcgtgccgttcccgcactacagcggctcggttccgtcgttcgggttcaccca

SEQ ID NO: 74834 - DNA, 180 bp, Zea mays
  Clone ID: LIB3079-043-Q1-K1-C10
cgcgtccaaaaaaaaaaaaaaaaaaaaaaaaaaaaaaaaaataaaaaaaaaaaaaggcctgccactcaaaaaaaaaccaagcttacttacacattcatgctcccctcctaacctttctatagtatcccctaaactcaacttactatccttatttttaaaacaactatacttttaaaaccc

SEQ ID NO: 74835 - DNA, 387 bp, Zea mays
  Clone ID: LIB3079-043-Q1-K1-C12
gctcccgcatcatggctcagccttgaaggaacagatttcttcaaccaagattcctgcccgtctcaagagtggcagcggactatgctcggcctgtgaaaacttcacgagcgaagccgtcacttatctcggcaaggaacagacacaggacaggatcatggagttccttcatgatgcttgctcccaatcattctcctttgaacagaagtgtgtcgagctgatggactcttatgcgactctcctgtttgccaagatcacggagatcagaccggaagcgttctgcaaacggtatggcctgtgcagggacacggctcttctctccggtgtgggaagtgacagcacgtgtgtgttctgccaccatctgctcgatgaaatcatgtccaaactgaa

SEQ ID NO: 74836 - DNA, 417 bp, Zea mays
  Clone ID: LIB3079-043-Q1-K1-C2
cacctggcaccttataaggcacattagtgtaccaacattggcagccaaaatatttggcttccttatgctgctgggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactc

SEQ ID NO: 74837 - DNA, 405 bp, Zea mays
  unsure at all n locations
  Clone ID: LIB3079-043-Q1-K1-C3
cccacgcgtccgccccacgccactctccctactccctccctctctctctatctccctctctctagcacccgatgcagcagcaacccccctccaatggagctggcgaccgagccctcccaagctcctctctcaccttggcaagctctcccatggcgtctccccctcctctacggcagtaaggaccgagagatgatgatcgagccagtgatgtggtggtaacaacaaggtgcagttggtggacgtactgaaggatgatggacttaaccagtggatgctcgccgagcaagtacctcccccaacaaacactatctaagtgttaaattaaaagtactctctaagatgtttggttgatggtgtgacttggcctncatccctgccaccgggatagacggtcgagtgggttac

SEQ ID NO: 74838 - DNA, 345 bp, Zea mays
  unsure at all n locations
  Clone ID: LIB3079-043-Q1-K1-C4
ccgaattccgggtcgaccaccggtccgcctccccctccggttcgggttcgggttcgtgaggttctccggggttcgggttcgtgggtgagcggatcgagatggcggcgtcngatgttgagtcccgctgcttcntcngcggcctcgcctgggccacggacgaccactcccttcacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacg

SEQ ID NO: 74839 - DNA, 386 bp, Zea mays
  Clone ID: LIB3079-043-Q1-K1-A7
acgcacaccccccgcaccgctctctccccacccaggcacccagcctccacgccacagatctctctccctggccgccctctctctctctccgaactctaccccgcagtctcggccgcggccatggcggaggacgcccccaacgccgtcgccgagggcagccagcccgcggcctccgagggatccgccgacgccgccctgccggctgccgcgggcgccaaggccgcggaggcgctgctcccgtcgctcagtatctggccgccgtcgcagcgcacgcgcgacgccgtggtgcgccgcctcgtgcagacgctcgcggcgcccagcgttctctcccagcgctacggtgccgtcccggagcccgaggccgagcgcgccgtcgtggccgtcga

SEQ ID NO: 74840 - DNA, 319 bp, Zea mays
  unsure at all n locations
  Clone ID: LIB3079-043-Q1-K1-C5
cacgtatattcatttcctggtcacatccccgaacaatgtgaaggcgttaatcagatagatgacgatgaagaagaacaactataataagatttgccctagcctgtgttctcagttatctctaanaaaaaaaaagaacactaaatacacaacaccataaaaacataaaagcaaagacctcaagtacaaaatcatactaaatcgggatacgcagaggtaccgccgattcggtttcgccaccttaattcacagaagatgcgatgcggaacaccatctatgtcatggacggccctgagctatacaaccgtaacatcaccgtaaa

SEQ ID NO: 74841 - DNA, 193 bp, Zea mays
  Clone ID: LIB3079-042-Q1-K2-E9
cctttttcaagcaacgcgagccatctatttcttttgtctagctatgttagtgatatcttgggagagacctcaatgttaccaccgtatctttgtctttgttggatggagagatttaagcaccttaccacacctttgttctttgttggatggagagttttaagcatcacctgtttgaagttgaaaaccctaactc

SEQ ID NO: 74842 - DNA, 134 bp, Zea mays
  Clone ID: LIB3079-042-Q1-K2-F10
taaatcacttacatatataaaattttcataactttctatcatacatctactctaatatgttaatgtgtatttttagatagcctgataattactcttatacatattttaatatcttaactccttcatcaatcttt

SEQ ID NO: 74843 - DNA, 443 bp, Zea mays
  Clone ID: LIB3079-042-Q1-K2-F12
cggacgcgtgggtaaattctgattctgagggtgctggcactcgatcatacagctaccgcgtatgttgagctagttattgctagggtaaaattattttattgaattttaatttcttagccctgcgcaatctttaggttgttatgcaaactggtgatgctgagctggaaatgcgagggcgctgcagtgctggtcagaagtttcttgcttctcttataatcagactagcacttgcggaaactttctgcctgaactgcggtatattggctttggatgagccaactacgaatctagatgggccaaatgcagagagtcttgctgctgcgctgttgagaataatggaagccaggaaagggcaggagaacttccagttgattgtaatcactcatgatgagagatttgcccatcttatcggtcaaaggcagcttgctgagaagtactatcga

SEQ ID NO: 74844 - DNA, 146 bp, Zea mays
  Clone ID: LIB3079-042-Q1-K2-F9
tcccactcatactaaaataacaaaatttatgtatctatagaatcacaaatcaatggtgaaagggggttcttataacagaataatactcacatatacatatattcaaatttaattcattaaaattgtgcaatcttaaatttaattat

SEQ ID NO: 74845 - DNA, 345 bp, Zea mays
  Clone ID: LIB3079-042-Q1-K2-G10
aatgatcacccttccactagagaaaatggcaaccagagtagctggttccctctgcgtagctgactgggcttggggaggagatgattgttagcagcatgaagaagtatgaagatagagcagtagaactagcgctgaatccggtgaagcttcaagcgctgactaacaagctcaaggaagttcgtatgacctgcccgttgtttgatacagctcgatgggtgcgcaaccttgaaagggcatactacaagatgtggaacctttactgctccagtcgccacccggagccattcaaggtggtagaggatgacaatgagtccccatttgaccgctaacgagatctcatcagca

SEQ ID NO: 74846 - DNA, 397 bp, Zea mays
  Clone ID: LIB3079-042-Q1-K2-G12
gttctatatctgctggagttggtctactacatttttgtcccaccatttcaaattttaagatgattggcttttctagatacattgcttcaactattgtatgtcgaagtgcatagcaaaatcaatgtatctagaaaaactaaaacgtcttaaaatggagggagtattattattcagagggtgccgtgggggagtgggactatcctaaacgagtgaaataacaatattacatttgatgccttgttatagcagtatgcaatacattagtatactcatagttggagtagcgaaccatcttagagtgagaaaactgtagccagcagaacagcattgtctacaaagatgacaattttgtttagctgtgctccttttttgtaccttttaagttgagacctgatgc

SEQ ID NO: 74847 - DNA, 346 bp, Zea mays
  Clone ID: LIB3079-042-Q1-K2-G9
cccacgcgtccgggtgaagttgctccatgaggcagcgggtcacgtggtgacggtggagctggagaccggcgaagtgtaccgggggtcattggtcgagtgcgaggataactggaattgccagctcgagaacataaccttcactgccaaggatgggaaggtttcgcagctggagcacgtcttcatcagaggaagcagagtgagatttatgattatacctgatatgctcaagaacgctcccatgttcaagcgcttggaagcgaggattaagggcaaaggatcagctattggagttggtcgtggacgtgctgttgcaatgcgtgctcgggctgcttgtggtcgaggtggt

SEQ ID NO: 74848 - DNA, 314 bp, Zea mays
  Clone ID: LIB3079-042-Q1-K2-H10
gagaagctggcctttgtggccctagactacgagcaggagctggagaccgctaagagcagctcctccgtcgagaagagctacgagctgcccgatgggcaggtcatcacgatcggcgcggagaggttcagatgcccagaggtgcttttgcagccgtcgctgatcgggatggaagctcccggcatccacgagaccacctacaactcgatcatgaaatgtgacgttgatatcaggaaggacctgtacgggaacatcgtcctcagtggagggacgaccatgttccctggcatcgctgacaggatgagcaaggagattac

SEQ ID NO: 74849 - DNA, 410 bp, Zea mays
  Clone ID: LIB3079-042-Q1-K2-H11
cccacgcgtccgcaagaacgtgcccatgctgaaggcaactgcctcaagattgtttggccctgtatttgattggatagaaacatgggaaatgatatcaagacttaagtatcttggaactatgcttttcctgcataattttcagcaggcttttacatggtcccttaagattgtgggtgctgctaagtctgctcttagtgttttgacaaagccaattgcgggaccaattctggaggtttttgaacttacgatgccaatttggaacctttgtgctgagacagtaggatatctgagttcagttgtcatgttatctgtagaagtgtcttggagtgtagttattgatacagtggagatgattgtctggccattttggtttggcttcagtactatggttagcattgtgaattcaattc

SEQ ID NO: 74850 - DNA, 238 bp, Zea mays
  Clone ID: LIB3079-042-Q1-K2-H9
cgactgggttgctcgtgaagttttcaacattgagagtgatcaaatccttagctgcttgcttttgtctctctattttctccttgtgtatttttaagcgtttatccatgaacaaagtatcggtactagggtactactaaaccaaggtatttaggctgtttggctcaggtttaaaaaaaatacttactatactcaaattaaaaggccatgaacaaattgcacatttaatcattgagggtat

SEQ ID NO: 74851 - DNA, 412 bp, Zea mays
  unsure at all n locations
  Clone ID: LIB3079-043-Q1-K1-A1
cttgaggctgtcatccatctagagtcgatttttccatgcgaaaagcgtattgaatttttagactcacttgtggagaagtttgttacacctgaatcatctcanggagagttggcaagtctagttgacaaagaagaaatatcttccatatttttagagtttttggatctctttggtgatgcaaagtcaatcaggaaggcttcaactcggcatacaacttttttttcatgtaagagaagcattctgccatcaaagaaacggaaggctgatgatgctgttgtgtcagacagggacaagtttgctaaaactgggtctgttcagtcagccacaggaactgatccaaatgcttccaatcctnctgtttggcctgcgacttctgaaacatctggacatcaatggggaagctcttatgctc

SEQ ID NO: 74852 - DNA, 424 bp, Zea mays
  unsure at all n locations
  Clone ID: LIB3079-043-Q1-K1-A10
cagacgcgtgggcggacgcgtgggttttggtggacttttactctccatgggccttattggatttctcttggggaggagccctgcgagtcttacctttggcgttgcacctggccttgccatattggccctggctgtacttagcctcaatgtctggaggagcgggaagtccagcttaccgttcatactggcgcaagcaggcattgccgctgccgtagcatggaagcacggccaggcgtacaccactacgaggaagctgcttccgtggggattctacgtcgcgctgagtgccgcaatgatctgcttctactcctacgttcttcttgccggagggaatccgcctcctaagaaggcgaaggcgaangcgaaggctgctgcttgatttgatgttgaaggcattcaccggagcgtctcataattgcactac

SEQ ID NO: 74853 - DNA, 412 bp, Zea mays
  Clone ID: LIB3079-043-Q1-K1-A11
cccacgcgtccgaccgcaccaccgaccactgcctccgtacgcgtccctctggcggaaaatcggtcctagtgcgcgagctcgttttgtttggatcttctgtatatctattaaggaggcttctccatctcctcggagcagcaaggctgtgcagcaatggagaagtataacagcaacactcaatttgcaccattgagagagactccgtttgccctccgtggtgctcttggtagttcaagctcatatcttgagcaagccaggggctacacatcttcccctgtagcagctctgcgcccaaagatgtctacacctggaaatcgactcctgcatacgagctgccccctgtcatctgctgtagcgaaccgcccgctgtcgccccatcttcctctgaagaagccacagttcagcgctactt

SEQ ID NO: 74854 - DNA, 459 bp, Zea mays
  Clone ID: LIB3079-043-Q1-K1-A12
cccacgcgtccgcgggaagcttccgactccataccccgcacacgagcgctccctgcagatgacctcggctgtggtggagcgcgtaaccaacgacgaccggagcgtatcctcgttgcttgatccaacgctgggtggagaccacagggaagacgagctagcggtcatcggcgaggtgatccgggcctgcatgcagagcgacccgaggcgaatgccgagcatgagggaggtcgccgccaggctgagggaggccgtgggtatctcgccggtcgctgcgacgccgaggctgtctccgctctggtgggccgagctggaggtcctttccgccgcggaagcaagctaataatagtgggcgagaggacaggacaggaacagggcatgatgatgtcgcgcaatctgaccagtttgttctcaagaaaaaaaagccttgcagccctttgtgcatgctgtaaatgtgaatgt

SEQ ID NO: 74855 - DNA, 377 bp, Zea mays
  Clone ID: LIB3079-043-Q1-K1-A3
agcaactctccgaatgaagcaggatatgcaaaatgagaacaaaaatatgtctgacttaatagcatataggggagaattcacccctcatccacatgctggtgataattggtgtatctatccgagctatgactatgctcattgcatggtggattctcttgaaaacatcacgcattcgctgtgcacacttgagtttgacatacgccgcccttcatactactggctacttgttgccttgggtctttatcaaccatatgtgtgggaatattcgaggctaaacatatcaaatactgtgatgtctaaaagaaagttgaatcgacttgtgacaaagaactgggtagatgggtgggatgatccccgcttgttgacactggctggac

SEQ ID NO: 74856 - DNA, 463 bp, Zea mays
  unsure at all n locations
  Clone ID: LIB3079-043-Q1-K1-A4
gcggttcgatatcactgtacgactcttgtatggaagcaacagacagtgatcataaacctgtcaaatgtgtgttcagtgtagatattgctcatgtggacaaacaaacaatgaggcagaagtatggagaaataatgggttcaaataaggaagtgcttgactcacttcagggcttggaggctttgcctgaagtagatatcagcacgaatgacatcattctgcaagatcaaaacccttttgttgtgaaactgcacaacagaagtacaaaagagttggcttgttttgagatcattggtcagacaccaaagtcatctggcacacctttctcaggtttcccttcttggctgaaggtttctccggcagtcggtataatttctcccagacaatctgttgaagtgacgttgcaacatggacaaatacgaagtcaagattatcttactgggacttcangggacagttctggagc

SEQ ID NO: 74857 - DNA, 74 bp, Zea mays
  Clone ID: LIB3079-043-Q1-K1-A5
aaaaaaaataaatataaaaaatattttataaaagaaacagaaaaaaaatataaaaaatgaaaaatatttcgcga

SEQ ID NO: 74858 - DNA, 57 bp, Zea mays
  Clone ID: LIB3079-043-Q1-K1-A6
cccacacgtccgaaaaaaaaaaaaataaaaaaaaaaataaaaataaaaaaaaaatat

SEQ ID NO: 74859 - DNA, 305 bp, Zea mays
  Clone ID: LIB3079-042-Q1-K2-E12
cccacgcgtccgcggacgcgtggtcggactcgtggggacgcatcatcaggggaagatgcaggcgcggcccgacccggagaaggacctgggcatcgtattctccacgttcgaccacgacggcgacgggttcatcacggcagtcgagctcgaggagtcgctgcgccgactcggcatcgcagtgtccgccgacgaggccgcggccatggtcacgcgcgtcgactctaacagcgacaggctcatcgacatccactagttccgcgagctctacgactccatacccaagaagaggatgcaccagcaccccg

SEQ ID NO: 74860 - DNA, 277 bp, Zea mays
  Clone ID: LIB3079-042-Q1-K1-H7
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaataaaaaaaaaaaaaaaaaaaaaaaaaaaaaataaaaaaaaaaatgaagaaacatcattttattagcctagcagtaaatccctaataacgggagataacgtaaaaattatgaggttaagaacgatcgcgcttatcaacaatttgcgcagtttgaa

SEQ ID NO: 74861 - DNA, 561 bp, Zea mays
  Clone ID: LIB3079-042-Q1-K1-H8
ggccggcattcggatgtgtgatgatgaaagagttcttgtctgaattggctaagagggttaataagaacaccactgcctatgagaattacaagaggatctttgtacctgagggccagccgctggaaagcgagccaaatgagccactgcgagtgaatgtgctcttcaagcacgtccagaagatgttgactggtgatagcgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagcataatcttcctgatcaacaacggtgggtacacgattgaggtggaaatccatgacgggccatacaacgtcatcaagaactggaactacactggctttgtggacgccatccacaatggcttgggcaagtgct

SEQ ID NO: 74862 - DNA, 74 bp, Zea mays
  Clone ID: LIB3079-042-Q1-K1-H9
gcgaccacacgtgcgaaaaaaaaaaaaataaattattataatgatttaaaaatataaataaataataaagaaag

SEQ ID NO: 74863 - DNA, 273 bp, Zea mays
  Clone ID: LIB3079-042-Q1-K2-A10
cggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctacggcggtcggcgcgaaggtggcggcggcggctacggaggcggtggcggctacggcggtcggcgcgagggtggcggtggcggctacggcggcggtggcggcggcggctggagggactgatg

SEQ ID NO: 74864 - DNA, 323 bp, Zea mays
  unsure at all n locations
  Clone ID: LIB3079-042-Q1-K2-A11
cgacgcacgcgtccgccttctcgctcgtcgccgtcgtcaccgtcgtgctcgtcgcggagccgcaccgngtcagggtgctcggcaacgtctggctcgccttctccatggccgtcttcgtcgcccccctgagcgtcatcttcgttgtgatcaggacgaagagtgccgagttcatgcccttcaccctctccttcttccttaccctcagcgccgtcgcctggttcttgtacgggctcttcaccaaggacccctacgtcacgctcccgaacgtgggcggcttcttcttcgggtgcatccagatggtgctctactgctgctaccggaag

SEQ ID NO: 74865 - DNA, 435 bp, Zea mays
  unsure at all n locations
  Clone ID: LIB3079-042-Q1-K2-A12
cccacgcgttcgcctacgttgagcaccagaaggccgtcactatccgcaacgacgtcaaccttaagaaggagacgcttaggatcgagcctgatgaagagtgccctggccacttnctcgttgccttcacctttgacgccacggtcgctggcagcatgactgtttacttgtttgcaaaggaagagctcaactgcaatctaacagcagtgaaagaagacctaatgaagcccgttactggtagcttcaaagagggtctgggtcaaaaattcaggcaaccttcaggaacagggattgacttttcaatggttggagaatcagattattaaagcagggggacatggatggatatccacttgcagttaaagctgaaacaacattgcttgttgatcacccaccagaaggggatgaccaaaagatgaaaactcctaactcacagat

SEQ ID NO: 74866 - DNA, 355 bp, Zea mays
  unsure at all n locations
  Clone ID: LIB3079-042-Q1-K2-A9
gagcgcggcgcgcgagagggagaacgaccaggaggggaggagatcgatcgatcgatcgatcgagatagatggctttcctcaacatggagcagcagacctgggccttcaccttcggtatcctaggtaacataatctcgctgatggtgttcctttcgccgctgccgacgttctaccgcgtgtaccgcaagaagtcgacggaggggttccagtcgaccccgtacgtggtgacgctgttcagctgcatgctgtggatcttctacgcgctgctcaagtccggcgccgagctgctggtgaccatcaaacgcgtcnggtgcgtgatcgaggcggcgtaccttgccgcgtacctggtgtacgc

SEQ ID NO: 74867 - DNA, 184 bp, Zea mays
  Clone ID: LIB3079-042-Q1-K2-B12
gcgagagagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaaacggtgagccccccaaaccagcagtgg

SEQ ID NO: 74868 - DNA, 324 bp, Zea mays
  Clone ID: LIB3079-042-Q1-K2-B9
acgcccacgcgtccgcgcccttgttctctgcgactctgcccggccggtctccgaggggggcgtggggaaccagagagcaaggcgaggagcgcggaagggctgagggaaggggcggcggggcatggctcgccggccggcgtcgtgggagcagggcggcgacgagtacgactatctcttcaaggtcgtgctcatcggcgactctggcgtggggaagtccaacctgttttcccgcttaaccaagaccaccttggccctcgactccaagtccaccatcggcgttgagttcgccacgcgcacactccaggtggagaacaagattttaaa

SEQ ID NO: 74869 - DNA, 431 bp, Zea mays
  Clone ID: LIB3079-042-Q1-K2-C10
cccacgcgtccgggacgccttccacggcgacaaggaccacggcggcgtccacgacggcaccaccgtcgtcctctgggagtgggccaagggcgacaaccagcgctggaagatcctgccctggtgaacgtgaacagagacgagctagatgaatccaaggaaccttacctagctgctgccgccgccgcctaattcgtcctcctccgctctagctgttatctgtctgtgtcttcgcgtcctcggttcctgaatggacgaataatatatagcatgcatgtacggctagcgaccatgtctgaatgacatcttcgttgctgctgctgctgctactgctacctgtccgtttggggttctaaaagactctgatgagtggttctgaatgtctgcatttcaagtttgctgtgtgatgttaatgtaccgtgcgtaccagagct

SEQ ID NO: 74870 - DNA, 310 bp, Zea mays
  Clone ID: LIB3079-042-Q1-K2-C11
gagagcatcaacaacaagctgcagctgctgatgaagagcggcaagtacaccctgggctacgagaccgtcctcaagacgctgcgcaactccaagggaaagctgatcatcatcgcaaacaactgccctgcacttaggaagtctgagattgagtactacgccatgctggccaaagttagtgtgcaccatttccacggaaacaatgttgatcttggcactgcctgcggcaagtactacagggtgtgctgcctcagtatcatcgacccaggtgactcggacattatcagtaccacccctggcacccagtgagcca

SEQ ID NO: 74871 - DNA, 105 bp, Zea mays
  Clone ID: LIB3079-042-Q1-K2-C12
gagagcattaacaacaaacctgcaactgctgctgaagagcggcaagtacacactatgctacgagacctttcttatgacactgggcaactgcaaatgacagctgat

SEQ ID NO: 74872 - DNA, 246 bp, Zea mays
  Clone ID: LIB3079-042-Q1-K2-C9
ccgattcgtccgaagagtatgaacaacaagcttcaactgctgatgaagagcgttcaagtacaccctgggctactagaccgttgttaaaactctgcgcaacttcaaggtaaagctgatcatcatcgcgaacatctgtccttcacttatgaagtctgagattgagtactacaccatgctggccaaagttagtgtgcaccattttcaccggaaacaatgttgatcttggcactgtctgctgcaagttct

SEQ ID NO: 74873 - DNA, 248 bp, Zea mays
  Clone ID: LIB3079-042-Q1-K2-D10
gtcaccaaatcattccagtccctacatgaagcatacaaagggaaaattgttgggcttgtagtatccacaaatgaggctccatcatccttaggatccataattgacgcaccattttaactgaacatttaaggacggttagaaaaagcaggcaggactccagacttagcctttgtcgaactggttcaaaaaacctgggcttgaattacaggaatcatcctgctggttcaaactctaataggggttggctg

SEQ ID NO: 74874 - DNA, 434 bp, Zea mays
  Clone ID: LIB3079-042-Q1-K2-D11
gaaattaaaaagctgaagctcataccatattatttccctttgtttgttactgagaatgttgtacagaaggaaaaggaccacattgagggctttgcacctgaggtagcttgggttactaaatctgggaaatctgacctggaagcaccgattgcaatccgccccacaagtgagactgtcatgtatccatacttctgcaaatggataagaagccaccgagacttacccttgatgtgtaatcaatggtgtaatgttgttagatgggagtttagcaatccaacttctttcataaggagccgtgaatttctgtggcaagaggggcatactgcttttgcgactaaagaagaagccgatgaagagggtctccaaatattggaactggacaaaaggatatacgtataatttttagcaattccagtttccaaagggaggaaaag

SEQ ID NO: 74875 - DNA, 306 bp, Zea mays
  Clone ID: LIB3079-042-Q1-K2-D12
gcagcggcctacgccgtcgtgctttcggaatacctcggcacggccagcctgcgcgtctgggagttcgccgggggcgcgtggcggcaggtggccgccatgccgcccgccatgtcgcacggattccacggcacgcgccccgacatcaactgcgtcagccacggcgaccgcctcatggtctgcgtcacctacgccgaggccaacgcctgcttcatgtgcgacgtggccagcaaccagtgggaggagctgcccaagtacgtcaatgctgacagcgaggccagcgagttcctggccgcattctcttcgagc

SEQ ID NO: 74876 - DNA, 210 bp, Zea mays
  Clone ID: LIB3079-042-Q1-K2-D9
acggtctggtattgaaaaatattatagttcctccgaagtgttcggctaccttgtgggagctctggtttgaatactataatggggtagttctatggtgtagtatataccatggtatttatgtttggagtatttaaaactccactcgaatctaaaatttcattatctatgactgggttttggtatatatacattaagatatcatggtttaaa

SEQ ID NO: 74877 - DNA, 304 bp, Zea mays
  Clone ID: LIB3079-042-Q1-K2-E10
cccacgcgtacggattgtagcatcaatcatcatctgccacactcctgtccgcgctgccagtgcactacgagctggcattgacatccttggcacattcctggactctcaagcaaaggcgtgaggcggaccatgatgaccaacgtctgcagaatcagtagcaagcactaaatccaatattgcttgaaccagaggcatgtagatatcgggttagctttccgtatgagagtatgcaataatggatgaatggctctgcagtttcgatcttgtttgtaggccagactcaaatccatacgccatgaactgc

SEQ ID NO: 74878 - DNA, 600 bp, Zea mays
  Clone ID: LIB3079-042-Q1-K1-H6
ggaagtttaaacttgtcaagggcaattggagacgtggaattgaaacagaacaaattcctgcctcccgagaagcaaattgtgacggccaatcctgatatcaatgtcgtggagctctgcgatgatgacgactttgttgttgtagcatgtgatggcatttgggactgcatgtcaagccaacagctggtggattttatccacgagcgtataaacacggagagcagcctgtctgccgtgtgcgagagagtgctggacagatgcctggctccatcaacgatcgctggagacgggtgcgacaacatgaccatgatcctggtgcagttcaaaaaacctgtcgatcggaacaagaaggccgaagcagcagggcaatctgccagcaatgtggacgaagccaagagtcgtgttgctgaggagtgaagcatggctggcactcaccagggcgcaaccatttgctttcataaggcaggtgaaaaaaaggaacgaagaaacctgcagtgtacgtatctcaactgtacgtggcatgccatgcaaatcctgcctaagttaccccggacaatggcattgcctagtgcagtggtggatcttcagatcacaacctttctt

SEQ ID NO: 74879 - DNA, 375 bp, Zea mays
  Clone ID: LIB3079-042-Q1-K2-E11
cccacgcgtccggtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcgcaagagggaagcgcttgacgtagtctttagatttcaattgttgcagccgatcaaccttcttagggttgtataatatgaagtcaatgttgagactaatgtgaggtgggaaaggcctattgatgcatcaaatgtattatgagctaat

SEQ ID NO: 74880 - DNA, 143 bp, Zea mays
  Clone ID: LIB3079-042-Q1-K1-F9
gtccgattcccggtcgacccagcgtcgcacgcgtcgaaataacaaaattatggtatggatagaatcacaatgaatctgaaacaggtctatacagataacgcacacatgtacataaaaagaatggaaaaataaaagggcggcgt

SEQ ID NO: 74881 - DNA, 544 bp, Zea mays
  unsure at all n locations
  Clone ID: LIB3079-042-Q1-K1-G1
gggggagagagagaagtgggagacccgcgagaggctgccgtgtagggactagggaccgtagagtaagcgacagcgaaggagggagagggggatggccgggatcgggccgatcaggcaggactgggagccggtggttgtgcggaagaaggcacccaccgccgctgccaagaaggatgagaaggccgtcaacgccgcgcgccgctccggcgcggagatcgagaccatgaagaagttcaacgctggtatgaacaaggcggcgtccagcggcacatccctcaacaccaagcgcctcgacgacgacacagagaacctcgcccatgagcgagttccaagtgacctgaagaaaaatctcatgcaagcaaagctcgataagaagttgacccaggcacagcttgctcagatgatcaatgagaagccacaggtgatccangagtatgagtcangcaaggcaattcccaccagcagataattgcaagctcgaaagggcctggaacgaagctgcgtgcagaataccagacatatacgaaacaggaactgctgtata

SEQ ID NO: 74882 - DNA, 392 bp, Zea mays
  Clone ID: LIB3079-042-Q1-K1-G10
aatgatcacccttccactagaaaaaaatggcaaccagagtacctggttccctctgcgtaactactggccttggggaggagatgattgttagcagcatgaagaagtatgaagatagagcagtagaactagcgctgaatccggtgaagcttcaagcgctgactaacaagctcaaggaagttcgtatgacctgcccgttgtttgatacagctcgatgggtgcgcaaccttgaaagggcatactacaagatgtggaacctttactgctccagtcgccacccggagccattcaaggtggtagaggatgacaatgagtccccatttgaccgctaacgagatctcatcagcagcccggctctgtaaataaggcgagagttgtagaatatttagcatcgt

SEQ ID NO: 74883 - DNA, 250 bp, Zea mays
  Clone ID: LIB3079-042-Q1-K1-G11
gcaacagctgcagcaggtgaccgtggcacggtcagttgcagcagcagcagcagctgccaccaacttggagctgaacccattcttagagatggataccaaatgctacttcactggcggccccttcgcaacgctggacatgaagtgctttctccccggcagcttgcagcatatgctggatgcacagcagcgccagatgctcgccaccgagctgaacctcggctaccaactggcgccgtatggttctgacgct

SEQ ID NO: 74884 - DNA, 310 bp, Zea mays
  unsure at all n locations
  Clone ID: LIB3079-042-Q1-K1-G12
gttctatatctgctggagttggtctactacatttttgtcccaccatttcaaattttaagatgattggctnttctagatacattgcttcaactattgtatgtcgaagtgcatagcanaatcaatgtatctagaaaaactaaaacgtcttaaaatggagggagtattattattcagagggtgccgtgggggagtgggactatcctaaacgagtgaaataacaatattacatttgatgccttgttatagcagtatgcaatacattagtatactcatagttggagtagcgaaccatcttagagtgagaaaactg

SEQ ID NO: 74885 - DNA, 363 bp, Zea mays
  Clone ID: LIB3079-042-Q1-K1-G2
gccaggtgtacgtactagtactagtagatgcgtcacatactatccagctacgtactactactagccggtgcacatcactagcgatgactgccatccacggtagccatgcgtgcccaccgttgaagatgggtcaagtccgccaccagcctcgccgtggtccagcgtatcaagagcagcctcagcctcgtcagcaaccgccgaaggatccggagcatgcacgtcttgaccgactacggaaggatgaagtgcatgacgctgtcgtacgtgtacgcgatgtcgacggacgagacgctgaagcacgtggactagctgctgagcgacgacctgatgcactaggtggactacatgatgctcagctgctgg

SEQ ID NO: 74886 - DNA, 401 bp, Zea mays
  unsure at all n locations
  Clone ID: LIB3079-042-Q1-K1-G3
cgataatccgccggcgttgagatgtgggtttatcaggaactcctatctggcgacgaggctcctgtcggattcattcacctacaaggagctcgagaacggcgtnctgtgggaggtcgagggagagtgggtcacccaaggtcctgttgatgtggacattggtgccaatccatccgccgagggtggtgaggacgaaagcgttgatgacacagctgtgaaggtgggtgatattgttgacacattccgtctacaggagcaacctncttttgacaagaaatcatttgtgtcttacatcanaaaatacatcaagaatctcactgctgtgttggagccacagaaagcggatgagttcaaaaagggtgtcgagggtgcaaccaagtttctccttagcaagctgaaggacc

SEQ ID NO: 74887 - DNA, 614 bp, Zea mays
  Clone ID: LIB3079-042-Q1-K1-G5
gactctttccgttgctggcttcagcatatgcatttagatttgtgggtgactggctgaagtggctatacatggatgtcactcagaaactggaagctaaagactactcaacactgcaagaagcccatgcctgtactgctggtttgaaggctgtgacaacatctgcaacagctgatgccattgaagaatgtagaaagctctgtggcggacatggttacctgaacagcagtgggcttcctgaattgtttgctgtctatgttcctgcttgcacttatgaaggagacaatattgttctgcttttgcaggttgcaaggattctaatgaagaccttatctcaattgacatctggaaaacaacctgttggtacaatggcttacatgggcaatgtacaatatctgatgcaatgcaaatgtgctgttaacacagctgaagattggcttaaccctgttgccatacaagaggcgtttgaagccagggctctcaggatggcagtaaactgtgcccagaacataggccaagcagcaaaccaagaagaaggtttctatgagcggtcccctgatttgctagaggctgcagtagctcacatccagttggtcattgtaaccaagttcatttcg

SEQ ID NO: 74888 - DNA, 437 bp, Zea mays
  Clone ID: LIB3079-042-Q1-K1-G6
ctggagatccaccactccaccagtccggtccatctgctggacctcgattggtttggtcttacctaggaacatccggggatgtcgactcctgcgaggaagaggctgatgagggatttcaagcggttgatgcaggaccctccggccggcataagtggcgccccgcaggataacaacataatgctgtggaatgctgtcatatttggacctgatgataccccgtgggatggaggtacgtttaagctgactctccagtttaatgaagaatatccaaacaaaccaccaactgtgcgatttgtttctaggatgttccatcctaacatttatgctgatggaagcatatgcttagatatcctgcataatcagtggagtccgatatatgatgtagctgcgatactcacgttaatccagtcattgttgtgcgatccaaacccgaattc

SEQ ID NO: 74889 - DNA, 456 bp, Zea mays
  unsure at all n locations
  Clone ID: LIB3079-042-Q1-K1-G7
ctttttctcctcctgccgtacgtccgttccagcttgcaaagcgctcgcgagctgctgccatggcaggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggcgactcccgcatcatccgggacgcctacgcgcagccgcggtaccttcgcatggtgcgcctcgcccgctgcctctgggccgncggcgaggcggaagccggctaccgcgtgctcaccccgacgccgcacctctccatgggcccgcggagcagcgcctcgctcgccgncgncatcgctaacatcggtgccgaggaggtggacgtggacgaccttcacc

SEQ ID NO: 74890 - DNA, 619 bp, Zea mays
  unsure at all n locations
  Clone ID: LIB3079-042-Q1-K1-G8
gtcgccgacccactccccgatggggatcagggatacatcgttctcaataggccatgggcatttgttcagtggctccagaaagcagacataaaggaagactatattttgatggcagagccagatcacataattgtcaagcctatcccaaacttgtcgagagatggtcaggcagcagctttccctttcttttacattgagcctaaaaaatatgagaatgtgttgcgtaagttcttccctgaagacaaggggccaatcactaagattgatcctataggaaactctcctgtcattattgagaaggaatctcttggaaggattgcaccgacttggatgaatgtttcattagcaatgaaaaaagatcctgacgcagataaatcttttggctgggttcttgaaatgtatgcctatgccgtggcatctgctctccatggagtgggcaacatcttacgcaaggactttatgattcagccaccttgggacttggaagttggtgattcttttattattcattatacttatggctgtgattatgacatgacnggtaagctgacttatggcaaaattggagaatggagatttgacaagagatcatacacggacaaaccttcacctagaaatt

SEQ ID NO: 74891 - DNA, 417 bp, Zea mays
  Clone ID: LIB3079-042-Q1-K1-G9
cccacgcgtccgggtgaagttgctccatgaggcagcgggtcacgtggtgacggtggagctcaagaccggcgaagtgtaccgggggtcattggtcgagtgcgaggataactggaattgccagctcgagaacataaccttcactgccaaggatgggaaggtttcgcagctggagcacgtcttcatcagaggaagcagagtgagatttatgattatacctgatatgctcaagaacgctcccatgttcaagcgcttggaagcgaggattaggggcaaaggatcagctattggagttggtcgtggacgtgctgttgcaatgcgtgctcgggctgctgctggtcgtggtggtggtcctgttggacgaggtaacgcgcctcctgtgaggaggtagattctaaatggcggcttttctcgtctggc

SEQ ID NO: 74892 - DNA, 163 bp, Zea mays
  Clone ID: LIB3079-042-Q1-K1-H1
ctttttctcctcctgccgttcgtccgttttagcttgcaaagctctcggcagctgttgccatttcaagcgccggtgcgccctcaattacccatgcctgtcgcccagcccccaacttctacgtcatcgtagtgggcgccggcatcatcgtcagcttcactgctca

SEQ ID NO: 74893 - DNA, 202 bp, Zea mays
  Clone ID: LIB3079-042-Q1-K1-H10
gagaagctagcacccgcccaccaggatccaggtttgtgctgcgagagggcctatccattcggcatgattgatttcgtgctcctgatcagccgacagggcaaggtgaggctcaccaagtggtattctccttacacccagaaagagaggaccaaggtcattcgcgaactcagtggactcattcttacacgagggcccaaactct

SEQ ID NO: 74894 - DNA, 231 bp, Zea mays
  Clone ID: LIB3079-042-Q1-K1-H11
cccacgcgtccgcaagaacgtgcccatgctgaaggcaactgcctcaagattgtttggccctttatttgattggatagaaacatgggaaatgatatcaagacttaagtatcttggaactatgcttttcctgcataattttcagcaggcttttacatggtcccttaagattgtgggtgctgctaagtctgctcttagtgttttgacaaagccaattgcgggaccaattctgga

SEQ ID NO: 74895 - DNA, 231 bp, Zea mays
  Clone ID: LIB3079-042-Q1-K1-H3
tttcgtcgtacacctcacccgctttcctttgctccactctagcgacgcgatttctgtgctcttttgagattaaattatcttggactgctgttggtctggtcggcggctggtggcatagggatggagaccgcagctgcgatggtggagggcggagtggggcggtttttgttggcgccggcgatgttcgcatctctgccggctgtcttacaggttggtcatttaaaaaccttt

SEQ ID NO: 74896 - DNA, 316 bp, Zea mays
  Clone ID: LIB3079-042-Q1-K1-H4
cccacgcgtgcgcgtcgccgttgttgctgtgactgcagcgttggcgggccttgtaccgactaaatgggacacaagcggccttattgttaccgggaagagcttccgcggaagcagatccctatgatcaggtgccaagaggtcgttacaataccggagaacgcacatggtaaggcccaagggaacgcacaaggccaccacagcctgactacattaaccacgagcactattacaactatagcctcctgtattgcatgctctaaacattgctagacaaatgcctgtatgcatcaatgaacgctcgagaccggtgccacaa

SEQ ID NO: 74897 - DNA, 116 bp, Zea mays
  Clone ID: LIB3079-042-Q1-K1-H5
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgccctttt

SEQ ID NO: 74898 - DNA, 75 bp, Zea mays
  Clone ID: LIB3079-042-Q1-K1-F8
aaaaaaaaaaaaaaaataaaaaaaaaaataaaaaaccaaaaaaaaaaaaaaaaaaagggggaacaagaacgcgga

SEQ ID NO: 74899 - DNA, 337 bp, Zea mays
  Clone ID: LIB3079-046-Q1-K1-H3
ggggaaagcatgcttaaagaaagtgttgctgtatcaattgtcttcaggagctaatggaactagatggggtatgctaggaataggtaactgatgtctagcaggcagaaaattggttttccttaacttcagctcagcgcatatgtgacatgtttcttgcactagataaggatacaaacagtacactgagcaaacaagaactcaaggaatatgcagatggcacattgactgagattttcattgaaagagtttttgatgagcatgtccgcctgagcaaaattggaagtggaaacagtctcgagatggacttcgaaagccttcttggatttgttttggctct

SEQ ID NO: 74900 - DNA, 128 bp, Zea mays
  Clone ID: LIB3079-046-Q1-K1-H5
aaactactacacaaactacaacaacacatatacctaaacccacaaactcacacctaaatatacacaacaaaacctcaaccaaacaaccaacaacaccacaaacaacaacacaaacaaaaatatacact

SEQ ID NO: 74901 - DNA, 209 bp, Zea mays
  Clone ID: LIB3079-046-Q1-K1-H8
acctacaatcgtaatgtaatgtgctggtattctcgaatgccatatccgatagcagccttggcttggaataacgtagtggctgactgatatgccagtaggcacctgtctagtacttacagaactacaaaaagtttgtactatacatatatggacaaccttataagtggctatgtgtgtaccaaaaaaaaaaaaaatattaataattttat

SEQ ID NO: 74902 - DNA, 200 bp, Zea mays
  Clone ID: LIB3079-046-Q1-K1-H9
atacccggccgcccttattcaatttttgaccactcaacacacatacttttatttacaaagactatcatacatacttcaaagcacttttataaaaaaacagccatacacttcaatacttaatacaccaatctctacaaacacaactaacttaccccatctacaaacattatcaaacttataccaaatctcttaattaaaac

SEQ ID NO: 74903 - DNA, 433 bp, Zea mays
  Clone ID: LIB3079-047-Q1-K1-A1
cgcacgcgtccgaacttaattcggtttaatggaaatgtggcagcacacctcatgttgttgttggagttgctaatggttcagaggaaattgaagctgtcaatttgatagacgtgttgcgtagagcaggagcaaatgttatcgttgcgtctgtggaggagaatgttacaaattgtgacctctcttcatatgtttaatctaatagctgatattatattgtattaattcatttaaatgctatttttattttttttgtattgctttttgtttatttatttttctttatttttttatttattctttttttgtttttgttttttttttattatttttttttttatttattttttttttttttattatttattttatatattttttttttttttttatttttttttattttttttattttttttttttttatttttttttt

SEQ ID NO: 74904 - DNA, 87 bp, Zea mays
  unsure at all n locations
  Clone ID: LIB3079-047-Q1-K1-A10
aaaaaaaaaaaaaagaattttatataaaaaaaaaaaaaanaaaaaaaaaggaagggaaaaaaaaaaaaaaaaannanaccccccccc

SEQ ID NO: 74905 - DNA, 450 bp, Zea mays
  Clone ID: LIB3079-047-Q1-K1-A2
cccacgcgtccgaagaccagttcccttctcctgatcgtcctgttcctcacagcatcagccatggttggccttaccggataagcaggctgtccccgctgcacaggatactgcctttcacattgtttactttgactcgttttatttctctttatcttattattttctttttttattttttttttttttttttatttattatattttttttttttttttttttttttttttttttttttttttttttttttttttttttttttttttttttttttttttatgttatttttattttttttttttttatttttttttttttatttttatttttttttttttattttttttattttattttttttatttttttttttttttttttttttttttttttttttttttttttttattttttttttattttttttatttttttttcttattttttatttt

SEQ ID NO: 74906 - DNA, 447 bp, Zea mays
  Clone ID: LIB3079-047-Q1-K1-A3
gccgacgcgctgcagctcggggacagtgttctacgtggtagggtgctccgtgggctggtacccgtcatggagctgcctcaaatacattcccaacaggctggccggagtggccctggccgcgccggcggtgaactactggtggccgctgcctgctaacgtgtcgagggccgcgtacgggaggctccacgcccggtaccgtaagaccttctggatcgcgcaccacgcgccggctctgctttacgcctggctcgcgcataattgtgttttgttgttttttatcttattgttttatcttctagtagggtggtgttttttacttttttattctattttttttttatttttttattttttatttttatttttttttgtctttttttatttatttttttttaatatatatatttttatatttttttttttattattttttttattttttttttt

SEQ ID NO: 74907 - DNA, 452 bp, Zea mays
  Clone ID: LIB3079-047-Q1-K1-A4
cagaagtggaaggaagcaggcggccactcatggttaagggacgcacgggacagcgctgcatgcgttacgttttttgcaccatcctcggatacaagaggtccaagtcgaaccagtacgagaccacgtcgctcattcagatcgaggtggtgaacaccatttatgacttcactttttctctttcttgcttctgtctgtcttttactttctttttatttatattctattttactttttattttttcttttttttcttattttttctttttctattttttttttttttttttttatttctttttatattgtttttttttttttttattttatttttttattctattttattttagtatttttttttttttttttttatttttatttttttattttttttctttattttttttttattcttttttattttttttatttattctttttttttttattat

SEQ ID NO: 74908 - DNA, 79 bp, Zea mays
  Clone ID: LIB3079-047-Q1-K1-A5
ccaatcccaatccagccacgacccacgcatactcgcaaaacctcctctacatttccaactatgcacccctcctccactc

SEQ ID NO: 74909 - DNA, 426 bp, Zea mays
  Clone ID: LIB3079-047-Q1-K1-A7
attggaagcaatcctgttcttcggtttattgctggaattgtatttatgcagtaccagtactacattgaggttctcaagcacacacactctgtaggaactctggatttgcatgcattgaatgtccagatcttcatcaagatgcatcgttcagactatgctgagaagcaattgaagatcatgcaacaaattgatgaagaccatacacttacacaacttgcaaactcatggcttgtcattgctgttgtttgctttaatatctctgtatcttattttatattccattacttttttgatgagttcttttttttctatttttttttttattttatattttatttttttctttttttttattttcttgtttttttttattattttttctttttttatttttaatatttctattttttattatttttttatttt

SEQ ID NO: 74910 - DNA, 224 bp, Zea mays
  Clone ID: LIB3079-047-Q1-K1-A8
ccggattccagctacgacccacgcatcctaaaaaaaaaaaaaaaaaaaataaaaaataaaaaaaaaaaaaaaaaaaaaaagaaaaagaaaaattaaaaaattaaaaaaaaaaaaacaaaaaaaaaaaaaaaaaaaaaaaaaaaaaaaaaaaaaaaaaaaataaaaaaaaaaaaaaaaaaaatataaaaaataaaaataaaaaaaaaaaaattataattaaataa

SEQ ID NO: 74911 - DNA, 62 bp, Zea mays
  Clone ID: LIB3079-047-Q1-K1-B1
cgatcgagccacgcgtccgagatgcctaagatggaccgatgcgatagggaaggatacagaca

SEQ ID NO: 74912 - DNA, 255 bp, Zea mays
  unsure at all n locations
  Clone ID: LIB3079-047-Q1-K1-B10
ctccattttccccactactacttcctctgctcgcggctcgccttcgtcggatccggtccagagcattcagcaacagcctgcnacctgcagtcctcgcctccgcctcctccaccctgaccgtcaacagaagaagacgaggatgtcgggatccaaggtgtacaccctcgaggaggtggcttagcacaacaccaaggacgactgctggctcgtcatcggcggcaaggtttttaatgtgaccaagtttctggaggatca

SEQ ID NO: 74913 - DNA, 271 bp, Zea mays
  unsure at all n locations
  Clone ID: LIB3079-047-Q1-K1-B11
gttggatttcaccactaactgtggtattatctggttctactgctgggataccgcagggcaagataagttttttggcctcaaacaccnatactatatccanggccagtgtgcgatcatcatgtttgatgtaacctcaaggcttacttacaagaattttctnaccttgcataaggaccttttcaggttcttttaaaacatcttcattttctctttctttttttattgtttaatttttttttattttatatttttttaattttttttctttttt

SEQ ID NO: 74914 - DNA, 287 bp, Zea mays
  Clone ID: LIB3079-047-Q1-K1-B12
cccacgccgtcccccacgcgtcccgatgaactcaaccctttcaacaagaaccataatcgaccggttcctttgttgtccctcccaaacttccccctgaatgaaatgccactctgcctaaccaaggttacctgttgcctggcctgccccgcccttctcccttggccctcttcctttctcctctccccgcgcgggtgtttgcgcgtgtttagagggccatatgccacctgtaaagcttgaacaataaaacatttgtgcacattcacatgtgtgaatttttttccttcttt

SEQ ID NO: 74915 - DNA, 73 bp, Zea mays
  Clone ID: LIB3079-047-Q1-K1-B2
tccctctctacccacgcatccaaccttctcctacccaacctatcctctttaaatttctctatcctatccaaaa

SEQ ID NO: 74916 - DNA, 440 bp, Zea mays
  Clone ID: LIB3079-047-Q1-K1-B4
gtgttctttgatggacatcagcctggtatacatttccctatgctggtactacgactagatgttgatctttatacatgggggttccatgtgttacaatggctggtgctgttcatgctcataacgttggtgtcagcttgctcagcaaagtcgggttggggaggctggttgccaaaactgatgatgagtatgtgagcctagcgttgtatttggctttttattgttatgtccttcatgttctgtttatgtcttttttgtagctttttatttattttttttttttttatttttttttttttatttttttttgttttattttttttaattttttattttttatttttgtttttttttttttttttttttattttttttttttttttattttttttttttttttttatttttatttttttttttttttttttatattttattttttt

SEQ ID NO: 74917 - DNA, 435 bp, Zea mays
  Clone ID: LIB3079-047-Q1-K1-B5
gttccacctgcgctcgatcatctctgtaggtgtacgggcccgtaacatatgcccatgtgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctctcatctagcgtgtgaagctgcttattcataaccaagattatgattattaagtcttgtatgctttcatagcctttcaatgttattgttgtctgctttaaacttattatttttgttttatgttttcttttttttttttgttttttatttgtttattttttttttattt

SEQ ID NO: 74918 - DNA, 293 bp, Zea mays
  Clone ID: LIB3079-047-Q1-K1-B6
ccgatcgccgtccccgaccgtagcgcatgactgaggatgagtgaagaggagaaggcgtctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatactagcttgacatgaaaactggactgattaaggttgatcgagtcctttactcatcagttgttta

SEQ ID NO: 74919 - DNA, 428 bp, Zea mays
  Clone ID: LIB3079-046-Q1-K1-H12
gattcccggctgcggcccacgcgtccgggccacctcgcctactcccacaccaactaggcgctcctccgccccaggtcgttgctcgtccaaattcgaggtgtgctggctgttccagggggtgcttgacaacctgggtcgtcttagccagcatcactttctgttattcaagttcgctaactagtttcttttttttatctattccttcaattacttgcttctattattctcttttttcttttaatattctatttatttttatctttatttatttttaacttctttatttatttacttcttttttcttctattattttttttttatttattttttttttatattttcttttttttttttttttttattcttttttctttcttatttttttttcttttttttatttttttattcttttttttatctctatttt

SEQ ID NO: 74920 - DNA, 116 bp, Zea mays
  Clone ID: LIB3079-047-Q1-K1-B7
ggcaacctccacctcagatttcgtcctcctgctcctcgccgccgccgccggcctacgtctgctccccggctcgctggcgtggcacagcagcaactgtgcaccgggcgcgcccggca

SEQ ID NO: 74921 - DNA, 375 bp, Zea mays
  Clone ID: LIB3079-047-Q1-K1-B8
tcaggatcctattgccctcacgctaccatttccgccaattcatcacagccaccagacttcgctcgccttacgtatacaccaacccacctccataaaccgtatgcacagccaccttaatggtatctcttcatcttctctttcctacaacaggactacttccatctagctcatgacagataccaccttatctacattttctcatcctgtattgctaattttatctccctatttcttcttttttatttttttttttttatttttttattttttatttttttatttttttatttaatattattatttgttttatttttttatttttatttttttttttttactttttttcttttttattttttttatttattttttttt

SEQ ID NO: 74922 - DNA, 453 bp, Zea mays
  Clone ID: LIB3079-046-Q1-K1-F12
gtgcaagggggaaccaaacatatcatactatctgctcgcgatactatagggctccaggtctcatatttggtgccacgtgagtataccacagcgattgacatttggtctgctggttgtgttcttgctgagcttatgctagggcagcctttgtttccaggtgtaagtggtgtggaccaactcgtctaaatcatcaaggtccttggtacttcatcaaggtaagaaattaaatgcatgaactctatttacacatattttatgttcccacatttttatgcttatctatttctcatggttttctgcatttggtttccttcttttacttttttttttttttttatttttttttgttctttttttttttttttttctttttttattgattttttttttttttttttttttttattatttattttttattatttttttttattttttttttttttctatttt

SEQ ID NO: 74923 - DNA, 245 bp, Zea mays
  Clone ID: LIB3079-046-Q1-K1-F2
catgtcattgaacttggaggctccttccaaataattaatcatacctaggttaagcaatttgtaaatagacaccgcgtttcgggttgtcggtggtcagcattcctccttttgaagatgcttgtgatgatatgagaaatcaggtttggtaggggctgctgcctgggcaagtggggtttgtgcatatggtcccaggtagtatggtcgcacatgtctgctcacagattctgtttaatgaaggaattttt

SEQ ID NO: 74924 - DNA, 237 bp, Zea mays
  Clone ID: LIB3079-046-Q1-K1-F4
aattcctggaccgacgcggtgcgcccaggcgttctaaaaccgagaagagaccattcctaaggaaaacaatcctgaaaccaatccgttggtctgcatgaggaatttgaggagcatgctaagaaggcaaagaccttgcctgaaagcacgagcattgagaacaagctgatcctttacggcctctacaagcaagccacggttgaagatttgattaccaatcgtccggccttattttaccaa

SEQ ID NO: 74925 - DNA, 429 bp, Zea mays
  Clone ID: LIB3079-046-Q1-K1-F5
acgaggcgttcggctcatggcatactatatcttgaccccttcgaggttctcgaccaggaaggacttttttagctggttaagcttgctacacagaggggccgcaaagctaggcctaacttgaaggtcggcatttgtcgagaacatggtagagagccttcatcggttgctttcttcgccaagactgggctggattacgtttcttgctcccctttcatggtcccgatcgctaggctagctgcagctcatgtgcttgtctgaggggctgcctcctcgttggcagcctgctgtaagtgcatctggtgattaataatactactatgacagatccatatgctctgtgaagagtattagtagcagcgctcataaaatctacaattacatctatattctcaactatgtaaaactttcaaactgttcatgcttaaaaac

SEQ ID NO: 74926 - DNA, 329 bp, Zea mays
  Clone ID: LIB3079-046-Q1-K1-F6
tctcatggcatcctccagttataccccttcgaggttctctaccagagagggagttttctaactgtttaatcttcctacatataggggcctcaaagctaggcctaacttgaacgttggcatttgttgagaacatgatggatatccttcatctgttactttcttctccaatactgctcttgattacttttcttgctcccctttcaacttccctatcgctatgctagcttcatctcatgttcttgtcttatgtgcttccttactttattcaaaccttctttttgttcatctttttattaataatactactatcacatatccatattcctctt

SEQ ID NO: 74927 - DNA, 391 bp, Zea mays
  Clone ID: LIB3079-046-Q1-K1-F7
acaaaatcatcaaaggattccaaagaaccgattccatcaaaagatgcaaagcaaccaaggccgtcaaatgatacaaaggagccaaagccaccaaaggtttcaaagtcacccaaggactccaaagaacagaagaaggcaacgctgaaagatccgaagaaagcaccaaaggattctaaaggactgaagaaagcgcttaaggatccgaaagaacaggaatcattggaagacccaaaggaacatacagcaaagaaggccggcaagcgtgtgacgttcgccgaggtggagcctgagaaggagctcaaggcctcgaacagtgactggcacccatcctctgatttccacgcggcgtaccctgagcagaacccatgggctagcggctttatgatctttg

SEQ ID NO: 74928 - DNA, 259 bp, Zea mays
  Clone ID: LIB3079-046-Q1-K1-F8
cgacccactcttcctgaccatccacattcatattcaacctattacttcaagtatagagtatagagctctacacggacgattatatttatacattttaaccaaccccaccaaaggtttcaaaatcacccaatgactccaaagaacataagaatgcaacactcaaagatcctaagaaagcaccaaatgattctaaaggactgaataaagcgcttaaagatcctaaagaacattaatcattccaagacccaaactaacatac

SEQ ID NO: 74929 - DNA, 136 bp, Zea mays
  Clone ID: LIB3079-046-Q1-K1-F9
aagaaactgctgctgagatggtttactactcgcttttggtgggctcaaaaacttagttttcttttcaacctgcagcccacctccccctgctactaccccatcttcccctactacctcaatctcaagtactagaact

SEQ ID NO: 74930 - DNA, 441 bp, Zea mays
  Clone ID: LIB3079-046-Q1-K1-G1
gtcggcgtggctggttgccaagaacaccctttggatcatgccctgcaagctcccgcccttcgaccgttatgatgtccgcgtgcgcatgactgcagaggggatttgcggcagcgatgtgcactacctcaaggagatgcgcatggtgcacttcgtggtgaatgagccgacggtgaacggtcactagtgctcagacactgtcgatgaagttgcttcgctatggacgcatcgtactgctgcaaatggagtttcgcattgtagctgataaagtgcctacaaggtgcatccatatgtgcataggtggcactgaatcggggctcactggaccagtttgatatttgtagtaatatatatacatgtgggagcaacataatttatgtttcgatcatcattatccaatttgattccctgttataatggatcacattggaaaaacccttacat

SEQ ID NO: 74931 - DNA, 458 bp, Zea mays
  Clone ID: LIB3079-046-Q1-K1-G10
ggatcctcatgatcctctgcgtttctttcactgttggtttccgtaacaccaatcagatttttttatcacatgtggcgtggccgtgatcacggtgatgctggtgaccacgtgcctcatgcccctggtgatcatgctgtgctgggaccgctccccctggctgtttctcgccttcttcctcttcttcggctccatcgaggctctctacttctcggcttctcttatcaagttcctggactgctcgtttttgcccatccttctggcccttattcttctctccataattttcttttatcaccatatcattattatcattttcgagtactacatttcacaacattttttccctttttttttcttcatttctcttttttacatatttatacatttttattcttttatatttattcttatttttttttatctcttttttaatcttttttatttcttttatctttttt

SEQ ID NO: 74932 - DNA, 167 bp, Zea mays
  Clone ID: LIB3079-046-Q1-K1-G11
gacgtcatgaggccctcgccgacgtgttacgccacgcgtcctccatctccacccctgctcggtgtgccgaagccggtggcaaacggaggcgatgtggtggcagtggcagagtcaggccccgcgagctgggatgaggtggctaggctagtgctacgcatagactcagc

SEQ ID NO: 74933 - DNA, 248 bp, Zea mays
  Clone ID: LIB3079-046-Q1-K1-G12
cgcacgcttacgctctgacatcaagattgcactcaataatgaaatagagcagcgtcgcttagttttccaagagctgaggaccacccttaagaagcagcacgaagatgtgtcacttagcttgaagaatttgtggcttcaagatgctacctaaaatgatgggaacaaaggaaatggagactgcacaaatgaggtcttgtcagctaacttggggaacttgaaactggatgtttcttcttaatactattatt

SEQ ID NO: 74934 - DNA, 391 bp, Zea mays
  Clone ID: LIB3079-046-Q1-K1-G3
gtgctctaaccactcgcttaagctctctatataactccagcctgttgccttcttccaaagcggctgtctcccccataaataaagcagctcctccgggggcggcgaactactcctcgtcgccaaaaccctagccctgcttctttgccatggcgagcagcgctagccaggctagcctcctgctccagaagcagctcaaggatcttgcgaagaaccccgtggatgggttctccgccgggcttgtagactacagcaacatcttctagtggcatgtcaccatcatcggaccccctgacaccctatatgatggaggctacgttaatgcaataatgacctttccccagtactattccaacagcccgtcatcagtaagatttacttctgagatttggca

SEQ ID NO: 74935 - DNA, 293 bp, Zea mays
  Clone ID: LIB3079-046-Q1-K1-G4
atttccgacccgacgcgtccgcttatcttggccttgcgtgatgattcaagttaagttaggagaagatctttgtcgtgtatcagatgtgctgctaagacaaatcattcagctcttgctacacatcactctatattgggcccggcaattgctgaagctttgaaggactctagcatgcctgtacgtctagctgcagaacgctgctcccttcatgttttccagttaacgaaagggccagataatgttacagcagcacaaaagtaccttgggatgactggcttggaagtgaagaaaat

SEQ ID NO: 74936 - DNA, 371 bp, Zea mays
  Clone ID: LIB3079-046-Q1-K1-G5
ggatggtagagctaataaaatcaagagtattatgattctactcctgaaacccatgagtggtggatgcattaagaaatcccaagtaggaatgcaggcattgcacatgacttcacaggaacatgccgctccttgagccgtgataggaatttcactgaatcggtcccattctctagtatgagaatgagacctggtcattcttctccaggctttccactccaagcatcacctcagctatgcactgcagcagttagggaagcaaaaaaatggttggaagagaaaaggcagggactgggcgtaaaacctgaagacaatggatcatgcacattaaatacagatatatttagttctcgtgatgactctgacaagggttc

SEQ ID NO: 74937 - DNA, 320 bp, Zea mays
  Clone ID: LIB3079-046-Q1-K1-G6
tcctgaattcccgtttcgtaccgacggacgtcgtgcgggatggtatagctaataaaatcaagagttattatattctactcctgaaacccattattgtggaattctttaagaaatcccaagtaggaatgcaggcattgcacatgacttcacaggaacatgccgctccttgagccgtgataggaatttcactgaatcggtcccattctctagtatgagaatgagacctggtcattcttctccaggctttccactccaagcatcacctcaactatgcactgcagcaattagggaagcaaaaaaatggttggaagagaaaaggc

SEQ ID NO: 74938 - DNA, 233 bp, Zea mays
  unsure at all n locations
  Clone ID: LIB3079-046-Q1-K1-G7
gttgactctngtccacctagttcaccatcatgaatgaaagatcagtgagcaaccggcggtgtctttaagactaatcgactgtgcgccctaatacaagaaagtcgtatcactcgatagcaaacccgcacatggagtcaaactgaatcggacncattcaaccaactgagaagagaccattcacatgctcaatctttaactcaaacttacctatctatcaactcacatcagagcgc

SEQ ID NO: 74939 - DNA, 241 bp, Zea mays
  Clone ID: LIB3079-046-Q1-K1-G9
cgtgagtcctcttcagtctccactcctttccagaagtcaccaaccttccctagcctgcactctttaacagccgcgtcccctccaaggtagcccaatcgaaaccactcgcccggccaccatggcctttgccagctcgctgcttcccgtgcctccctacctcttctgcgctacccccgcgtcctacgtctccttcttctttccgcccattaacatcaactcgctcttttcttctcgccaactc

SEQ ID NO: 74940 - DNA, 302 bp, Zea mays
  Clone ID: LIB3079-046-Q1-K1-H1
cggacgcgtgggtctacgttggactggcatgtcctacagaattttgtttgggttatggatagggaggctgttacattattggataagtggttacccaggcatgccagttgcagtcttccaacattttttgataaggctgagaggttaatcaccatcaattccacatccagcagtgattgatgcctggttcagtttttcagctccttcgacttgtgttttagaattcaaaagtgcatcactgtggactttttggtgcttgtctagaccatgtatcttctatggggatcgacatatgtgatgtt

SEQ ID NO: 74941 - DNA, 149 bp, Zea mays
  Clone ID: LIB3079-046-Q1-K1-H10
tgggcaatggagaatctggtgtatatcttaatgataatttgcacaagtcatcattagtacatacttaactgattgatactgatccaagtgtgaactttcacgacaatggtggcctctctgtgtcttcgtctcaaaattcacttgtgtac

SEQ ID NO: 74942 - DNA, 203 bp, Zea mays
  Clone ID: LIB3079-046-Q1-K1-F1
cctctcacaaccatccacctactccatcctcaactaccgcttcaaaccatccaaactcaccctcaccaacaaaatccataccatactatccacacacgctctaaaccttctttcttaaaacgtactccattatctaccttcagttcgtgctcaccattgacttaaacaacaccgtataccatatcaccccgatcccactctta

SEQ ID NO: 74943 - DNA, 235 bp, Zea mays
  Clone ID: LIB3079-046-Q1-K1-C1
tcgatcgagaagtggcatagaaccgtctcctgctattcttctcaaagccactcccagatccttactgtgatgctcaatagaagagaggtgtccgccgtccccgaaacgatcaacgaaagacatgctcagactaatatcatcaagcttgcaaataatatgcatttctccattcccgagatccgccaattcaaagctatcacccaccatgacacttgcatgttccgacattaacgct

SEQ ID NO: 74944 - DNA, 380 bp, Zea mays
  Clone ID: LIB3079-046-Q1-K1-C10
ccgcactcgtccgctgctcgcctctcgttccgaagcttctcctctcgcgtatcctacgcagttttttaaagacccggggagcggacctgttctaatctctcctctcatctctctctctctccttctattctatatcatctttttatgtctattttcattttttttctttctattctttattaatttttctttacttttttttctattactttttttattttctatttctcttttttattttttttttttttctcttttcttataatcttctttttttcctcttttttttttatttttcttcttattttctttctttctttcttttattttcttattctctttcttttatttctctcttctttatcctttttttatctttt

SEQ ID NO: 74945 - DNA, 277 bp, Zea mays
  Clone ID: LIB3079-046-Q1-K1-C2
gctgtgtgttcaaacagagggtacacttcatattgtctgatagaatacaaaagggaactttgtaagttttcagtcaagtaacttctgtagaattttaaaagagcaatactgtaactgaaatgttgctactactttacatcagtttcatcctggggcatataattgcaggtaccctatctatagaatcccaactggaccaacactcaaggatttggatgcatgtttcttgacatttcattacttatcaacacctaccaatgatactgatcccagttca

SEQ ID NO: 74946 - DNA, 362 bp, Zea mays
  Clone ID: LIB3079-046-Q1-K1-C3
cggccgtcatacacctcacgctccccctcgcttgcattctgtgaccccaaaagccttctcttgatgtgtttaatggatctggactacatcaactcactcattggtggaggcttctcttttcagaatccaaacgcatcaaaaacctgtatgtgcggcaaatctttcgcgactgcgaaggaattcgaggctgcatcaaacgcttgctacatctagagtagtcaaatattgatagcaaatcgtgatgtaacttgttatatatctttgttctgatcaaatcacgtagcttcaccacttatacttggttcgtttcaaaatagttggctttgtttttattaacatgtttacttttttaatatttttct

SEQ ID NO: 74947 - DNA, 360 bp, Zea mays
  Clone ID: LIB3079-046-Q1-K1-C5
taggaggtctttaactactcatacatttcatttgcttgacatctgtactgattctcccgctcgtttcaattctgttgtttatatcacatatggaatcaaacttaaatattagctattacaagaaatcttgactcattaacttttatcgagttctgtactcataatttctatactctcacaattatgatcacgttacaaggactcttcgataacacaatcacccaattcatgtattactcctcatgcaataacctgctgttactggatcgtttctaactgcaataacaatcaaacttattcccatgattcaccaaagtgaaaagtatcacaagataatagcaatctgtactaataatcctt

SEQ ID NO: 74948 - DNA, 192 bp, Zea mays
  Clone ID: LIB3079-046-Q1-K1-C6
gacccactcttcctagtaggtccttaactactcatccatatcatgtgccttacatctgcacttattctcggctcgttcatttcaaatttttatatcacaaacccaatcaaacttaaataatatctatacaagaaaacattactcattaacttttacacaactccttactcataatttctataccctcacaat

SEQ ID NO: 74949 - DNA, 241 bp, Zea mays
  Clone ID: LIB3079-046-Q1-K1-C7
cggacgcgtgttctgactcgtgggcatttatatagagggtggaacctgaatctttacgtcggtcccctttagtacctcgtcatccaaaatcatatatggagatcatggaaacgatacaaaagggctagcgtccatactatatacagaatattaaccacaaccctccaaatccttatcaaccaatctcataaccccatatctcaccgaaaccacaaccatggtaaaaacatggtcaaggtaa

SEQ ID NO: 74950 - DNA, 346 bp, Zea mays
  Clone ID: LIB3079-046-Q1-K1-D1
cccactcgttctcccactcttcttctgatccggctgatccaccttctgagtggggttttttcctatcacaattccatacctcttgtgaattgcataatccctcgaaccatctagtttttgaactctatttgcgcccgaagccttctggcgaatgtcacgtctacctgtacgttacaccaaaagacattgtataataaaataaagatatctaaaactataaaattcaatacattataatctattaactcattcaaaaaaaaatggtcacatgttttataaaatccatttttacatccccttacatccgccttaataatttttttaatggttccctaaatttaattta

SEQ ID NO: 74951 - DNA, 382 bp, Zea mays
  Clone ID: LIB3079-046-Q1-K1-D10
gattcccgcgggagccacgcagtccggggagacgatcccacctcgcctgttaatcgcatcccaagacttcaaccttcctttgcatcttgtgatacggttcgcatgtccgcgacagatccgggcaaacgggccgatgcagttcttcggctgctcgtcgctgacgtcggtcgcgctcaatgcttctttttttccttctttttctctataatttttttcttttttttatttttttttttttattatatttttttctttccttcttttactcttctttatcttttctctttctttttttattatttttttttttttttttttcttttattttttggtttattaatatttttttctttttattttttctatttttttattttttttt

SEQ ID NO: 74952 - DNA, 336 bp, Zea mays
  Clone ID: LIB3079-046-Q1-K1-D12
ctttctctccttccttattaaggactttaatttccatctatcgctgcatttttatacattccagcagcccacaacttcacatctcaatatacatcacaattttaatccatttcacattttcaatcataccattgaattcttcctcaaccttcaaattctaattcctccaaatcatgattatcaaatatctatcctgaacattgtatcttttaaaacttcaaattccccatataactcatacttttttactactttttctaataaatcactatacatatcacttctacatattcacataattctcatcattccaaacaatttacttcctttttatta

SEQ ID NO: 74953 - DNA, 285 bp, Zea mays
  Clone ID: LIB3079-046-Q1-K1-D2
ttcccggtcgaccactcgtccgagttgatcatttctgcattaataactctagtagttgattagttcttaggatcgtaaattaggtggtaggaatgtaggcaagtaccattccaaggaattgaaagagagctaagcctaaggaagagaatagcaagaaaaaaaggaaatgttcagtgttaagcttaatgttttgtcacgaggacacacttcatgcataattgttacgttctaaatttgatccatttggtcttgtgggtttgattacattacagttctgcacatacc

SEQ ID NO: 74954 - DNA, 230 bp, Zea mays
  Clone ID: LIB3079-046-Q1-K1-D4
cacgcgtccgatggactttcgctgtatctgtatgatcgccagcttttatctcaacttcagccgggtggatcacaccagggaccacgtagtggtgcacgacgggtccgactgtagctgctatcatagtgctgcataggacgcgagccagtatctgtaaggatctatgtatgtctatactacgtcctactcgctgtgactcgtacgcttctcctccgtctgtgactgtcata

SEQ ID NO: 74955 - DNA, 396 bp, Zea mays
  Clone ID: LIB3079-046-Q1-K1-D5
gcacgcatctcgggaccatggcacctttacttatcacacaccaacatactacgaatagcgttgatctctctgtgttctgcctctgcccgttgggctgggcaccgtggagtcccaggctagtcgaagccgtggtctttggctgcatcccggtgatcatcgcagacgacatcgttctccccttcgcggacgccatcccgtgggaggagatcggcgtcttcgttgcagaggatgatgtcccgcagctggacagcatcctgacatccatccccacagacgtcgtgctgaggaagcagcggctccttgcgaacccgtcgatgaagcatgccatgctgttcccccagcctgctcaaccaggagatgcgttccaccagatcctgaacggcctatcgcgcaagc

SEQ ID NO: 74956 - DNA, 188 bp, Zea mays
  Clone ID: LIB3079-046-Q1-K1-D6
attcccggtcgaccgactctcgcaaagcaacctctatgacatctttactatcaccacacatactacaaacgtgattcttaatctccttcccttgctgacacctgatcagctgtcaacctgtcttgctcatccgtgatcatccaacacatctctccttccgaccatcctgtatagatctcttctcttca

SEQ ID NO: 74957 - DNA, 216 bp, Zea mays
  Clone ID: LIB3079-046-Q1-K1-D7
ctccgtctctcgtgggcgtggcactacttttatgccatcgctgccgccctactccaggttgccatatcatctgcggccccttcgcctgcgactatcaccatccatcataaatagcatcaagcactcgaacttacagcgagattgaaaatgatagaaggcaactacatcagatcgatccaagaagaccccattttccttgctgcatactatgtactc

SEQ ID NO: 74958 - DNA, 186 bp, Zea mays
  Clone ID: LIB3079-046-Q1-K1-D9
attcccgctggacccactcatccggactcctattagtgttccctctttattctaaaccttgaggcttgtgaacacacaagtaattttttctaacactcgtacctcttaattgtaactgattgccatctcataaacttcttatcaacatctctttttctcaagtgactgcgaattctatcctttttt

SEQ ID NO: 74959 - DNA, 133 bp, Zea mays
  Clone ID: LIB3079-046-Q1-K1-E12
tcgcctgaccagcaacggctgatctttttcggcaagcagctggacgatgatctcacgccttttttaatacaagcttggacagccagagcaccctccacttggtgctccacctcatgtgtggcattcaaatctt

SEQ ID NO: 74960 - DNA, 217 bp, Zea mays
  Clone ID: LIB3079-046-Q1-K1-B9
tcccgctgcgacccactcatcctatgagatttcaactgatcttgcttatatatctcacaagtttcagaaatttctcagaaatttatttaatactttgccatccccttatcttgattttctcctattcttttttctttttattctttttatatcttcttctcttattctcttatttttttttttttttactttttttcttatttattttctttttttt

SEQ ID NO: 74961 - DNA, 68 bp, Zea mays
  Clone ID: LIB3079-046-Q1-K1-E3
ttttagtttgaattaagtacatttatgtaagagttatttgacagcgattatgaaatcgagaattatct

SEQ ID NO: 74962 - DNA, 284 bp, Zea mays
  unsure at all n locations
  Clone ID: LIB3079-046-Q1-K1-E4
tctgactcttgttctgactcttggtctggggtagatatgggtctctcctttgggaagctgtgancgctttcttcgccaataaggagatgaggattctcatggtcgagctcgatgcctcctgtaagaccaccatcctctacaagctcaagctcgtctagatcgtcaccaccatcctcactatcggattcaatgttgaaactgtttaatataagaacattatcttcactgtttgctatttttgttgccatgacatgatcatgccccttttgaagcactacttttat

SEQ ID NO: 74963 - DNA, 382 bp, Zea mays
  Clone ID: LIB3079-046-Q1-K1-E5
tgcattgtctattcaaataattgagttttcatttaggtatttgacttcattcttattgagtcgaaattataaattatggtcttcttccatcactccaacatattttgaaaccaaccatgaatcaagaattagtttcttaatccctatatctgattcatttagactgtatcctactgcatatgatatattgttaggttctatctatgatccttcttactactcttcactgttcgatgatgtcctaaacaatgcatgcaatcatcaaggtgataaacaaaattttagtaatgacaattgttcaacatcttcatgccatacaccactacttaaatcttttgctaatgatgtttaaagttgactaaaaataccctttaacttctat

SEQ ID NO: 74964 - DNA, 274 bp, Zea mays
  Clone ID: LIB3079-046-Q1-K1-E6
gcatggtccattcaaataatcgggctttcatctaggtttttgtcttcattcttattcgttcgtattttttacatacatgtgctactcccatcactccaacatattttgaaaccaaccattaatcaagaattattttcttaagccctatatctgattcaattagactgagtcctactgcagatgatatattttgaagcttccatctatgatccttcttactactcatcactgttctaagatgtcctaaacaatgcatgcaatcattatggtgata

SEQ ID NO: 74965 - DNA, 183 bp, Zea mays
  Clone ID: LIB3079-046-Q1-K1-E7
ttccctggtcgactccactcttcctgcttctgcttgctctggggggaaggagtgagttagagctagagagagatctagtataggatgtatctatttagtcctcgaacgaacatgttcgctgtcttcatctttcacctaccagtatatcactaattattttcttaaaccctatatctttttcat

SEQ ID NO: 74966 - DNA, 146 bp, Zea mays
  Clone ID: LIB3079-037-Q1-K1-H1
gtttatgtgatgtggatctatcattgtgcaatactaattaaatttgtataaaaaaaaaaagaaaagaaaaaaaaaaaaaaaaaaaaaaaaaaaaaaaaaacaaaaaataaaaaaaaaaacaacaaaaaaaacacaaacatacaaca

SEQ ID NO: 74967 - DNA, 395 bp, Zea mays
  Clone ID: LIB3079-037-Q1-K1-H11
cccacgcgtccgcggacgcgtgggcagctccaagagagcttgacaaatcacctggttctgtgcgaactgctgcctggcttcatagtgaccaaactatattgagttcctgcactgacatgggtggagtaaggctatgggatgtgagaacaggtaaaattgtccaaactcttgaaaccaaggcttctattactagtgcagaagtaagccaggatggcaggttcatcactacagcagatggctcaagtgtaaaattttgggacgcgaatcacttcggccttgtgaaaagctatgatatgccgtgcaatgtggagtcagcttcacttgaacccaagtctgggagtaaatttgtagctggaggagaagaatttggggttcatgtattcgatttcttcact

SEQ ID NO: 74968 - DNA, 255 bp, Zea mays
  Clone ID: LIB3079-037-Q1-K1-H12
gcgccacatcacccgactcctggacgaggacggctaaccggccttcacgctcggcaacagggtcagctgctacgcgctgaagcactggacagagcatgtccaccccgtcaagctagagccctacaacccggactaccaatacgagtacatgctctggacctagagcctctacatccgcaactgctatcgctgcgtccgcatggtcaacaacatctaccttaactactacgccttacacggtgacgaggcccactg

SEQ ID NO: 74969 - DNA, 401 bp, Zea mays
  unsure at all n locations
  Clone ID: LIB3079-037-Q1-K1-H2
aaattttcttgggcgttcttcggcttcgttgtcacaaggttcgagttcgtcaccgtctagtgcgagtgtgcgagggaggaagaggcgaggagaagatgcagatcttcgtgaagaccctgacggggaagaccatcaccctcgaggtggagagcagcgacaccgtcgacaacgtcaaagccaaaatccaggacaaggaagggattcccccagatcaacagcgactgatattcgctggcaagcagctggaggatggacgcacgctggctgactacaacatccaaaaggagtcaactcttcatttggtcctcaggcttangggtggaaccatgatcaaggtcaaaactctcactgggaaagagatcgagatcgacattgaacccactgactcgattgacaggatc

SEQ ID NO: 74970 - DNA, 401 bp, Zea mays
  Clone ID: LIB3079-037-Q1-K1-H3
cttgcaccgagctagcagccaagatggcgaccaaacacctggctctttgcctccttgttctctttagcataggcatgggcatggccaccgctgctgcaaaccgcaaactgggttatggccccgggggaggaggtggcggtggtggtagcggtggcggtggaggcggtggttacggaggaccaggctatgggtccggatcagggtatggtgagggcggtggcagcggaggtgctgctggagggtatggacatggtggtggcggcggcggcggtggtggtgagggtgcgggagctggtggctctgggtatgggtccgggcaaggatctggctacggagctggcagcggtgctgccggtggatatgggagtggcggaagtggtggatgtggcagccgtcatcgt

SEQ ID NO: 74971 - DNA, 130 bp, Zea mays
  Clone ID: LIB3079-037-Q1-K1-H4
aactttatgagcaaaaaaaaaaactgcgttttattcacgtcaatcatcgcctccttcgaggacgtcatatatacatgggcagtgggcaccgatgatatacaccatcaaactgaataacctccccgggaaa

SEQ ID NO: 74972 - DNA, 434 bp, Zea mays
  Clone ID: LIB3079-037-Q1-K1-H5
cccacgcgtccgcccacgcgtccgcccacgcgtccgcggaggtcgactcgtcccgcagcgtgcaggaggtcccgccggcgaactcgccctgcgccgcgtcggaggctgccgtgcacaagccggtgatcagcgtcaacatcgagcaggaggtgaaggtggacgggaaccaaatcatggacatgtacatgaagagtatgcagcaattcacggattccctggccaaaatgaagcttccagccttggacatagacaacggtagcagcgggaagagcagtcccgcagcagccacacccagcgcagactccactggtgccgactcgaccgcggtgaagaagccgaccgccgccgggcagcaggagaagccctctcccaaggtgttctacggcagccgggcgttcttctgatctccggttcgctgatcagcggtagcacac

SEQ ID NO: 74973 - DNA, 414 bp, Zea mays
  unsure at all n locations
  Clone ID: LIB3079-037-Q1-K1-H6
gagccaatacccctcttgtcatccttggcacgtttccaacaggtctggctttgctcatcgagaagaagagcaggaggattgagatatccctgtactgtcttgccagagctatcgagagttttttcacatggatgaccgatgcaggactctgccctccaatacttcagataaagcgagctgatgtggttgtgttcagcatagctacctctatcattatgcactgctatgcgcaggaaagagaagtcttccggtccaagtacctgaatgtgctggactgggtatttggtgtgccgncaccacccgacagtgaggataagaactgctatctaccagatgaagccaggaaatgccagtgacatactggctggtanagttcattgcatgattttggaatggccacccatgtgatcctag

SEQ ID NO: 74974 - DNA, 321 bp, Zea mays
  unsure at all n locations
  Clone ID: LIB3079-037-Q1-K1-H7
cgtcccggggccatgcccaacccgaccccagcagcgcctcattcttcgcgcggcaaggccagctggtaggatgggccgcgacccatggtcggattaccaagcatccagaagggagaaagcactctccagcctggtgctccgcctcaggggtnggcatgcnagatttttgtgaagacatntgactggcaagtaccattcaccttggaggtgngagaagctctgacatnccattgacaatgtgaagggccaagaatccaggacaatggagggcatgtcccccagaccagcagcgtctggaatctttgcgggccaagccagctg

SEQ ID NO: 74975 - DNA, 224 bp, Zea mays
  Clone ID: LIB3079-037-Q1-K1-H8
aaaaaaaaaacaataaaaaaaaaaaaaaaatcttaaacaacaaaaaaaaaaaaaaaagaacgagaaattacaaattatcaggttcctatcttacgcactccttcatctctacttcttacttattatatataatcacctacctacacttcactgtactcaactttactacaccctaaattgtaaaaacccttgagttacataccttattctccttatattatatc

SEQ ID NO: 74976 - DNA, 346 bp, Zea mays
  unsure at all n locations
  Clone ID: LIB3079-037-Q1-K1-H9
tcccacgcgtccgcaccaccatctaaaacgtgttttctacccatcccattatcttcccccgtgctacagtcaccacattctgatccgggctanactcctatatccttcatcttaaccatctccattccttcgattccatccatccctaatatctcaacaccttccactctcttcatacatctctctctttctctattacgactcattatccatctcttctttacttttactcttcctcctcttcttctcttccaacgtactaactcaactcacctcttccttcaacataccttttctatcccataacatctttcaatacatctccttatctacaattattaactta

SEQ ID NO: 74977 - DNA, 323 bp, Zea mays
  Clone ID: LIB3079-038-Q1-K1-A1
ccctgggctgcactgcactggtcgaggctccagctaaagccgcctgtagctgtagcaacagcgacagagcttactctggattccttcgcgccgacaacgcgctgcagcatcaggggcacacactaatactagacgcattctcaggtccgtatgttccacagggcacaacaacacaatgggagcctgcaccttcctaaaggccactgacgtggaaagcgctccggggtccccagttacccgatgcgaaggtaggtgctgcttgaccgcgcgctgcggaagttccctggccgcacgcgggcgtcccatgccaagaaagcgtcagc

SEQ ID NO: 74978 - DNA, 256 bp, Zea mays
  Clone ID: LIB3079-038-Q1-K1-A10
ctttccggtcttgacctctcttttctggatttatcttatgttgatttcacgtgtgcttttcataaaaacgggcttttttcacgagcataccttcaatgtacaaagtttcgagatgttgatgccgaaggctccatatttcacaatgcaactttgcgtgaatgttaatttactgcgccaaatcttcgtggggctttattagctgttgcatgccttcatagtgcaaatctataataagcttgcttattatactttaact

SEQ ID NO: 74979 - DNA, 438 bp, Zea mays
  Clone ID: LIB3079-038-Q1-K1-A12
gaccgccgtatcctctgctcgtatggcgtcgccacagcagggaaggcgtcgccatggcgttggaggttggcaaggcgggcgctgcgtctctacgcgcgcggaagacgagtgggggagcagcgcgcgggaagcgggaaatatgtcattgactgcgcgggaaatgagttagcgagcgcgcgacgagcagcatcgcgcagcagcaccttggaattcggcgcggttgaagagaatatagatgggcgtcagcgccatgctttcataggtttaggcttccgggaaagacctgaagcatatgacttccaagctgccctacatgatcatatgaaatatttaaacaagaagaaagcggctgaagagatgattcagcattatgagaagcaatcttcagtggattacaggctcaaagaaggtgagacattggttcttcagcttaaaaat

SEQ ID NO: 74980 - DNA, 313 bp, Zea mays
  Clone ID: LIB3079-038-Q1-K1-A2
aattcggtcgaccacgcgtcgccaccgtcgttgttatgcttctggggctggtgcttatcaacctgctacacaacaatctgtgttgggcagtttaatggacacatggacaacataagacgaatttggctctcaagcaactcagatttgattcacaatgagccgattcctagacatcagtggagatgtataagtgcatctttacactctgattgatggacaccctagtggtccaattttggaacggattatcttatatggttttgaccagattctctaattcagcttttcagattgacaagatttagcaaagcgc

SEQ ID NO: 74981 - DNA, 225 bp, Zea mays
  Clone ID: LIB3079-038-Q1-K1-A3
ctactgattgcttctcaccaccaactcactgaatcagaaagaccacacactaatactatacgcattcttaggtccgtcagtctcacaagccacatcaacacattggtagcctgcacctaccacgaggccacggaggtggccgaggcgcccgtgtcgacggacaccgacgctacgaccgttctggcggactgcacgctgctgcggatcccttaccgcacgcaggcg

SEQ ID NO: 74982 - DNA, 354 bp, Zea mays
  Clone ID: LIB3079-038-Q1-K1-A4
cccacgcgtccggcaccacgcgccggctctgctccacgcctggctcgcgcagaagtggttccgggtgtcgccgatcgtcagggccgagcgcgacgcgttcaccgccaaggactgggagatcctcaccgcgctctggaggaagcagcgcgagagcggccaggtggacccggccaaagcgacgcagcaggggacctacgagtcgctgtgccgcgacgcgacgatcctgttcggcacgtgggagttcgaccccacggagatcgagaacccgttccccgacggggagggcggcgtcagcatctggcaggggcgccaggacaagatcgtccaggtggagatccagcggtacgtggcgca

SEQ ID NO: 74983 - DNA, 221 bp, Zea mays
  unsure at all n locations
  Clone ID: LIB3079-038-Q1-K1-A5
cgcccctggactgcactgcactgctcgaggctccagctaaagccgcctgtatctgtagcaacagcgacagagcttactctggattccttcgcgccatcaacgggctgcagcattaagggcacacactaatactagacgcattctcaggtccgaatgttccataggccacaacaaaacaattggagcgtgcacctntttacaagccacggacggggaaaacc

SEQ ID NO: 74984 - DNA, 69 bp, Zea mays
  Clone ID: LIB3079-038-Q1-K1-A6
gtgaaaacccaaaacaatgtgcgagaattttcttaaaaaagagacattataacaaaacaagggaaaatt

SEQ ID NO: 74985 - DNA, 372 bp, Zea mays
  Clone ID: LIB3079-038-Q1-K1-A7
gtgaaaacccagaacaatgtgcgtgatgagcttaaaaaagagacattgcaacttgcaagggaaaatttagaaaaggagcagcggattttggaacttaggaatcagtgcacaataattagaaccacggaactggctgctgctcaagaccgcctaactgatttggagaggcaaaaggatgatattatgaggtcctattcccctgccgcactgctcaacaagctccaaacatcaatggcaaagttggatgaggagtccgaggagctgcaccagaagttcctggagaaggacatcgaccttccaacctttgtgcagaagtacaagaagctccgcacggcttaccacaagcaggcgttgctccatctcgccggccag

SEQ ID NO: 74986 - DNA, 353 bp, Zea mays
  Clone ID: LIB3079-038-Q1-K1-A8
gtactcacaatcgatatccaaggaaaatacaaagtgtggcttttatttacatcctgctgaagttcgcctgcgccaaacataactcaagggaagcttagtgctccacggatattacgaattcacaaggttgctaactatgtggttgagaaactcgttcttgacaaaccattggatggaggctctgatagtacgtttgttatgggattgagttctgctcaatcacagctctcacagctagatagttcttcgcggcttggactaaagccatggcaaaaaacaaagccatgtattgaggtattgtgcaataaccaggttctatcaccagatatgagtttggctacagtgcgaacata

SEQ ID NO: 74987 - DNA, 172 bp, Zea mays
  Clone ID: LIB3079-037-Q1-K1-G9
gtgatctatcacgctcgcgagcgagagagactcacatctatctgtcaagctactccccagtgtaagcacactcgtacgggaacaccggcatacttgcatattgctgcagcacacgatggaaagtatccctcatgatcatactcacctctgacctcaaactcccttacaaagt

SEQ ID NO: 74988 - DNA, 298 bp, Zea mays
  unsure at all n locations
  Clone ID: LIB3079-037-Q1-K1-F4
gngcatggaggagggggagttctccgaggcacgctagggcctggcccgccctggaaaaaggcctacgaggaggtcgccgcaaagggcggcagtgatgacggtgacgaggaggaggaatactgatctgcttgcatgaatctgtttggctgtcgagccaggttgtggtgttgaaaaacctttgtttgtgtcctggcccccctgggtaatgtttgggtgtttccttccatcatcacttgctgaactgctctagtatttgcatttgtaattgaagtctgtcgctttaagcactcttggttct

SEQ ID NO: 74989 - DNA, 395 bp, Zea mays
  Clone ID: LIB3079-037-Q1-K1-F5
gaaagaggcttgttatgttcctcacccttttacatttccgcctcgatgttctctaggggggctatttggaatgcgacttccaatagaagatatattatcaatgcaaagagaaatgatttaataaaaacaaaaaaaaaaaaaaaataaaaaaacaaaaaaaaaaaaaaaaaaaaaaaataaaaaagaaaaacaaaaaaaactacaaaaataaaaaaaaaaaaaaaagggccgcccgctttacaggacccaattttatgtccccgcacatgcaaagtaataactcttctatagggctacctaaactaaattaactgccctcgttttaacaactccgtgattggaaaaaccttggctgtacccaatttaatccccttgcaaaaaatcccttttttccc

SEQ ID NO: 74990 - DNA, 463 bp, Zea mays
  Clone ID: LIB3079-037-Q1-K1-F6
ctctcctctgctctcactctcctcccacccactccagaaaacctcacaaaaaccctgggtgcccacaacccgccgccggccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgctggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaactt

SEQ ID NO: 74991 - DNA, 365 bp, Zea mays
  Clone ID: LIB3079-037-Q1-K1-F7
ggaattttgccagcaattgatcttatcagcgtgaatgctttggttggggtaagctgagcagctttttgtttgataaatgagatatatagctttgaaagtattgataaattatcttcatctagtatccttgatgcgaaatataattctctgatttgtttagtaactgagtaatccatacgagtgttctgcagatattctactttgttggatttggattgttttgtctggaatcgttgctcagcatctgggtcatccagcaagtgtacatgtacttccgtggaagtggaaaggctgcagagatgaagcgtgatgcgacaaggggtgcaatgagagccgcattttaagtgggtattttgtgatgatag

SEQ ID NO: 74992 - DNA, 352 bp, Zea mays
  Clone ID: LIB3079-037-Q1-K1-F8
cccacgcgtccgcccacgcgtccgagcaggaataccccaagttccgctcgccgaagtcgggcgtgcgcctgctggtgttgacactggaggtggccgtggcgtgcatgtcccggtccgtggaccagctcgtcctcctcttcgatgcaagctttttccgatcggcgtcggctttcctcaacctgctcatgggcacgctcaagatcgtcgccgactactaccccggccgcctccaccgcgccttcgtcatcgacgcgccctccctcttctccgtcctctggaagggagtgaggccgttcgtggagctggcgccggcgacggcggtggtgtgctccctggacttcgaagactcact

SEQ ID NO: 74993 - DNA, 288 bp, Zea mays
  Clone ID: LIB3079-037-Q1-K1-F9
gatacttccctgctattcctatatcctatgcttcatcactccacttaaaataccactctagaggaagctcatcaatgtcggcttcattggatcataaaacatcctttatcacttggatgcatgctgccatgaccccgatggacccatactctgcatcaatatacttttgctacattgaacacaatcacactatgaactaatacatccatgcaccactctgatatgataccttaacaagactcaagcccactgactaacatacttatcgacctcatcgagaaccgccat

SEQ ID NO: 74994 - DNA, 405 bp, Zea mays
  Clone ID: LIB3079-037-Q1-K1-G1
agacgctgagccgtgacgtgtaccgtcttggacatcgttttgactttttcagaatgttgtgctgggactatactactattggtttttacttcagcacaatgataacagtttggaccgtttatgtattcctctacgggcgcctgtatcttgtcctaagtggccttgatgaagcattagccactggaaagaggtttatacacaacgagcctctccaggttgctctagcttcacagtcttttgtgcagcttgggttcttgatggcgctgcctatgatgatggaaattggtctagagagagagtacagcatatatgttttcttctttttctcttgttcccttttgctcgatgaaaccagtccacgagtataggggttctttagccttttggcaatccagtcttttacgc

SEQ ID NO: 74995 - DNA, 370 bp, Zea mays
  Clone ID: LIB3079-037-Q1-K1-G10
gtggagagcctggcagtgccagcattccgcgttgggtaccccattgtaaccgataagctcggtgagctgtacgaaaagggtaagccaaagggagtgacaatgacagtgctgttggcgaaggctgcagccatggctcttgcacagcaccctgttgtcaatagtacctgcagggatggaaagagcttcacatacaacagtaatatcaacattgcagtggctgtggcaattgatggtggccttattacacctgtccttcaggatgcagacaagctggatatttatttgctctcgcaaaattggaaggacctagtcaagaaagcacgtgcaaaacagctccaaccaaatgattacaactcttggacttttacac

SEQ ID NO: 74996 - DNA, 400 bp, Zea mays
  Clone ID: LIB3079-037-Q1-K1-G11
cccacgcgtccgcaccaccagcgaaaacgtcttggccagccatcccggtgtcgtcccgcgttctacagccaccgctgtcgtggccgtcctagactcctagatccgtcagcttaacgagctccattccttctaggccagccatcccggtgtctcagcagcggcagctgcggcgtcgagctcttgctttctgtgggaggacgcatggcgatgtctgcggctcgtgggctcttggtcctcttcttctctgccgccgtagtggctgagctcgcctctgccgcgaacggtcctttcctgtccgatagcgtcttccagtcgagcgccggatctacagggaggagcttgctgcatgccaataataattgccctgccaacctttaatttcaaaacttcacaatcatca

SEQ ID NO: 74997 - DNA, 353 bp, Zea mays
  Clone ID: LIB3079-037-Q1-K1-G12
cggacgcgtgggcggacgcgtggagcgaacgctttgcaacaaattctgtcgaaatggctgggggagctagaaagacactgatattgcgagagattcctgaaggtgatgtgagatcgatactttctgacagagaatcattggcgccgtgtgatgtaccagtatttgtttacgatagctgtgatgaatattcatggcaaagagctagagacttgcttgtgcaagtggctacacatggagaaaatactggctacgaagttccgtgcttgatagttgctgcgaaagatgatcttgaccaatcttcacaagctctacaagaatcaactagagtgagccatgacatgggaattggaaca

SEQ ID NO: 74998 - DNA, 178 bp, Zea mays
  Clone ID: LIB3079-037-Q1-K1-G3
caaacatgctgagacatttagttgaacaagcatgagtttgtgttgtaccttgatttctttgggggatttatcaaatcggaattacctagtcacactgccactgaggcctcgtgcacacggttatactttgtatgaataatttgatatacatgtaaatgcatgcagtcacactttgctt

SEQ ID NO: 74999 - DNA, 329 bp, Zea mays
  Clone ID: LIB3079-037-Q1-K1-G4
cccacgcgtgcgagagatcctggtgctgaacacatgttcaaggaaatcagcaatgcttagtgatggtttgtctgatgatgagaagcgatcaatctatgataaatatggagaagcacgtctgaaaggtgctggcatgggcacaggagattactcaaacccgtttgatctattcgagtccctgtttgaaggattcggtgggatgggtggaatgggtggcggtcgtgctgcccgtaacagaccaatgcaaggtgatgatgagagctacaatcttgtactcaatttcaaggatgcagtgtttgatgtcgagaaagagattgagataaccagat

SEQ ID NO: 75000 - DNA, 482 bp, Zea mays
  Clone ID: LIB3079-037-Q1-K1-G5
gctgatgtgacagacagtgttattggtgaaggatgtgttattaaaaactgcaagatgaacgattctgtagttggactccgatcttgcatatctgaaggtgctatcatagaggacagtttactaatgggtgcggactactatgagacagaagctgataaaaaactccttgccgaaaaaggtggcattcctattggtattgggaaaaattcatgcatcaggagagcaatcattgacaagaatgctcgaattggagacaatgttaagatactcaatgctgacaatgttcaagaagctgcaatggagacagacgggtacttcatcaaaggtggaattgtcacagtgatcaaggatgctttactccctagtggaacagttatatgaagtgaacgtgcgacatgcagctgtgtgtctcgacattcgacaatgatcagcacctggttacatgcgtgatctgcagatcagtctgttggagatcatcggag

SEQ ID NO: 75001 - DNA, 418 bp, Zea mays
  Clone ID: LIB3079-037-Q1-K1-G6
ctcttctctgttctcacccccttgcaagcaacaatcgttcaccgatcgatccagtgcgggctgcatggaaactgccgccgtcgccgcctccagtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgttgagaggcacgccaacgcggtctcggcggcggcggtcgacaaggccaagcgcgtctgcgccgaccacccgcacgtcaaggtggagacgacggttgagagcggggacccgcgggacgtcatctgcgacgca

SEQ ID NO: 75002 - DNA, 431 bp, Zea mays
  Clone ID: LIB3079-037-Q1-K1-G7
gcgttgcatccttctatgtcagccgagtggtcacccttattgacaaaatgcttgacaagaggggaacacctgaggcccttgccttgagaggaaaggctgcagtagcacaagccaaactagcaaatcggctctaccaaaagaaattctctggcccaaggtgggaggcgttggccaagaaaggtgccaagaaacaaaggttgttgtgggcatccaccggtgtcaagaacccagcttatcctgacactctatatgtggacagtctcataggacctgacacggtcaacacgatgcccgaccaagctttgcaagcattcatagaccacggcaccgtttcaaggacagttgatgcgaacgtgtcttaggcagaaggtgtatacagtgccttagagaagcttggcatcgactgggagaagctggaaagcaacttgagc

SEQ ID NO: 75003 - DNA, 423 bp, Zea mays
  Clone ID: LIB3079-037-Q1-K1-G8
agcagcttcagcctggccggccggcctgctattaaaccactttgcttgcaagtccgggggactgctagagaggaacaagctgagatctccagcatggggaggggaaggattgagatcaagaggatcgagaacaacacgagccggcaggtcaccttctgcaagcgccgcaatgggctcctcaagaaggcgtacgagctctccgtcctctgcgacgccgaggtggcgctcgtcgtcttctccagccgcggacgcctgtacgagtacgccaacaacagtgtgaaggctacgatcgagaggtacaagaaggcacacgccgttggctctttctctggccccccactcttagagcacaatgcccagcatttctaccagcacgaaatcgcaaaactgcgcaaccagatccaaatgctgcaaaacactaac

SEQ ID NO: 75004 - DNA, 375 bp, Zea mays
  Clone ID: LIB3079-037-Q1-K1-F3
gcttgatctcacacgggaacactgctcgtcacgccaaggactttggcgacttaaagcttgggcaagtctgcggcatcattggctcggatgagaagcgacatgaaactgcgtacaccaagatcgtggagaagctgtttgggatcgaccctgatggtaccggggtcgctctggctgacatgatgaggaagaagatctcaatgcctgcccacctgatgtttgacgggcaggacgacaagctgttcgagcacttctccatggtcgcgcagaggcttggcgtttacactgccagggactacgccgacatcctcgagttcctcgtcgacaggtggaaggtggtgaacctgactggtctgtcgggtgaagggaacaaggcgc

SEQ ID NO: 75005 - DNA, 433 bp, Zea mays
  Clone ID: LIB3079-037-Q1-K1-D7
gtcgtgcacctacatcgtggcgctgtgccaggccgtggacctgcgccacctcgaggagaagatcaaggcgtcggtgaagaacaccgtgacccaggtggccaagaaggtgctgaccatgaacccctcgggcgagctctccagcgcccgcttcagcgagaaggagctgatcagcgccatcgaccgcgaggccgtgttcacgtacgcggaggacgcggccagcggcagcctgccgctgatgcagaagctgcgcgccgtgctggtggaccacgccctcagcagcggcgacgcggagcgggagccctccgtgttctccaagatcaccaggttcgaggaggagctccgcgcggtgctgccccaggaggtggaagcccgccgcgtggcggtcgccgagggcaccggccccgtggcgaaccggatcgcggacagccggtcg

SEQ ID NO: 75006 - DNA, 312 bp, Zea mays
  Clone ID: LIB3079-037-Q1-K1-D8
cctgtcccacagagatgcccacaagcttcattgggcacacagtgcaaatcacaagggggagcgactaggatctgcaagaaggtccacaagcaatgaatggcgctgggcaggtccgtggaccttaccaagttcaactgctacacggagctggtggcagagctggactagatgttcgacttcaacggcaagctgaaatgctgtagcaaggaatgcatggtcgtgtacaccgactactaatgcgacattatgctggtcgctgacgacccatgcaatgagttctgcagcatggttcacaatatcttcttgtacact

SEQ ID NO: 75007 - DNA, 378 bp, Zea mays
  Clone ID: LIB3079-037-Q1-K1-D9
gatcttgtgaccctccctcagccgcgtcgcgtcgcatcctacgatccaaagctctctctgggcgcaggtcgcagccatggggaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcggg

SEQ ID NO: 75008 - DNA, 331 bp, Zea mays
  Clone ID: LIB3079-037-Q1-K1-E1
cttaatttacctcattgatgtggtagatgatatactcttctatataaacttagtcaaactgcactctcttatatttctagttggagggagcatttattactcttaacatattacattgttcgtgaatccttttattacatgatttatgttggtcaaattttaactggagactactgtacttttatcagccatatgtagtatactagtatgccatgtttaataggatcatagcaacttcagaccctggagggctccttgtatttgttccatttaagagctttcttgtttgcaatggccataccaataaaccccaccaaacttatcttttttg

SEQ ID NO: 75009 - DNA, 371 bp, Zea mays
  Clone ID: LIB3079-037-Q1-K1-E10
gcgcactcgacgccaacaagcccgtcatcggcgcgtccggcgccgcgcccttcctcgtgctgtcgtgtccaggccgcgtcgtccactgagcaggcgcgccacgacgcgctgcgcgcgctcctgaacctctccatcgcgcccgccaacgcgctgcacctgctggcggccgggctcgcgccggcgctggtggcggccgtgggggacggccctgtgacggaccgcgcgctcgccgtgctctgcaacctcgtggcggcctgccccgagggccgccgcgccgtgagccgcgcccccgacgcggtgccgtccctcgtcgacgtgctcaactgggccgacgagcccgggtgccaggagaaggcgggctacgtgctgat

SEQ ID NO: 75010 - DNA, 359 bp, Zea mays
  Clone ID: LIB3079-037-Q1-K1-E11
acgcaatcgatgaaactggcatacgattcagagacactgttcttgcgcttggacgtgtaaggtctgcgcttgacgtgtgggtttcattccaaggacgggagccttcgcctgaaccacttcttagacaaaacggcttgcttgctgcagctgcctagtgccccaaagatttctctgctatttatgcttaaacagggaccattttcatccgggcaattatttgatgaatatagacatttcacccttgtttgtttaccctcctctagattattaaatcagttagaagacaaacaaacaacatatattattaatgcatgtgtctactatatgtgtctagattcatcggctgctatttgaatatt

SEQ ID NO: 75011 - DNA, 383 bp, Zea mays
  Clone ID: LIB3079-037-Q1-K1-E12
cggatcaccatccgcttcagcaccaccacactccgtctcgtccgcatcggcagcgatgcgcggctggcgtctcatatctgggcgtcggccacgcacctcgcacaggctattaccggggatggagctggtggacctgccaatagcggcgagactgtgtcatctgagtggcctccgcaccccgaatcggatacagtcatgtcggaagcacgcgaagggggtggcttttttgattgagccagaggttccaattatcaggcgataaggtagctgctgttagctgtcagccaacatgagtaaaaggaggctaccacctaccatacgctatctgtcttcattcggacgaggtttctcgcaaggtgatcgcttgctgttacagctgaaac

SEQ ID NO: 75012 - DNA, 365 bp, Zea mays
  Clone ID: LIB3079-037-Q1-K1-E2
ccagcatagatctcgtgctcgccactatgattctgtacagcatcgcatcagccttctggagccatgtcgccgacgtcacaccacaatccacaacccgtcgaagcgaagcaagcaatggccggagtcggatcgaatgccctcgccgatgccgccgatctggcagacgtctccttctcggtggccgacgcggccgaggcgcccgcgcccagtcccgtttccgccaccgtcgcggcgtcgtcgccctttgccgcggttctcgtcgcctccgccgccgccttccttttggccgccgtccgcaattgagccgatggggcctcaagcctgcaggctacctagcagaacttcccccgccgcctcggccgccg

SEQ ID NO: 75013 - DNA, 327 bp, Zea mays
  Clone ID: LIB3079-037-Q1-K1-E3
caccaaataagaaagcaaattctgggccacttgatcagtacctgaaattgcggactctgcgacgtgcctcgtacactcattacttttatgaagcaactgttggtgctggcctcccaatcattagtaccttgcgaggtcttctggagacgggtgacaagatactgcgtattgagggcattttcagtggaactttgagttatatatttaataatttcgaaggaacaagggcattcagtgatgtcgttgctgaagcaaaagaggcgggatacactgaacctgacccaagagatgatctatctggaactgatgttgcccgaaaggtcatta

SEQ ID NO: 75014 - DNA, 400 bp, Zea mays
  unsure at all n locations
  Clone ID: LIB3079-037-Q1-K1-E4
cccggctcccccacggtactccagccgctagcctgcgattccgccagtacgccaccaccagcgaggctggactaccgccgccgcccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcctgctccacctncccttggtagctgaggataagaacgtgccatatgtgtttgttccatcgaagcaagctct

SEQ ID NO: 75015 - DNA, 439 bp, Zea mays
  Clone ID: LIB3079-037-Q1-K1-E5
aaaaaaacaaaaagggtaccggaagcggcgaaagcctcgccccccgccgctctcgcgtcgtctccggagcgcacgtcagatcaggtgcgccgcgcccccctcgcctaagctgcgacgaccatccatcgaacaggaaggatgacgggctccatggatctcccggccaagggcgggttcagcttcgacctgtgccgccggaacaacatgctggagaagaacgggctcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccggtacagatatggtgagcttccagc

SEQ ID NO: 75016 - DNA, 436 bp, Zea mays
  Clone ID: LIB3079-037-Q1-K1-E7
atgacaatggattgccaaagtcaaagttttgggagcctacttatgaagactgcttaaatttgattgctcggcttccaccagtggcttcttatgtttaccggagaattttcaagagtgggaaatcaatagaagccgataattctttggactatgcggcaaatttctcacacatgcttggttttgacgacccaaaaatgctggagctgatgcggctctatgtaacaattcacactgatcatgaaggcgggaatgtcagtgctcatactggtcatctggttgggagtgctctgtcagatccttatctttctttcgcagcggctctaaatgggctagctgggccactgcatggccttgcaaatcaagaagtgcttttatggatcaaatcttgaattgaagaaactgggaatggtgttaccacagatcaacttaaagacta

SEQ ID NO: 75017 - DNA, 270 bp, Zea mays
  Clone ID: LIB3079-037-Q1-K1-F10
ccgagttccatttgatttccttgatccaaattaatattctccccctaaatgaatcatcaaaggtgagtctcaaaaaaagcgcgtctcatgccaattaaagaatccattgatcacaaagaagctttgttccaatccccctaattacccatcctcttcatcaataactatggcttcttctgcaactctgctaccataaacatgtgctccaaatgccacaatgatattattactaatcattatcatgccaaacttgctttctactctatcgac

SEQ ID NO: 75018 - DNA, 424 bp, Zea mays
  Clone ID: LIB3079-037-Q1-K1-F11
gatacttggtcaatcattgcatatttgatgtttcatcaaaccaataaaaatgccactttggcatcttatgttcagtatttccttccctgtttcatgaagcatgccttttgcattgatttgatgctgcagtgattttgttgctgccaaatgcaatgttgcttatatttgtcagattgaacagaatcacactgtagctaatacagtatgcaaagctctcatgtcatagattaagaaaactcaaaaccagtgattaacaaaatggtagacctgggagagtgcccccatattctttatccacttctacctagttattctagagcctaaggctattcggactcataccactcttaatttggactctaaaagaaatattctattcttggcaacaaaattctttaccctatactacaattcttcgcagtca

SEQ ID NO: 75019 - DNA, 429 bp, Zea mays
  Clone ID: LIB3079-037-Q1-K1-F12
ctttcatagcttacctgcccataatgcatggttgatcttgccaatataattgatgcagtgcgtgatgaagctcaggacagagctcccgagttgaagatgaactccatctgcgaggaatcgaagctccagcatcagaaggtcccaaatgacctgttggagcatgccaaagctgatgctcaaacagctctcgaggagatagatcctgactaagaaacatgatgatatgcccaaacttcatgttttggcgctgatgaaatctctgatccctctggggtgacagactggatatggcaaacacgtctgattatatattgatgacatgtaaaactcaattgactgaactacggatctgaattgattgatgtcatagctgctgctattgacattcaaaaaatttaccctatactacaatacttcgaaatcatatta

SEQ ID NO: 75020 - DNA, 379 bp, Zea mays
  unsure at all n locations
  Clone ID: LIB3079-037-Q1-K1-F2
gtaaaccgtgggaatgtttttttgttgttgtcttgtgttcgatggcaacacccaggtcgggaaggcaatcgagaacgcgatccccggcggcgcgggtgcggcgggagctgtggtgcgggctgacgtacctggtgatccagacggccgggttcatgcggctcaccttctgggagctgtcgtgggacgtgatggagcccatctgcttctacgtcacgtccatgtacttcatggccggctacgccttcttcctccgcaccaagaaggagccgtcgttcgaaggcttcttcgagagccggttcgcggccaagcagaagcgcgtgatgcgcgcccggggcttcgacctccgcaggtacgaggagctccggagagcctgcngcgt

SEQ ID NO: 75021 - DNA, 414 bp, Zea mays
  unsure at all n locations
  Clone ID: LIB3079-037-Q1-K1-D6
cgcttgctaccccgggtccccaccacacgcacgcgagcccgcggccaccacctcgaggccgctgacgggctggaatccgctggcgcccgtcctccagaccgtcgccgctttctcccgccacatcctcatcgcccccgacgccgggctcgacgaccaccgcctccgcccccttctagcgctctccctctccccgccttcgccggcaccaccgcaaccggaggtccggaaggagaagaaggatgccaaggaggcgccactgacgaaggaggaggtcggccgggccacgtggatgctgcttcacaccatcgcagcgcagttccctgacgaacctacgaggcaacaaagacgggatgcaaaggagttgatgcatataatctcgagactatatccttgcanagaatgtgctgatcactt

SEQ ID NO: 75022 - DNA, 439 bp, Zea mays
  Clone ID: LIB3079-055-Q1-K1-E12
cccacgcatccggctttgcgtgtcatcttgtttcggaccttggtgtaccactgcggggcggaggtttactccttcacacattgacttcctaggataggcttgccaccgcgttttgctagatgagtcgcgaaataagcttttacttcctcgctgctgtgggtgaagtgactgtaattcactaattttgaactaacaaaacccaccgttgatttgtatgatacgttttgttcaacagtttgcgtaccatctttcactgtggtccatcttaatcaacaatcaattccgcaatcatctcaaactcatgaagcaagtaatctgagatctccagttgatgtcaatgttggagatggctcttaaacctcacctgggcagcaaaatggtctggtcactctctctcagataatggacttttttggatcaatgctcccaggcgaaaatg

SEQ ID NO: 75023 - DNA, 405 bp, Zea mays
  Clone ID: LIB3079-055-Q1-K1-E2
tggagctcttccacggccgcggtggagatggcggcgaatctggaggacgtgccgtcactggatctgatgcacgagctgctccgccgcatgaagtgcagctccaagcccgacaagcgcctcatcctcatcggtccacctggctctggaaagggaactcagtctcctattatcaaggatgaatattgcttgtgccatttagccactggtgacatgctgagggctgctgtggcggccaagacacctctaggtatcaaagctaaagaagctatgaataagggagagcttgtttcagatgatttggttgtgggcattattgatgaagctatgaagaaaccctcatgccagaaaggtttcattcttgatggctttcctagaactgtgactcaagcacagaagcttgattag

SEQ ID NO: 75024 - DNA, 425 bp, Zea mays
  Clone ID: LIB3079-055-Q1-K1-E3
gctccgttgagtaatgagatcgaggagttcatgagagtgaccacctgtgcatacttcatccaaggctatggtttaacagaaacactgggacctagcactgtctgctacatcgacgacatggccctggtcggaagcgctggtgtgcctgccacctacaccgaaattcggctggaagaagtgcccgagatgggttataatccactcggcgttccttcgcgtggtgaaatctgcatccggggaaaatccctcttcgctgggtactacaaaagtccagaactcacaaacgaagccatcgctgatgggtggtttcatacaagtgacattggaaagatgaccccaaacgggatcttgaaggtgattgacagaaaaaagaacatatttaagctgtctcaaggggaatatgttgcggttgaatacctggagaa

SEQ ID NO: 75025 - DNA, 442 bp, Zea mays
  unsure at all n locations
  Clone ID: LIB3079-055-Q1-K1-E4
cccgcgcgtccggagacaaccgctgcgtaaacgaatccatcgccatggcgtctcgtctcggggcggctgctgcctcctcctnctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaagcggcatcaccacaggcataagtggcggagatggagttatacccgtatctgtggcctggcaacaatgttaaataaaaggaatgctttatgttgtgctttcaagttgataaattgtggcaacaggagattttgcttta

SEQ ID NO: 75026 - DNA, 338 bp, Zea mays
  Clone ID: LIB3079-055-Q1-K1-E5
gagttcgagcagcaggtccgcgcggcgctgcccaaggaggtggaggccgcgcgcgcgggggtggagagcggcagccccctggtccccaacaggatcagggagtgccggtcctacccgctgtaccggttcgtgcgcgaggacgtcggcaccgagtacctgaccggcgagaggaccaggtcccccggcgaggagctcaacaaggtgctcgtggccatcaaccagcgcaagcacatcgacccgctgctcgagtgcctcaaggagtggaacggcgcgcccctgccgctctgctgagctcagctgcacgcacctgctccgcacaaagaaagaaaaaacaaaag

SEQ ID NO: 75027 - DNA, 305 bp, Zea mays
  Clone ID: LIB3079-055-Q1-K1-E6
cccactcgtccgcccacgcgtccgtccactcgtccgcccacgcgtccgattggcaggcgagcatcatggggccttcggacagcccatttgcaggtggggtattcttggtgaacattcacttcccaccggattaccctttcaagccaccaaaggtgtctttccgcaccaaggttttccacccgaacatcaacagcaacggcagcatttgccttgacattcttaaagaacagtggagtcctgctttaactatctcaaaagttctcctgtcaatctgctcactgctcacggacccaaaccctgatgat

SEQ ID NO: 75028 - DNA, 439 bp, Zea mays
  Clone ID: LIB3079-055-Q1-K1-E7
gtcttgatgaagttggttatgatgatgttggtggagttagaaagcaaatggcccagatcggagagcttgttgagcttccactacgccatcctcaacttttcaaatctattggtgtgaagccaccaaagggcatattgctgtacgggccacctggttccggaaagactcttattgctcgtgctgttgcaaatgagactggagcctttttcttcctgatcaatggtccagagattatgtcaaagctggcaggggagagtgaaagcaatctcaaaaaggcatttgaagaagcagagaagaatgctccatctatcattttcattgatgaaattgattccattggacccaagagagagaagacccatggagaagtagaacctcgtattggttcacaagtactgactcttattgattgactgaaatctcgttcccatgttattgt

SEQ ID NO: 75029 - DNA, 405 bp, Zea mays
  Clone ID: LIB3079-055-Q1-K1-E8
cccacgcgtccgccacgtcccggttctggctcccctccccatcggcttcgccgtggtcatggtccacctggccaccatccccgtcaccggcaccggcatcaacccggccaggagcctgggcgccgtcgtcgtctacaacaaggacaagccatgggatgaccactggattttctgggtgggcccgctcctgggcgctgccatcgcggccttctaccaccagtacatcctccgggcgggcgccatcaaggctctcggctccttcaggagcaacgcgtgatgagcagagctaaagaaaggccttcgctggactgcgtgctggagcaacggcgatcgatcgatctaacgtggggagaggccgataggcgggcccccaaaggaggagaataagtttgtgcccgtggcccg

SEQ ID NO: 75030 - DNA, 420 bp, Zea mays
  Clone ID: LIB3079-055-Q1-K1-E9
gccagatgctaagaaaggtgcaccacatctgagggacatcttttatcggatggggggatgggacaaagatattgtagctctatcagggggacatactctgggaagggctcaccctgagaggtctggattcgatggtgcctggacaaaggagcctcttaagtttgataactcatactttcttgagctgttgaatgaggaatctgagggacttttaaagctcccaactgacaaggcactgttatcagatcctgaatttaggcgctatgtggagctctatgcaaaggatgaagatgcgttcttcaaagattatgctgaatcacacaagaaactctctgagcttggcttcacgcctcgcagcacagcaccatccaaatcagatcttccaaccgccgccgtgcttgcacaaaatgcctttggggt

SEQ ID NO: 75031 - DNA, 399 bp, Zea mays
  Clone ID: LIB3079-055-Q1-K1-F1
cccggactcacgaatcccaaagcctccatggcgactcaccggcactgcctcccactcctgggactggtggccgccgccctcgccgacgtccctgctcgcgcggcgctgggcggcgggcgcggaccgctgctgggcgggtggaacccgatccctgacgtgagcgactcgcacattcaggagctaggcgggtgggcgctggggcaggcgaagcaccataagctggccgacgacgggctgcggttacgccgcgtggtgcgcggcgagcagcaagtcgtgtacgggatgaactagccgctatacgtcgacgccggcgaaccccgcggtcgcaccgtgccctacgtcgacgtcgtgtaccaacaagtctggacccggaacctgcaacttgacttctttaacccg

SEQ ID NO: 75032 - DNA, 417 bp, Zea mays
  Clone ID: LIB3079-055-Q1-K1-F10
aagtatacgagtatatcctctttcggggaactgatatcaaggatttgcaagttaagtcatgaccaccgccgccgccacctcaagcagcttccctgcacaatgaccctgccataatccagtcacattattctcaaccagcatcaacatcgtcaaatttgccttccgctgggggtgcagttttaccagacctcagctcccaggcagttcaatatgggcttcagaggccaacttttcagagtaaccttcctctataccaaccagggaatgctccacggggctcttcagcggcacctccagcaggaaatgctccgtggggctcttcagcagaacctccagcaggaacgacactttcggttccctcaatgtactggcatggatactatgcgccttcaagtgggctgccacctcatttgcagc

SEQ ID NO: 75033 - DNA, 109 bp, Zea mays
  Clone ID: LIB3079-055-Q1-K1-F11
attggtggtgccctcttttagatttcttatgagttatagttcaataataaagtttgttgtgggatgtttgtggcttcccagaaataagaaagtacatttctagattctt

SEQ ID NO: 75034 - DNA, 392 bp, Zea mays
  Clone ID: LIB3079-055-Q1-K1-F2
cccacgcgtccgcgcggaattggcggaggggcagccggatatgtcgtcgtcggttgggggcggcggcgcgggcggcggcggagtggacatggtcagcctgctggagaaggccaaggatttggaccagctaaagaaggaacaggacgaaatcgttgccgatatcaacaagattcacaagaagctcctcgcatccccagagatggttgataaaccagttgacaccattttgctcaagcttcgtggtttatatgcacgtgcaaaggagctctctgagaatgaaatcagtgcctcaaatgctttgattggattattagatggtttgttgcaatctggagcttcaactgcacaaaagaaaaagatagaagttggtgagcagaaaaagaagaggatca

SEQ ID NO: 75035 - DNA, 232 bp, Zea mays
  Clone ID: LIB3079-055-Q1-K1-F3
gtgggaatcagatctgaagcggcgagaggcggatatcaagaggagggaagaggcgctgaagaatgctggcgtgccaatggaggagaagaactggccaccattcttccccatcatccaccatgatattgccaatgagataccagcaaatgtgcagaagttgcagtatcttgcatttgcaagctggcttggaattgtgctttgtttgtcctggaacttcgttgctgtcatagtc

SEQ ID NO: 75036 - DNA, 336 bp, Zea mays
  Clone ID: LIB3079-055-Q1-K1-F4
tttggttatctgattgtctaaaacctataattggtgtaatggtatcgtagtggttggttgagcagtgagtgactcatattttgtcaggtctatgtgttatcgttaaacttttaacggtcattctatttcaaaagttttgcattttgcaaaaaaaagatataaaaaaacaaaaaaaaaacaatacaaaagaaatattatagacataaaaggaacctaaataggatattttgcaccaataaatcatggatatccacttattaaaccaaaaaaaaggggcggcccttttaaagattccaaatttaattacccgggttttggagttcataactttttttt

SEQ ID NO: 75037 - DNA, 321 bp, Zea mays
  Clone ID: LIB3079-055-Q1-K1-F5
ctcggcgatcgctccaccccttcccacgccttcaggagtgcaatgggggatctagggagagtgctaatctatgaggcaacacgagattggttgccgacagtaacacggcagatccagtcacctgtgggcactgaggttgttgaatctgtcagtgagatggagccaataatgattgtacctattcttagagcagggcttgcacttgcagatctcgcaacatcaattttgccttcaactagaactttccatttaggtatggcccgggatgagacaacactgatggcctcttgttacttaaataagctacctgatagattcccg

SEQ ID NO: 75038 - DNA, 390 bp, Zea mays
  Clone ID: LIB3079-055-Q1-K1-F6
gcccaccgtcggttggccattgggatgaagcacatgcgccttccaacgtggcaacgctggcatccttcctgaagcagtgtcgaaggtcgctgctcaggcttgcaccagcattccttccaacccctggagttctatccacaagggttttagcgcctaagaatcataaggtgaggcgaaatatttcagccgctccaccgcaacgaactggtttacattaccagtcctcaagggggtcctagttcttgaaccataggtgaagcagacttataccactattatagctgttccaccgtcgttccagattacatagctatgcccaatttccggtgtacatatatagtcggaaagttatttggcaattggattggtcgttgctcgatatattcccta

SEQ ID NO: 75039 - DNA, 409 bp, Zea mays
  Clone ID: LIB3079-055-Q1-K1-E11
ctttgagcattgtatgtaaaagtgccgatgtagctgttagggttgaaagtcaactcaaacgggtcatcaggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtcgcattcatgaggcaggaataccacatttatatgacatctgatgggaggatcagcatggccggtttgagcatgatgactgtgccccatcttgcagatgccataca

SEQ ID NO: 75040 - DNA, 325 bp, Zea mays
  Clone ID: LIB3079-055-Q1-K1-C4
gcttgttacacggttgggttgagtgcaaggtgtagaactgttgatgatagtagatattggagcagtgtaaagatgtgagtgcttaagcataagtcattagagtctttaattccatttgatggtggcctttctttgtatattccagattggaggagaactgacagacttcatcattgtgcttcatgaccgtaaagctgtcaaggctttcagcagtcgcattcatctttcacttggggcaggattgagtgctgcagcatgacccattggcagagcatttgaggcatacgttcgggccagtgaaaaaggttctgggatatgctacact

SEQ ID NO: 75041 - DNA, 338 bp, Zea mays
  Clone ID: LIB3079-055-Q1-K1-C5
cgagcattcgtgtacccgtgatactgggagttcaagacctccgctcatgtccgccggaggggcgctctcagcccggccgcgaccgccaactcctgccgccatcatccattcactcttcgtctccctatccgacccgtccgcaatccgccttctgcccgccccgctcctcgtcttctcccaactccgccgcctcctgccgtccgacgccgtcacccaactcctccttcacccaatcgcctcgctcctccaccttcaccgctccgacatccgcataggccttcagcttcacgggctctccctgtccgccggcctctcctgctactcgcacctactgcccc

SEQ ID NO: 75042 - DNA, 409 bp, Zea mays
  Clone ID: LIB3079-055-Q1-K1-C6
cccacgcgtccgcttcgcaccttaccttctattctcaaggaaacctttatccatgggccggggtatcatactgctcctgcttgtgacccccctcgccatctccatggcactgccatcactatcaacgagaatcgaagggagtgtcataggggagagatccaacttgttctcacagctgcactccgataattctagccctacagaaaacaaactccaaccaggtgaaaagtcctttgcatcggaagcatatgcggggaactggaaccaaccaaccaaccaaccatcgcaagacttccttcaacaactagaaccctatcgagtgatattgaaacaaccaatgcaaggggaaaaatccttcctatcccaagcatattccgccaaattgaaccaaccaacattaacaagcaag

SEQ ID NO: 75043 - DNA, 444 bp, Zea mays
  Clone ID: LIB3079-055-Q1-K1-C7
caagggcctacgccaccgctgcttctgcaccagggactgctagtactgcctcgtcgggcgtggcctcggctcgtgtcctgcgtgtgcatagccgcagcggatcagtaaaacatgcatgcatgcgttaccgaatatttggcagtaccagcaagttaatggattaaataatatgtaatggaacaaagcctgttttgaacgtggaactgctgagtgctagcagcgctcgtgtttattggcataaaaaaaaaacattaaaaaatcaaatagaaataaaaaccaaaccataaaaaaacaaaaaaataaaaaaaaaaacaaaaaaaaaaaaaaaaaaaaagggcaaccaatataaaataatgcaaactaacaatacgggacaatccaacatatggatcttctttttggaggacctaaatttaaatgaaaggccctcattataaaataaaa

SEQ ID NO: 75044 - DNA, 430 bp, Zea mays
  Clone ID: LIB3079-055-Q1-K1-C8
cgcctgtacggctcgtcgggatcacctgggacgatttcaagatcgggttctgggagggtgcggtgccgcagctcccgctgtccgtgctcaactcggtgatcgcggtgtgcaagctctcgtcggatctgttccccgaacgggccgagctcttcccggcgcgggtgtcggtgagcgtcggcctcatgaacttcgtcggctgctggttcggcgccatgccgtgctgtcacggcgcgggcggattgtcggggcagtaccggttcggcggccggagcggcgcgtccgtggtgttcctggccatcggcaagctggcgctggggcttgtgttccgaaactccttcctgacgatcctcgggccgttcccgatcgggatactgggcggcatgctgctcttctccgggatcgagcttgccatggcgtcgcgcgacatggg

SEQ ID NO: 75045 - DNA, 442 bp, Zea mays
  Clone ID: LIB3079-055-Q1-K1-C9
acaaactattgctgctgcagtatctttgtttggagctgatgatagatccaatcctggacgggatgaactcaataagaccatgcagtcactttgcatcatggctcataatgtatggataacatgggtgtccaccgaattatctcacattctttcatatgatatcagcaaagatgattcactatcctcttcgactcctttgaggggctgggaagtcactgtaattaaacaagatgaaacaactgagggtcccttggagatgcaaatagctcttccatcgatgccttcattgtacatcatatcatttctttatcaagcatgtttggagattcataaggttggagggcacatcctgtacaggattattttgcacaattttgcatgggagctactgcagaaggttgtcaacatttatgaaaaatttctttcatgtgttgaatctggg

SEQ ID NO: 75046 - DNA, 419 bp, Zea mays
  Clone ID: LIB3079-055-Q1-K1-D12
cccactcttccggacaactactgtcaagtccttttccattgcatcccttcaacaggatacgaatagtttcagtgaggaaaatatcatacgagacagcaggtttggtaaggtgtatctggcaaagcttcctgatggagagctactggaaattttgaagattgactcttctaactcaaaagtgccagtagatgcctttcttgagctagttgtgaggatttctgaactgaggcatcctaacatacttggtcttgttggatactgtgcggagtttgagcagcgattacttgtctatgagtactgtagcaagatgaccctacatgatgaacttcgtcatgtggatgactcaagcaagccattatcgtggaatgctcgcctccaagttgcttcagaggcagcaaaagcattgcaacatcttcatg

SEQ ID NO: 75047 - DNA, 372 bp, Zea mays
  Clone ID: LIB3079-055-Q1-K1-D2
gcgacggatcccaatccatcttctcctcatccccaccacgaccaaaaaaaaatccggtcggcgatgccgtctgctgcctgacatcggtcagccagggtagatcgcgcaggcaggcagccccacacacatacgaaacccaatcctgcttcgatcccgtcggccggcgatggagggccggcggccgggcgcgcccgtggcgggcctgcccatcggcttccgcttccgccccaccgacgaggagctgctgctgcactacctccgccgcaaggcgctggcctgcccgctccccgccggcgtcatccccgacgccgacctcgcgcgccttcacccgtgggaacctcctcccggcggcggaacaaggggatcccgaac

SEQ ID NO: 75048 - DNA, 443 bp, Zea mays
  Clone ID: LIB3079-055-Q1-K1-D3
cggacgcgtgggcgatccatcagggaaattgagcgagagaggcaaggattgcaggcccaggagagaaagctcatcactgagatcaagaaaacagctaaagaaggccagatgggagctgtcaaagtaatggccaaagaccttattcgtacccggcatcagataacaaagttctaccaactcaaatctcagctccaaggagtttctctaagagttcagacactaaaatcaactcaagctatgggtgatgccatgaaaggcgttacaaaagcaatggctcaaatgaacaggcagctaaatctgccaaggttgcagaagataatgcaagaatttgagcggcagaacgagaggatggagatggtgagcgaaatgatgggagatgccatagatgatgctttggaaagagatgaagaagaagaagaaactgaggagcttgtgaatcaagt

SEQ ID NO: 75049 - DNA, 339 bp, Zea mays
  Clone ID: LIB3079-055-Q1-K1-D4
cgctgccgtcttcacccaatcagggatgaggatgccaagttcaagctctgcaaggtgaggggctggcagtttggccagaagggcatcccctacctgaacacctacgactgccgcaccatccgctaccccgacccgctcatcaaggccaacgacaccatcaagatcgatctggagaccaacaagatcatggacttcatcaagtttgacgtcggcaacgtggtcatggtgaccggccggaggaacaccgggcgtgtaggtgtgatcaagaacagggagaagcacaagggcggcttcgataccattcacgtcgaggactccatgggccaccaagttcgcacc

SEQ ID NO: 75050 - DNA, 280 bp, Zea mays
  Clone ID: LIB3079-055-Q1-K1-D5
gcactcgttcggatcgctgaaactagggtgcgccgcataaaatcacgtacgtagtttttgagctcggaaaagccatctcatcgtttgtgatcccacgacctgttgcttaacatgtggcatctccgctgcaaccgagtacctggactgaaatgttcatgttatcgtcaactaacaactgacctggtttacttcaggccctactgtataattacaggaattggttggtccatctttgctgatttccacagcattcttatggtaaaattattactgggagttt

SEQ ID NO: 75051 - DNA, 430 bp, Zea mays
  unsure at all n locations
  Clone ID: LIB3079-055-Q1-K1-D6
cccacgcgtccgcttcgttgctcaggcactgaggaaggagcccttgacggtttatggtgatggaaagcaaaccaggagtttccaatatgtttctgatctggcaagtctacctctactcaacatatattgaaaaaaaaataagagacactcgattcaacatcactgccagagtaccagatttgattttttttttccggtggcttagtggcctagccagcaagtcgagggtctgatgaagctgatggaaggcgagcatgtaggaccatttaacctgngcaaccccggcgagttcaccatgctggagcttgccaaagttgtccaagacaccatcgaccccaacgcacggatcgagttccgtcagaacacccaggacgacccacacaagcgcaagcccgacatcggccgtgccaaagagcttcttgggtgggaa

SEQ ID NO: 75052 - DNA, 285 bp, Zea mays
  Clone ID: LIB3079-055-Q1-K1-D7
aatttcgcagcattccgcgcgcttggtctctcggaggcgtggcggtagcctgtgcgggtgtgcctcggagctccggcctccgggaataaacataggggtatcgccatgcacgcggcggccaagacgaggaatggctccttggaacaccccacccggacgtcctccctgggcggtaacaaggccggccggacggcgaggatggccgagtcgtccaccggcctcagccccaaagtcgaccgccgcacggcggtgagcgccgagagagagaaaaggaagccaccgacg

SEQ ID NO: 75053 - DNA, 388 bp, Zea mays
  Clone ID: LIB3079-055-Q1-K1-D9
gtcctggtccttctaccgcgccggcatcgccgagttcgtcgccaccttcctcttgggctggatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgtgcgccatctgcggcgcgggcgtcgtcaaggggttccagcaggggctgtacatgggcaacggcggcggcgccaacgtcgtggcgcccggctacaccaagggc

SEQ ID NO: 75054 - DNA, 330 bp, Zea mays
  Clone ID: LIB3079-055-Q1-K1-E1
catccggctttcgaacaccagatcctcgctgggctctcaaaggcactgcatgccactcgccgtgcgggtgacagcctccgtcccctgctcccctacatgatcagggcttgccggccctacgctgtccactggttcgcgcgcgaaaccctatccaccacgtacgcgactggcacatgcaccagctacgccggtgagcacctcaacaagctactcaccatcatctaccaccgcacgcacatcgagccactcctctagtgccccaacgagcagaactgctcgcccctgacaatctcctgatcttagctgcacgcagctgctcctgacaaacaa

SEQ ID NO: 75055 - DNA, 237 bp, Zea mays
  Clone ID: LIB3079-055-Q1-K1-E10
gagacggagatagtattgtcatcccgtcttccctcacccagtcaccctgactggacggcgggcggctgatgcgcttgtcatcccctggtccctttccttttcgggccccttgggaaaatttttggccgccgtttggccgatcgttaaaggctgaataaccggcgggtggttcggattaccatcgccgactggaacgccttctacgttaacttggaccgggccttcattcaccccaac

SEQ ID NO: 75056 - DNA, 427 bp, Zea mays
  Clone ID: LIB3079-055-Q1-K1-C3
catgccggctacttcggtaaggtcggcatgcgctacttccacaagctccgcaacaagttggactgccccgtggtcaacatcgagcgcctctggtcgatggtgcccgccgaaaaggcggctgaagccgtctgcgacaaggccccgcagatcgacgtcacgcagttcggctacttcaaggtgctcgggaagggggtgctgtcgcccaagcccatcgtcgtcaaggccaagctcatctccaaggtcgccgagaagaagatcaaagccgccggctgcgccgtcgtgctcaccgtctagttttcagtccttattcgcctcttggttttgagatctatatctggactagcagtgctttcttgtcttacctatttgtgttaagaagacgtagtttttaaatccattgctccttcctgtttggacagtgctttct

SEQ ID NO: 75057 - DNA, 279 bp, Zea mays
  Clone ID: LIB3079-055-Q1-K1-A3
cccactcgtgcggggagcccaaggaggagaacgttacccttggacccactgtccgttaaggataggttgtctttggtgttgctcacatctttgcatccttcaatgacaccttcattcatgtcactgatttgtctgggagggaaactttggttcggatcactggcggcatgaaagttaaggctgatcgtgatgagtcgtctccttatgctgctatgcttgctgctcaagatgttgcacaccgttgcaaggagctcggtatcaccgctctgcacattaaac

SEQ ID NO: 75058 - DNA, 406 bp, Zea mays
  unsure at all n locations
  Clone ID: LIB3079-055-Q1-K1-A4
ggttgcaccaatgtggatgagattctacatacgggcaaaagtgcttcagcccctggaatcgggctcttggctcaattagctgctgcgaaagttgtagcaacggcactttgcaaaggttctggtcttgttggtggcctttatgctccaagtttgatgattggcgctgctgttggtgctgtttttggaggctcagcagcagaattaataaactctgcgattccgggtaacactgctgttgcacatnctcaaagctatgcactgggtaagttcttattttttggcaatcaatttaaaccctgaactctatattgggctaacttttcataccatttaagtgggaatggctgctaccctggcttcaatgtgttctggttcactgacatctgtgctggtactctttgaattg

SEQ ID NO: 75059 - DNA, 271 bp, Zea mays
  Clone ID: LIB3079-055-Q1-K1-A6
tcttcctaaaaaaaaaaaaaaaaaaaaaaaaaaaaaaataaaaaaaaaaaaaaaaaaaaacaaaggaacgcataatttcaaaaactaacataacaaacattcaaaaaaaatatataatctacgtgcctctctttacttcccttccttacttactccttcttccacattaatactcctactatccttccacttactttctttccactgcctctccttttaccccgtttttccctgtaacaaccttgcctttacccacctaactttccttcct

SEQ ID NO: 75060 - DNA, 434 bp, Zea mays
  Clone ID: LIB3079-055-Q1-K1-A7
gctgaagtcagtgctaacatgacatatgatgctttgagcaaagatgtccatcatggtcaggcagtgacagacaagatgttacttgatccgatttcttgtgagataattcaggactctggaaaaccagaaggctgtctacaaggatttccatggccgaacaccattgcatcattgtgtccaaaagaaaaatgatgagctcaccaagcatctgctgaagaggggtgcgagaacgacaattaaagatggcggaagtctgactgctctggagagaagaatggaacttggagcgataactgatgaagacttattcatactatttgtgaagtgatgttgcaaacttgcaatacaagcctttggcaactagctggttgtacctgatagcattgtattgtacccacctaatttagcttctggaaagaacatgatttctacac

SEQ ID NO: 75061 - DNA, 204 bp, Zea mays
  Clone ID: LIB3079-055-Q1-K1-A8
tcttcctctgactctttgtcttactctttgacttactcttgtgaaaaaaaaaaaaaaaaaaaagagaagaattatataaaaaaaaaaataaaaaaaaaaaataaaaaaaataaataaataaaaaaatatcaattaataatatatccaaaaaactaaaatctcatacattgctcacattttttataactgtaattcttataaaaa

SEQ ID NO: 75062 - DNA, 203 bp, Zea mays
  Clone ID: LIB3079-055-Q1-K1-A9
atcacatcttttgcgtatccattttacctttcatataacataaaagcgctatgatgggaggctctcgtggtgataacacttctgaatcaaatattatactcctaacgataccacgcttcttcaatccatagcttatttattatattatatgctcttgtgacatcttcttccctggatagcttgatagattcagctatagactt

SEQ ID NO: 75063 - DNA, 418 bp, Zea mays
  Clone ID: LIB3079-055-Q1-K1-B1
ggattgtgaggcggattcttgtaaagaggcagaaagtgattcctgcacaagcgatatggggttgtgtccaggaagtagcactgatctgtttgacattgcacgatctccttttgttgattttcaccatcaagaaagatgcaggcaagtgaagatggcaaaggggccatgcagccttcttgattttgttctaatctcaaaggcagttgataactcttccaagcctactccagacttcgaactactttctcatcacacatgtcattgcaatgctctaagccagaaccctatatggtggcttatggaacggcctcggacaattagtcatgatttctcaaagtcttattgtgaggctaacctgcaattggtcattcacaattcaaaagctcataagatttttgtgagagtggtcacttttgat

SEQ ID NO: 75064 - DNA, 307 bp, Zea mays
  Clone ID: LIB3079-055-Q1-K1-B10
acaacacctactacgaatatcaagaacccttcggataaatgagcgctgcgccggggggagtgttactcctacttgcgactgctgctacaacctaagcccctgatgtgcaatcgtccatcttaagccactcgctgaaccctacgttgaggcgcgcgttgaccaatctacttctgaagaagatggtaggcaaccatgtgtcgcaatgctaccactaccacatcatgcgcgacgacccgctcatcattgcccgcgaatagaaggagcgtccagctaaactggaaatgctgaatcgacttgacaagggccc

SEQ ID NO: 75065 - DNA, 205 bp, Zea mays
  Clone ID: LIB3079-055-Q1-K1-B2
aaaagtataacgacagcaaagaaaaaaaaatataatgacctgaccaaaagaaaaaaaactaccgctaggtttttcaaaggattatcaactacgcgcgtcagacacaatggaccgaattgtcgtctgctagcatactatcttgctgattttaaatcgagcgtcttctcacatactaccatgctggttactgaatggtcaaccctga

SEQ ID NO: 75066 - DNA, 340 bp, Zea mays
  Clone ID: LIB3079-055-Q1-K1-B3
tcgcccacgcgtccgccagtagtcatatgcttcgtaaaaaaaaaaaaaaaaaaaaaaaaaaaaggaaggaataaaaaaataaactacgcttcatcactgagatgatgcgggatgctttgcgccagaatgctactgacactgcaaccattttatctaccgaagctcaccatgacaacatgcactcaacacaccagttcacaggttgaatccatagtacgcatcagctttatgactccctagatttactagaatttaaaccattaaatgatgagagaattggcattatacaataaacttttggaaaacgtgttgacactggagtcgtattattaatcaacgg

SEQ ID NO: 75067 - DNA, 331 bp, Zea mays
  Clone ID: LIB3079-055-Q1-K1-B4
gacggccagaggaagctagcagagtcgagagagagagagagagagagagagagagagagagagagagagcatggctggcaggagtttcctgattcggtcccccaaggaggaggagtccgacgccgccgtcagagaagctgtactgctgggagcaaagaacgccgcaatagctggtactgtggttgcagttcccacgttggttggctgccgtgtccttccttgggctaaggcgaatctcaactacactgcacaagcactcattatatctgcagcctgtattgctggcttcttcatcactgctgacaaaaaccattctacgggaacgcacgac

SEQ ID NO: 75068 - DNA, 377 bp, Zea mays
  Clone ID: LIB3079-055-Q1-K1-B5
caacgcagcgtcgttttgcggtgtagtgggattgaagccaacttatggccgggtttgtcggtttggtctcatggcctacgcttcatcgctggatgttgtgggatgctttggttcgtcggtttttgacactgcaaccatcttatctgttgttgctggccatgacaagatggacgcaaccagcagttcacaggttgttccagagtacgcatcggagttggtctccctagatttactagaatcgaaaccattaaatggtgtgagaattgggattatacaagaaactcttggagaaggtgttgccagtggagtcgtatcatcaatcaagggtgctgcttcacacctggagcaattgggatctggcgtggaagaaggttcac

SEQ ID NO: 75069 - DNA, 420 bp, Zea mays
  Clone ID: LIB3079-055-Q1-K1-B7
cccacgcgtccgcccacgcgtccggtgctatgcagcttggtatgcacatgttcccggatggaaagttctagctccatattctgcagaagatgctcgaggtttgctgaaagcagcaatcagggatccagatcctgttgtgttccttgaaaatgaacttctttatggtgaatcatttcctgtatctgctgaggtacttgattctagcttctgccttccgattggaaaggctaagatagagcgacaagggaaagatgtcactatcactgcattctccaaaatggtgggatatgcccttcaggccgctgatatactggccaaagaaagtatcagtgccgaagtaatcaatcttcgctcaattagaccgctggatagagctactattaatgcatctgtgaagaaaaccaatagattggtaaccgt

SEQ ID NO: 75070 - DNA, 302 bp, Zea mays
  Clone ID: LIB3079-055-Q1-K1-B8
cccacgcgtccgcccacgcgttcgcccacgcgtccgcgtttgtatatctaagcacagtactgctcattgcatttgggtttcatggattttgtcttcattatcttatatttgttatgcaccctcattttttgtgcaggaggcatgctctcttacttcccaagatctcttgcacggaaacacatccaaagatagcacagcttctagaacatcacaaacctaatgtgtcacttcttatgctaaagtgtgcagagtgcgatagcttctctgctacagaaaactttgaaaaagatggcggttcatct

SEQ ID NO: 75071 - DNA, 425 bp, Zea mays
  Clone ID: LIB3079-055-Q1-K1-B9
cccacgcgtccggctatgtgtacaaatgacttcatttgcttctatgattgggcagggtggagattgatacgtcgaatcgatgtcaatgtgaagaatctttactgggctgacagtggtgatttagtaacaattgcaagtgatacgtcattctacattttgaaatataatagggatgtagtttcatctcatttggatagagggggttcagctggtgaggaaggtgtggaagatgcctttgaactgcttcatgagatcaacgaacgtgtccggactgggctatgggttggcgattgtttcatctacaataattcttcatggcgtcttaattactgtgtaggaggagaggtcacaactttgtttcacttggatcggccaatgtatttattaggatatcttgcaaaccaaagccgtgtctatcttattga

SEQ ID NO: 75072 - DNA, 233 bp, Zea mays
  Clone ID: LIB3079-055-Q1-K1-C10
ataaaaaaaaaaaaaaaaaaaaaaaaaaaattaaagcaaaaaaaataaaaataaccgggcccgcgtacacctatataatacaaatctccatctactctagtgtaaactacaataaagttcactaacccaatttttaccacattatcactcaaaaaactcctgacctacccaactttttcattctgctattattcactccattgccctccggcatcatatgccgtacacatatt

SEQ ID NO: 75073 - DNA, 384 bp, Zea mays
  Clone ID: LIB3079-055-Q1-K1-C11
ggcagccatcgctgacctccgccaggagatggcctcggatgacatcgagaagatcgaggggaagcttgaggctgccaacaaggctgtctcgaagattggtcagcacatgtcaggtggtggctctggcgactcacagtcgggatctggacctcagggtggcggtgaccaggcgccggaggcagagtatgaagaggttaaaaagtgaggctgcgggaagttgaggcgaaattgtagtgacctgtttagaagtagctactcttttttgggaacacagatagtcagatgagatgtaaaacctgtgttgtaataatcgttggatttgcccccacttagtttccttctgcggcgatggaggtaacacgacattgtcattgcttttgttgc

SEQ ID NO: 75074 - DNA, 410 bp, Zea mays
  Clone ID: LIB3079-055-Q1-K1-C12
cccacgcgtccgcccacgcgtccgggtgcctatggtcgtcgagcttgagcacggggaggggtccgccggcagccacgaccaccaccaccacctgcagccgcaggggtcggaggaggacaccgacgtggaggccgcctcccacgtgagccaggccgaggccgagccgccggtcagcatccagagccaggcgctggtggcggaccaggagggtgaggaggtcaggctggaactcacgctcggcttcgagccagtcgtcaggcagcagccgaggctgtcgtgctgcgactcgagcggcttgagcgccgcgtcgagcctcatcggcctgcggctgcagctgccagccgcctgagcagaggaggtcatctcatttcacaaggcacagtggcacaccaagtgcagttttgcaacca

SEQ ID NO: 75075 - DNA, 248 bp, Zea mays
  Clone ID: LIB3079-055-Q1-K1-A2
caatctttaacgacagcaaggtcgcagtatctgttgacctgcccaaggaaatgggctacgtgtatttctttcagaggattagcaactaggcacgtcacacacaatggaaagaatggtgggctgttaggatactgtcttgctgattttaaagcgaacgtttactcacatcctgccatgctggttactgaatggtcaaccgggatatttgcttttttgttccttgagacctcgattggcatcttccggtt

SEQ ID NO: 75076 - DNA, 406 bp, Zea mays
  Clone ID: LIB3079-045-Q1-K1-A12
ccgacgcgtccgtagccctctcctttgtagcagctatgtttgccataggctctcatgggtggttttactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcgcaagagggaagcgcttgacgtagtctttagatttcaattgttgcagccgatcaaccttcttagggttgtataata

SEQ ID NO: 75077 - DNA, 272 bp, Zea mays
  Clone ID: LIB3079-045-Q1-K1-A2
ccaacccgtccggttctaaatcgcgggctgtctttcgcgatctagaaccctacgcgtccagtcagattttgtaacatatctaagccattgatttgtaaacttccatcttaagtgtaaatttgggttcccgaagggttgtttatgcccatttcgcttatgagcttctctataacatacagttaacacttaacagctgctccgcatttgcaatctcccttgtttcataatgagtcgactgatggtatcaatctgtcaagatatatttgggtgaa

SEQ ID NO: 75078 - DNA, 371 bp, Zea mays
  Clone ID: LIB3079-045-Q1-K1-A4
acagcatccacccagtatcatgaatcccgggtgttataccatcgagacagtctgtccatggtgatggtgaaagctctgcttctggcaatgcactggcaggtatctcatttgcatccatggcaccaagttcaggtcaccaggcgatgtcgtccacatcagactcacatccagttttcccagcatcctcgcttctaccaggttcaggtccagggtcgatgacaaactttgtgcggtcaagtaccagaatccctgttgtcatggcgagcgatacaagcaccacgcctgaatccatatgttcaccacatcggatgtggtccactgaacgctgcaccagcaggaattcaacaagctagagctcatattggacgcac

SEQ ID NO: 75079 - DNA, 408 bp, Zea mays
  Clone ID: LIB3079-045-Q1-K1-A5
accaaccccagggacgagttccagcactgggtgaaggacatgaggcacagcactagcatggaggacgaggaagggtacccagcgttcgcgctggtgaacaaggtcaccggcgaagccatcaagcactcgctgggacagagccacccggtacgccttgtgccctacaaccccgagtacgttgacgagtcggtgctgtggacggagagccgcgacgtctggcacggcttccgctgcgtgcgcatggtgaacaacatctacctcaacatggacgccttccacggcgacaaggaccacggctgcgtccacgacggcaccaccgtcgtcctctgggagtgggccaagggcgacaaccagcgctggaagatcctgcccttggtgaacgtgaacagagacgagctagattaattc

SEQ ID NO: 75080 - DNA, 460 bp, Zea mays
  unsure at all n locations
  Clone ID: LIB3079-045-Q1-K1-A6
cggacgcgtgggctattgtagctcatatcatctgtcacccatggcgaagtgcatcaggttgcaaggattattctggttgctttccatgattcttctagcatcctttgttgctcatgcacgcacaacaagtgggcacaccaaagaggacagcaatgctaggaacatgacgatgaccaagacgagggcatcgggcaacatacttgttagccgtaatgacgacgggccatgctatctagattccggtcttaatgagtacgtctgcagaaagactaataagtgctataagagcttggtgctctgcgtggcgagttgtcaaccatcatcatgaattcatgatactgcggaaacatcatgatactgcggagacagactgctagagatgaggctagctagatgctggttcaccaaaatattatgtaacaccccaaatctccattntaagaaataaataagattttcg

SEQ ID NO: 75081 - DNA, 394 bp, Zea mays
  Clone ID: LIB3079-045-Q1-K1-A8
gaatgatgccccagcagcagatgagaacaatgataacaaggatgctactgcaaatgaggaggaagaaaaggaagaggacaaggagatgactctggaggaatttgagaaaataagagaggagaagaggaaagcactacttgcattgaaggctgaggagaggaaagttgaagttgacaaggatttgcagtctctgcagccactttcaaacaagaaagaaaatgatgaagttttcattaagctgggttctgacaaggataagaagaaggaaaatgctgagcgtgatgagcgtgccaagaaatcggtgagcatcaacgagttcctgaaacctgctgaaggagaaaggtactactgcggccgtggccgtggaaagggccgtggggattcgtgtggtttt

SEQ ID NO: 75082 - DNA, 404 bp, Zea mays
  Clone ID: LIB3079-045-Q1-K1-A9
cgacagtgatggtcacgatgggggcataccgaaagataattgaagataataaaaatggattgtgctatctaagggctctagagtactgttgtgcaaggaccagacaatgctatgatgacataaagaagtgcttggagcattgccgtggttgaaaggtgtaataaaggatatgctttctttggatcttagttggtgatcagaaaaatgttctaccaattcatgcatgtaccaaaggataatataagctgctcaaaaaatcgtggttaattagagttttttgttggaaaaatgataacttccttacaaacatataccaaattaaagagaccctcttaatgcatgatctatcttttaataaagaacatattccatagtaaaaaaaaaaaatttaatatattttttaa

SEQ ID NO: 75083 - DNA, 418 bp, Zea mays
  Clone ID: LIB3079-045-Q1-K1-B1
caatgtgccaggaaggatatatgggctggtgggctgggacttagggtcttgtccttctttggtggcctttgtgctgttgctttaaagtttcttataatcatatggcatcttcttgcctcgctttatgatcacctaggaactgccttgccttggtgcctgagtaatctcgaatatatcgtatagatctttggtcttcagtactctaatgaaaataagacaaattctcttgaaaatacaaatcttgtgatagtgaaatgaaattcattttgtttgtatggcatgatgagctacgtgatgctgtgctgcttgttttcgccaacaagcaagatcttcctaatgccatgaatgctgctgagatcactgacaagcttggattacactccctgcggcagcgacactggtacattcaaagcacttg

SEQ ID NO: 75084 - DNA, 409 bp, Zea mays
  Clone ID: LIB3079-045-Q1-K1-B10
attcccgctggagccactcatcctagttattaggcttctgcaacacggtttcttaagaaaggcactacacttgattctggcagagttattctgaagggggttacacctgagctttcttgccccattgttcttttcacatactataatccaattctgaaacgtggtgtgggaaacttcatgtctactatcaaacaagctggcatacatggacttgtagtgcctgatcttcctttggaggagacagcgttgctgatgagcgaggccattatgcacaacatagagctggttcatacccactctcatctttgcatgcaccacttgcacaaaatttgttgcgtacttgtgttgctatctgggtgctaactaaattcttactctagatgggacctatcaaatcttcagcttgggc

SEQ ID NO: 75085 - DNA, 390 bp, Zea mays
  Clone ID: LIB3079-045-Q1-K1-B11
tagaaatctggtgtggtgtataacaagtgttacctgtgggaggcctgtgataatgcccgttatgtctcaacatccattttcgtgcattccatgttcttcaatacggacttgaaacatgaattctgattttcttattactaccttcaagtttcagctaaaatactataaaacaaactaacatacatatactaaaaaataaactaatcttccttcgatctagacaaccctaccttacgaccacgtccttatgcacaacaatatatctttttcatacccactattatatttgcattcaccacttgcacaaactttgttgcttactaatacctttttttgcctacttactaaatttttactctaaattgttatctttcaaattttcaatttgtt

SEQ ID NO: 75086 - DNA, 240 bp, Zea mays
  Clone ID: LIB3079-045-Q1-K1-B12
cccactcatcctgcgccactctatatgccctctaccatttgctccacctcaatgccctaccctacaaccagcccttcctaaacatgctcagcatgtactaccactatcatatcacctaccagttcacatgcaccaccatcacattactacccttcacagctcctcctctctattacatcacactctcctacttctaattcctctccccacactccaacctcaatttctaccacctcttct

SEQ ID NO: 75087 - DNA, 462 bp, Zea mays
  Clone ID: LIB3079-045-Q1-K1-B3
atccctcctgttcttcgtcaaccctccagaacctgctctctcttcctctacgagactacgaccgtgtaaggacatggccgtcgagcgcttgaagaccgggttcgagcagttcaaggccgacgtctacgacaagaagccggagctgttcgagccactcaaggcgcaccagtcgcccaagtacatggtgttcgcctgctccgactcccgcgtgtgcccgtcggtgaccctgggcctgcaccccggcgaggcctttgccgtccgcaacatcgccagcatggtgccgccctacgacaagaccaagtacgccggcgtcggctccgtcatcgagtacgccgtctgcgccctcaaggtggaggtcatcgtggtcataggccacagccgctgcggctggatcaaggcgcttctcttcctcgaggacggtgcgcccgacaagtttcacttcgtggaggaatgggtcaaggt

SEQ ID NO: 75088 - DNA, 343 bp, Zea mays
  Clone ID: LIB3079-045-Q1-K1-B4
cgactgcttcgtcaatgggtgtgacgcttttattctcttggacggcgacgactgcgagaagttggcactgcccaaccggaactcggtcagagggttcgaggtcatcgacgccataaaggcggatctcgagagcgtctgcccggaggtggtgtcgtgcgctgacatcgtagcccttgccgccagctatggagtcctctttagtggagggccttactacgatgtgcttctggggagaagggacgggctggtggccaaccagtcatgagccaacagtggtctgccttcgccgttcgagcccatcgactccatcattcacaagttcgccggcgtcgaccttaacacg

SEQ ID NO: 75089 - DNA, 374 bp, Zea mays
  Clone ID: LIB3079-045-Q1-K1-B5
gtcatttgaagacagaaatcatgtctatgtttgatgatctaactcaagatgaccaagatggagtgcgactatgggcagttgagggttgtgctgctctttgtaagttgttggagccccaatattgtgcagcacatattctcccagttatcgtaaatttttctcatgataaatcttggcgtgtgcgctatatggtggcaaatcaactgtatgaactatgtgaagctgttggtactgaacccacatggggtgatctggtgtcagcttatgttcgccttttctgcgacattgatgttgaattgctgattgcagctgcttgaaatgttcaaaattcttgaaaattttaaacccacaaattgcaattgaacattattttt

SEQ ID NO: 75090 - DNA, 325 bp, Zea mays
  Clone ID: LIB3079-045-Q1-K1-B6
catccgaccagctgggcaggagagtcgtctctgacagccccgtgtacgacggccgtggcggggacgcccgcctcgtggctcgcatacagggagtcacggtcctggtcggtaacgcagacgccttgttcaccatggtgttcgaaaccgacaggctaaagggctccacgctcgtcatcaacggaatggtcacggatgggtcagactaatgggcgatctacggcggaaccggggtgttcgccatggccaccggtgtcatgaagagaagaaaccttgccggcggtagcaactactggaactctgacgagcttgccctggaagttttctg

SEQ ID NO: 75091 - DNA, 442 bp, Zea mays
  Clone ID: LIB3079-045-Q1-K1-B7
gctatattttgccaccaacgctgcaactttctgttgttccatcaggtggttggcaatgcagtgatgctcggtgaaatcataaactacgtgcagtccctacaatgacaagttgagtttatgtccatgaaactggccaccgtgaatccccaggtggacttaaatagcctgcctaacgtcctccctaaagatgtacatcagtcttgtggtccgccacatttctcgctggagacctcatacgcttcgttgtcgtacctcagccagcctcaccatggaagccctcttggctgcatggacaaccagagttgtatgcatccacttgacacgacgttttgcctggcgataaatccgcagtattcatttccttaacggtgttagcgatgcatcggcttagttgcagctaatttgatgcttgtgtttatggaaaccaagaagtggcgctgat

SEQ ID NO: 75092 - DNA, 425 bp, Zea mays
  Clone ID: LIB3079-045-Q1-K1-A11
acccgcctcgagccacgcgtccgccgacgcgtccgcacccggttccgcgttcctttccccacctactctcgcggctctcggcagcctgtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaatggcgcgattgggggctcgggtctgaagaaaagtggaaagaaatgagactggtcacccgtctccaatacctagaggatgataaggcagctgtctatctgtgttgcgctttactaaatgtgattgtaacagtggtacctcttgtgttctgtg

SEQ ID NO: 75093 - DNA, 141 bp, Zea mays
  unsure at all n locations
  Clone ID: LIB3079-043-Q1-K2-G10
taaaaaaaaaaaaaaaacaaaaaaaaaaaaaaaaaaagtttaaaatggtcttctcttattaaataatccaggctgtacgtacatataaatacaacagtcctccctcttctatcatntctacctaaattcaattcgctcccc

SEQ ID NO: 75094 - DNA, 217 bp, Zea mays
  unsure at all n locations
  Clone ID: LIB3079-043-Q1-K2-G11
gtttctctctcgaaatcggccgtctctctcccgtccggcacttcctccgatcgactagcctgcggcggcgccggcgccggcgaccagcggccatgctggtggcacccaaggtgctcttcctcgtccgcgacgccgcgggctacggcgctgccctcgccgacgcgctccgnccgccgnccgggctaactagggagtcctcgcccttcgagctccccct

SEQ ID NO: 75095 - DNA, 315 bp, Zea mays
  Clone ID: LIB3079-043-Q1-K2-G12
ggcttctcctccccctccggttcgggttcgggttcgtgaggttctccggggttcgggttcgtgggtgagcggatcgagatggcggcgtcggatgttgaataccgcttcttcgtcggcggcctcgcctgggccacggacgaccactccctccacaacgccttcagcacctaccgcgaggtcctcgagtccaagatcatcctcgatcgggagacgcaaaagtcccgcggcttcggcttcgtcaccttctccacggaagaagcgatgcggaacgccatcgaaggcatgaacggcaaggagcttgacggccccaacatc

SEQ ID NO: 75096 - DNA, 266 bp, Zea mays
  unsure at all n locations
  Clone ID: LIB3079-043-Q1-K2-G2
taatggtggcctgcctaccataataaaaataatatataccatgtaagccagacaccaataaacagantctttttacaaacgtgaatcacatccatgntgnccggctaacatggtatatattatctttattgtcgtctcgctaacatgataaatacacatatttttcccaaatactgctctgtcatcacgaacccagacatgttcaaaagccctaactcagacacatacgtcatattctacgaggccaagatcaatattaccccata

SEQ ID NO: 75097 - DNA, 359 bp, Zea mays
  Clone ID: LIB3079-043-Q1-K2-G3
tccgaattcccgggcacccagcgtgccttcccagatccattccacccgaggccgggccgcccaagcaaatctcacgcacagaaacaccaaagccccagaggcccaaactcaccacctcccaatggagaacggcgacgaaaccctcgcctcccccacggccgccgccgagacggacgcgctcaacggcggcgtcgcggaggaggagcaggtccccatcacccaccccgcaaagtcctacgtcacgctcgccgacgacaaccccgctcctaacggcggcgtcgtgaaagaggaggagggcggtgcccacaccaccgcgaagtcctacgcagctgtcgccgcccaaaccgagatcgaggacc

SEQ ID NO: 75098 - DNA, 415 bp, Zea mays
  Clone ID: LIB3079-043-Q1-K2-G4
caagggtgcctcaccgaatggcacccaagtcaatgtcttgcaaccttctcaagtttttccccaactgctggcaacataaacgtcctcgtcatcgctgctctgctgttcctcgtaatcctttgatcacctcaactccccatgacaatcttttcaaaaaccaaatcaacagatatgattgattttagttaaaacttggtttaccatgtattgagttacgtatagtgcgatagtatcacattcttttggcttgtgtctacagttccagtaggagttaggatagaacacaggatgagtccatagccctttttttgcacgttcataatgtactcataatgtacctggtgggtgtactgtgtacatattaaatatgacttcaggatgtattgattttataagataattgaataatgatgct

SEQ ID NO: 75099 - DNA, 324 bp, Zea mays
  unsure at all n locations
  Clone ID: LIB3079-043-Q1-K2-G5
gcgctgaaaatgaagatgatgaccacttatcttataatgttcctgatccagatttccatgantttgacaagagtcggactgaggaatagttccaaagtgatcaaaatttggctacatatgatgatgaagatggaatgcctcgtattatgcattattcaaaaaagtctttccttgaaaccattcaagctcagaataagctatctcacatcaagagcaaatagtgaatttgggcctttgaattgggtttcttctggcttcataaagacttgtggtgatttcaggattggtaaatatgaaagctgtgatatagtcaacatgttctct

SEQ ID NO: 75100 - DNA, 335 bp, Zea mays
  unsure at all n locations
  Clone ID: LIB3079-043-Q1-K2-G6
ggtcgaccgacgcgtcggaagcatcagcggcaggagctctgggcagcgtgcgcacgtggggtacctagctcgctctgctagcctacggagngggtgatcaccaccggggtgcgacgggaggtggcggnggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccctgtgctggtgatattcattccggtgctg

SEQ ID NO: 75101 - DNA, 356 bp, Zea mays
  Clone ID: LIB3079-043-Q1-K2-G7
cccacgcgtccgctcggcccaggtttaggtaagttccccttcttttttattattttttgctgttttcaggggcaagttttgatttcaaattttaaatctgtgtttaagctctcaaattcaaacaaatgcagcaaacaaaaatataccagcatgagatgcaaatacctaatgttattagttaatttactatcctattttaagcaaatgcctttacacatgcaactcctacactaaaaaataggcatttttgagaaaaatgatctctagtatattaaaatccctaagagagagcttataaacatataattcaacaaacggatgactggactttatgtaaagataaatttatttaatct

SEQ ID NO: 75102 - DNA, 471 bp, Zea mays
  unsure at all n locations
  Clone ID: LIB3079-043-Q1-K2-G8
cccaagtgcgcttcacgcaaatgtcgatctgggttcttgaggactatgatacagaagcatggatcctaaggccaatgtgagctcttcgcagttctttgaattactgagtcacccaatcaaagacttccatattgtggccattcatccagatcacaattcgttcatccttgttcagcactggaaccagaaactggtatcatataacatggatactcaggaactgcatggtctctgcactcttggaaagggctatgtgattattaccccatatgttccctgtttcttggagtcatcggttcttgccaccaaacactgaggttgttgtttctggggacttctctgcatgttcaacaagagcctgatcatccaagtgtggggcaaggtgatctagtctgatggtgctttaatgtccttttgtaatgctttgagaaagctngttacaggacaacatgggtagttctatgatatatc

SEQ ID NO: 75103 - DNA, 266 bp, Zea mays
  Clone ID: LIB3079-043-Q1-K2-G9
caagcaacatagaaagtggaatccagtagcaacaacagagcaacaatggcgaccaagatattttccctccgtatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcacccttgttgtt

SEQ ID NO: 75104 - DNA, 349 bp, Zea mays
  unsure at all n locations
  Clone ID: LIB3079-043-Q1-K2-H2
gcgcggtcggttctgggcgccgggggggcccccccagccgccggggaaccggcccttccggggggccgccggcggcgggtgagcaggcatgcgggacgagccgtcntccgtcntccgcggcgaccggcggcggggcctgggcctgccgctcatccgcatgctccccgtcgtcaagttcactgccgcctcctgcgacgccggcgccggcgctggtggcgtggcgccgaggatatccgtgtcggagtgcgccgtgtgcctgagcgagttcgtggagcgcgagcgcgtccggctgttgcccaactgctcccacgccttccacatcgactgcatcgacacgtggctgcagggc

SEQ ID NO: 75105 - DNA, 422 bp, Zea mays
  Clone ID: LIB3079-043-Q1-K2-H4
ccgttcgatctcccattcttcctcgtctccgccgccgtctgccccacctccaaccaacgcccaacgatcagtatgccagaagcttccccggcaaccttcgtccccgtcccggatccggggcgcccctgatgcggtgcccgcgcggcgcgatcgcgtgacggacggccgccatggatcccccaggccgcggcgaccaaggcgaggcgccgcagccgcagccgctggagtggcggttcgctcaggtcttcggcgaacgtgccgcgggcgaagacgtccaggaagttgacatcatatctgcaattgaatttgacaaatctggtgaccatcttgccactggggataaaagaggacgtgtggttttatttgaaaggacagatgttcgggatcagaatgccagccagagagaactggagagacaagat

SEQ ID NO: 75106 - DNA, 408 bp, Zea mays
  Clone ID: LIB3079-043-Q1-K2-H6
cccacgcgtccgcccacgcgtccgcaaatcccgtgctcccccgtctgaaaaccctccccacctccggcggcggcggcggcgctggcgaccgggtgtcttctccggcgagtctcccccctagtaacaagaaaatatggatgtacctgttgatgaccctgtggagaacctcactggaagtcctagtacccttggcaatgaggaagaagccactacttatgctaatgtgcaagatcagtccaaggaagaaccagaaaagctttacgaggaacccaaagacccaatgcaagacgagttgggtaaccaagggcatgtgagcatgaacaatgaagatgtgggaggccagaacaaagtggaccaagctacccccacagagcacggcgaggaagctggggtgaagcaacatgatgc

SEQ ID NO: 75107 - DNA, 356 bp, Zea mays
  unsure at all n locations
  Clone ID: LIB3079-043-Q1-K2-H8
cccacgcgtncgcccacgcgtccgcttcgtagcgccggcgctccatcttccgttccttccttaagtgggggtcggaacccggttaacggcggcagtgccgcaattaagaaccggcttttaacgacacggttaaccggtttcccttccggtttttttcaagtggcttgcgcccttggcttcggtgcttccacaccaagcggggacccttcatatagggtgtgagactaccaaaactcgaaaatgaacaagggaaagatttttaagctagccaagggattcagaggaagggcgaaaaattgcataaggatagcaagagagagggtggagaaagcgctgcaatattcatatagggatcg

SEQ ID NO: 75108 - DNA, 252 bp, Zea mays
  Clone ID: LIB3079-043-Q1-K2-H9
gatcacactcgtagagagaaggaaaaatatccccaaaccctagctcccgatctcgatggcgaaccctcgcggcttcttcgacatgaccgtcggcggcgccccggcgggccggatcgtgatggagctgtacgccaacgaggtgcccaagaccgcggagaacttccgcgcgctgtgcacgggcgaaaaaggcgtgggcaagtccgggaagccgctccactacaagggcttcacctttcaccgcgttattcccga

SEQ ID NO: 75109 - DNA, 370 bp, Zea mays
  Clone ID: LIB3079-045-Q1-K1-A1
tgcaaatcctgcagacaccaccgctcgtttttctctccgggacaggagaaaaggggagagagaggtgaggcgcggtgtccgcccgatctgctctgccccgacgcagctgttacgacctcctcagtctcagtcaggagcaagatgggtgccggcggcaggatgaccgagaaggagcgggagaagcaggagcagctcgcccgagctaccggtggcgccgcgatgcagcggtcgccggtggagaagcctccgttcactctgggtcagatcaagaaggccatcccgccacactgcttcgagcgctcggtgctcaagtccttctcgtacgtggtccacgacctggtgatcgccgcggcgctcctctacttcgcgc

SEQ ID NO: 75110 - DNA, 445 bp, Zea mays
  Clone ID: LIB3079-045-Q1-K1-A10
aattcccatctcgagccactcatccagcgaaagctcatgagaaggatgctgattcatttcaagttgacaatgccagtgagaacgaagctttttaaccataagcgacttatcagctccttacgaatccagctcgcgtgatccctgcccaggagaagttcatcaagctccttgaaaacagccgatatgtacctgtgaaaccagcgccttctggattcatcctcctccgagacctgcagccgactgatgctgaagatcttgcgctgaccgatgcccccacaacagtcgcatgaagcaccggcaacactgcccctgctgcaagccaacaagggtcatgatcatcagccatggccgttgacgatgagccacagccgtcacaaccctttgagtacacctcttgagcgaccgagcgttaccttttcttattcgttttttttttgactttttt

SEQ ID NO: 75111 - DNA, 405 bp, Zea mays
  Clone ID: LIB3079-043-Q1-K2-F9
gatgccatatatggatccgccctcaacatccgcaaggatctcgatgcccaaatcctctccaggttccagagccccctggtgctttgccgtcatctctgcttggatacgaggcactgacaggttccctggatgattttggatttgaagattatcttaacatgcctcatgattctgacagtttccgtcaacctgacatgcaccatggaatggaggttcgccttggtttgtccaagggacctatctgtcctagcttcaattgaggcagtaatgtaattctgctgcaagttcacctctcagtccagtacttcagtcaatagaccatattaagatggtgaaatatgaaaactggtagcttgcatctggtcaatgttatgttttaatcaacgcttaaattaatatttgtcc

SEQ ID NO: 75112 - DNA, 203 bp, Zea mays
  Clone ID: LIB3079-043-Q1-K2-E1
gcgcccacgccttcggaggcgccaaggtcaagaaagaagatgtgccgttaactcttaatgggtgaattgaggattgtggcatgctaatcgactaacaaaatccttgacttcgtcgattcattaacctatgaatgtatctgggaactgatgactgaaaaatattgcatgaaaatacatggtggtcaaacagaatttgaaccatg

SEQ ID NO: 75113 - DNA, 224 bp, Zea mays
  unsure at all n locations
  Clone ID: LIB3079-043-Q1-K2-E11
cccacgcgtccggttggcttctcctccccctccggttcgggttcgggttcgtgaggttctccggggttcgggttcgtgggtgagcggatcgagatggcggcgtcngatgttgagtaccgctgcttcgtcggcggcctcgcctgggccacggacgaccactcccttcacaacgcctttagcacctacggcgaggtcctcgagtccaagatcattctcgatcggga

SEQ ID NO: 75114 - DNA, 339 bp, Zea mays
  Clone ID: LIB3079-043-Q1-K2-E12
tttttttttttttttttttttttttttggtttttttttattttttttttttttaaaaaattccgccttttttataataaaaaggaggcccccacaaaacccctttttttcaaaaaaaaaaaaaaaaaaaaattctcccattatccttcccccaacaccccgggaaaaaaaatttttttttttttaccccaaacacaaaaaaaacccttgtgtttaaacccaaacatttctttttttctacccccccacacaaaaaacaaacctttttatattttttcctcacaccccacctaaaaaaaaaaacaaaaaatttctcccccccaaaaaaaaatcccccccc

SEQ ID NO: 75115 - DNA, 224 bp, Zea mays
  Clone ID: LIB3079-043-Q1-K2-E3
ttcttattttacctccacgattacacgctgttttctggtgatgagtggtggttggtggctagcctccaggtaaagatactttctgaacagaatatggttgctgaagctattgatagctgtacagttatggccgcttgggatggtgtgccatctggagttttgtgctaacatgcatgtgatttgacgctgcaatgtgtactagcaacagacttggttttcttggt

SEQ ID NO: 75116 - DNA, 489 bp, Zea mays
  Clone ID: LIB3079-043-Q1-K2-E4
gtttggagggagttgatcgagagaaaaccagaagcaaagaaatggatgatgaagacgattgaccattatgagggcttaatggatctatttggtaagaatagggagaaacgtcaagacgttgagaactcaaaaggtacctcgaagaaaaaggcgcgaacagaaccgccaaaggagatacttcaacgtactccattaaatcggaaggggtcagctcttgccgaaagttcagataagacggtggacaaatgtgagatccatgatgagataaaaacaaatgtggaacttgatttgtcagaatcgtgcagaactgataatggcattgttgccatacctgttcgtgcctattcatacggtaaaggtttgccctatgctcctgaaaattggccacgtcatggagacatatggcactggaaagttggaagcagggcttctggagcaggccattgggctgacaggtatattatgccgccatcccgttttcgtggcgct

SEQ ID NO: 75117 - DNA, 472 bp, Zea mays
  Clone ID: LIB3079-043-Q1-K2-E5
gcggaacaggctggtgcattgctgtctcaactctcaactcagctgggagatctagagaatgtaactgattctgcagtgcgaagggacattcaaagtagtgcagttcgcacgggttctctatttcagaaccttggttctttgcttctggaacttgggcgcaccacaatgctcctgcgtataaatccgtcatcttcagaagcggttgtaaactctggaccagctctttatatatctccatcagggccaaatcctcttatggttcaacctgttccatttccaggaaggtctgtccaaatgggtactttgttttctagtctgggttcacaaggatctgttctacatccgagagatgttgatatccatgtccgcacaagtgggtccgtgcctggagccagtactaacccaagtgattcagctggtgcgcaagcgcatcaaaatgtgaataggccaggagatgcttcgcatgcaaata

SEQ ID NO: 75118 - DNA, 216 bp, Zea mays
  unsure at all n locations
  Clone ID: LIB3079-043-Q1-K2-E7
ggannnccggtcgacgcgggcgtccgaaaaaaaaaaaaaaaaaaaaaaaaagaaaacaagattattataaataaaaaggaaaataaaaatttatggggggtgtatgtcttataggacgaccacttcctatcccagcacctgatctactgtatatggcattccaacagcaagagacgtgtttcgtaacctgcagaagagggggaaacttctgttaaa

SEQ ID NO: 75119 - DNA, 82 bp, Zea mays
  Clone ID: LIB3079-043-Q1-K2-E9
aaaaaaaaaaaaaaaaaaaaaaaaaaaaaaaaaaatatataaaaaaaaaaaaaaaaaaaaaaaaaaaagggcgggccttttt

SEQ ID NO: 75120 - DNA, 417 bp, Zea mays
  unsure at all n locations
  Clone ID: LIB3079-043-Q1-K2-F1
ggcgaatccttttgcaccaacttgaaaaacccaaaaaactttttttggacaaaaaaaaaaaaacctgttttcaggagggggatggcaaaattcactccacagaataatgcgcaaattccatggattctgatactagaacatggccgtggtgtgtttcacaggacgcgcctgccatctgatttgagggtcaagtggaggagcatgcanaggaaaaagtgggcaagctactgatcttacacgcncccgcgcacgtagctgttgtgtctcatgctaaattactaaccataccttcatttctctgtgtccatctgcagatctgatagccgtgacatggaacactgacgtggtacttgtacatagcgaatgtgcaagtangaaatgaggagggtttcttctaattacttttgcagcccttaa

SEQ ID NO: 75121 - DNA, 285 bp, Zea mays
  unsure at all n locations
  Clone ID: LIB3079-043-Q1-K2-F10
gcttgacataaccggacttcctcacctggttgctctagtatgatgtggagcgtctagttaaaaaaaatcgatntagtatgaagcaccttgctgctctgaatattaacaggcaattaaggcaaggtgctgtttcggtttggtggaccgcatgttgcagataataaattagttgttttgtcatttgcgtctctatcgactttgctagtttgcttcttttggccaccgcccaactagtcgctttcangagaaaaaaaaaaaaaaaaaaaaaaaaaaaaaaaaataaaa

SEQ ID NO: 75122 - DNA, 297 bp, Zea mays
  Clone ID: LIB3079-043-Q1-K2-F11
cggacgcgtgggctagccgccgccgccgccgctcgtctccctgagaggtgccgggaccgaggaactggccgagtactatgtagagaatcggtttttcttgtctcagcccggggtctgctgcgtctggtggtggtgaaggggagaaattcgtgagatctgttccggatcaagcgtgcgagctcgggaatcaggggtttcacacatagcttcgtcgatttgaatttgatgtactaatggagtctaagggtggcaaaaagtctaacagtagtcggtctatgatgtatgaaagctcccttg

SEQ ID NO: 75123 - DNA, 294 bp, Zea mays
  unsure at all n locations
  Clone ID: LIB3079-043-Q1-K2-F12
aaaaaaaaaaaaaaaaaaaaaaaaaaaaaaaaaaataaaaaaaaaaaaaaacaaaaaaaataaaaaaagggcggacttatttaaaaaaatcaaagcccgccaacacatatattcggctctcacccttattcaattctattctcccttnccttttctctcttgctccattgtttaaacctggggagacccgcaaatttatttcattttacctaactttaacccttttgccacctttcaaaacttttgcaaattccccattatatccacttttcccaatctttctttttatttaaa

SEQ ID NO: 75124 - DNA, 391 bp, Zea mays
  Clone ID: LIB3079-043-Q1-K2-F2
gcgccaccagggaacgttgcaggaaaccacacctgggttggtgccccccagcggcccccggacctgcgtgtgaggcctggacgccacgtccagctgacggttccgctggagcagctgatagaccggctggtgaaggagaacagggtggtggccttcatcaaaggatcaaggagcgctccccagtgcgggttctcgcagagggtggtgggtatcctggaagcgcacgccgcggatttcgtgaccgtggatgtgctcgacgaggagcacaaccacgggctgagagaaaccctcaaggcttacagcagctggccgacgttccctcaggtcttcgtcggaggggagctcgtgggaggctgcgatatcatttcgtccatggctgagagaggggagc

SEQ ID NO: 75125 - DNA, 325 bp, Zea mays
  Clone ID: LIB3079-043-Q1-K2-F3
cggacccctgggcctttcttcaacctgctcttgggcacgctcaagatcgtcgccgactactaccccggccgcctgcaccgcgccttcgtcatcgacgcgccctccctcttctccgtcctctggaagggagtgaggccgttcgtggagctggcgccggcgacggcggtggtgtgctccctggacttcgaggactcactggaggacgcctccttcacggcgtacccgcggaccgcgtccctgcggttcgagccgccgccggcggcggtcacggggaaggccggcgtggggtcagcctcgtcgcggttctccgtcacccccaccgaca

SEQ ID NO: 75126 - DNA, 437 bp, Zea mays
  Clone ID: LIB3079-043-Q1-K2-F4
gcctttgtagctgcaaattaaattgagctgtacctgttggtcttcctcctcgctcttcttgggtcgcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgatgcactcactcccagaacaagatcatcagctccaggagaacatcaaggtccatggcatcaacggcactttgcacgatgatcatcagtactgcggccatttggatcagctcggttcttcttcgtcgt

SEQ ID NO: 75127 - DNA, 457 bp, Zea mays
  unsure at all n locations
  Clone ID: LIB3079-043-Q1-K2-F6
gcgcataaatctcgtgctcgccactattattctgcacagcaacgcatcagccttctggaaccatctcgccggcgcgcaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgccgccgtcgcggcgtcgtcgcccttcgccgcggctctcgtcgcctccgccgccgccttcctcttcgccgccgtccgccactgagccgatggggcctcgtgcctgcaggctacctagcagtacttnccccgccgccgccgccgccgcctagatctatttattggagtgctatccagtagtactagtagtagtgagatttgttcggtgctgtcgtgtcgtcgtcgcattttggtcggatct

SEQ ID NO: 75128 - DNA, 381 bp, Zea mays
  unsure at all n locations
  Clone ID: LIB3079-043-Q1-K2-F7
atcttgtgaccctccctcagccgcgtcgcgtcgcatcctacgatccaaagctctctctggtcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggngctggacatcgcggtgcggctgctcgagcccatcaaggaggagttcccaatcctctcttacgccgatttctaccagctcgcgggagtt

SEQ ID NO: 75129 - DNA, 360 bp, Zea mays
  Clone ID: LIB3079-043-Q1-K2-F8
cccacgcgtccggcgccgccgccgcgtctcctcctgtacaggtaaggagaggaagagggcgaaatggtgagagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctgttgatca

SEQ ID NO: 75130 - DNA, 429 bp, Zea mays
  Clone ID: LIB3079-043-Q1-K2-D9
agtgaatcacatgcggcagactgtgaatcttgtatccaatgaacgccaaaagctgttggatagagcagcggctgcagagaaaagattccaaaaaggatggaatacactcagggaagaagggcgttccattcaacacgagttgcgtgagattagtgatattgaaaaccaagcagtaggtctgaagggaattcttgatcagcttcccagagcacatgcatctgaatttcggtcgaagatgtctggcctagcttctcaggttaagaaggagaagcgagtgctcaacgccgccctcacgaagattgtgaactacggtgtccccatctgactgccactccagccagttgttctgaaggtccattgtattgtatcagatttttgtgaaggaagacatgttcgatgtgtagggtgaacgctatacttgccactttg

SEQ ID NO: 75131 - DNA, 448 bp, Zea mays
  unsure at all n locations
  Clone ID: LIB3079-054-Q1-K1-C1
attcttcgtcatttggcaaggggggatcccgtggtggtggtgactactatggtggaggcagcggtggtggttatggtggtggcggacacggtggagctggggctccgagtgcctgggattgatgttacagttgctcccaagtagaggggtctgccaagtttaggtcactttttactctagttctatttaggtatacatttttggtaggagctgttatacagcaacaagtacaaggtgaatgtggtcatcccctttcttcttctggttgctactggctgcagtcttaatcttgcagatgttcattacgaagagggtcttgaggacattcaagcacacgagattcctagttaggtgaaattccttggtagggatagtagctaggctctgacaagtagtgcttggtgccctntgctctttttccctttgtcagcgtcgaattttggtggtc

SEQ ID NO: 75132 - DNA, 409 bp, Zea mays
  Clone ID: LIB3079-054-Q1-K1-C10
tgcgcttcaaaggttgagccgtcaaaaaagaaagttaagaaaactactgttccggtccatgggtgggtctatggggccttggctgcagctgacctgcataaggctgtagagaaagagtatgagatggctcttcaagacagagtaatggaagaaacaaaggagaagaagaatgctgttgaagcttatgtgtatgacatgcgtaacaagctatatgacaagtacagtgattttgtcacacctgaggacaaggaaggtttgatcggtaaacttcaagaagttgaagactggctctatgaagatggcgaggatgagaccaagggagtttatattgctaaactagaagaacttaaaaaggctggtgatcctattgaggtgcgcttcaaagaatgggagattagaggttctgctg

SEQ ID NO: 75133 - DNA, 344 bp, Zea mays
  Clone ID: LIB3079-054-Q1-K1-C11
cttctaaccgtccatctgaggatgattttgaaactgaagcagatatttctaaaaaagttcgtgagaatttgatcaagtcatcagagaagtccgaaccatctggcattgaaggttcggacattggtaccgacactgaaacagaagatgatacatcagaaaaggagaaatctgattcacctgtagctgacaagctggttaagtcgaaacgtgtaacagatgcagaaatcagtaatcctgcttccaaacccaagaaaaatgatactggcctggataggactatatttattagcaaccttccttttgatataagtaatgaggaggtaacagcgcgcttctcagtcttt

SEQ ID NO: 75134 - DNA, 97 bp, Zea mays
  Clone ID: LIB3079-054-Q1-K1-C12
cccactcgtccgcccacgcgtccgaaaaattaaaataaaaaaaaaaaaaaaaaaaaaaaaagaaagggttaaaaaataaaaaaaaaaaaacaacggc

SEQ ID NO: 75135 - DNA, 145 bp, Zea mays
  Clone ID: LIB3079-054-Q1-K1-C2
ccaagataatgacatgaacctgtatttcaacattctctggtccaaatctgttttgttatcgtgagcataatgctgtatatacaagcgtatcgtcttctctgattattatatatacatggtatatatatatagatgttccagctgc

SEQ ID NO: 75136 - DNA, 449 bp, Zea mays
  Clone ID: LIB3079-054-Q1-K1-C3
gccaaggccatcttgctttcaaggataagcttagggctctcagatccgtaatacctgaagtgcgatattattttaacttgcaatattttgtatataggtcattgatctggcaacttctcttgcaaaagttgcggatgtggatagaaatcttggtaacgaaagtaccgcagttgagggttttgaggaagcaattcgatgccttgagaagttgaagctggattctgaacaaactaccctcgaacagcggcgcctctcggttctcgacttcctgcacaaccagttggccgataagtaagacatagtcttctcctaagaaggcaccaccagcagatatctcctcatggtaatgttcaactctactacataaagttccctttggaaagagttggtctagaagcagcgatgagtgtgtgtttaccatcgtttgaaactttgtcacggcacaaaat

SEQ ID NO: 75137 - DNA, 424 bp, Zea mays
  Clone ID: LIB3079-054-Q1-K1-C4
tggaagttacatacaagttcaatgattttgtttcccctttgctgacaagtagtgattttgatggagaagccaatggttatgctcttaggtcaatattctactggtaaaacaacttttatcaagcatctgctaagaacaagttatccaggtgcccatatcggaccagagccaacaacagacagatttgtagttgtcatgtcaggatctgatgaaaggactattcctgggaatactattgctgttcaagctgacatgccttttagcggtcttacaacatttgggactgcatttttatccaagtttgagtgctctcaaatgcgacattcactgctagagcatatcacatttgttgacacacctggtgttctttcttgtgaaaagcaacgcacacagcgcagctatgatttcactggtgtgacatcat

SEQ ID NO: 75138 - DNA, 378 bp, Zea mays
  Clone ID: LIB3079-054-Q1-K1-C5
tcccacgcgtccgaaaaaaaaaaaaattaattaaaaaaaaaacaaaaaatataaaaagagtacgattttataaacacatacatacaacaaaaataaaaattatctattctcactcctgctcaattctctgtccctccttctacaacgtctttactttaaaatccttccccctacccaccttaatcggtttcccttccatccccctttaacctgctgcaatattctcaaataactactcacttacctcccttcccatcagtttttcaccctctttcccaattggtactcgccctgtaccatttcatttacctctaactctctaatgcctactcgcatcttgacatttccattttcctatgccctacttccctctccttt

SEQ ID NO: 75139 - DNA, 204 bp, Zea mays
  Clone ID: LIB3079-054-Q1-K1-C6
aaaaaaaaaaaaaaaaaaaaaaaaaataaataaaaaaaaaaaaaaaaaaaaaaaaaaagaagaatatattaaaaaaaaaaaaaaaaaaaaaaaaaaaaaaaaaaaaaaaaaaaaaaaaaaaaaaaaaaaaataaaaaaaaataaattcaaataaccaaaaaataaacaaaaacaacactattaaaaaaataaaaataaacaaat

SEQ ID NO: 75140 - DNA, 275 bp, Zea mays
  Clone ID: LIB3079-054-Q1-K1-C7
aaagaaaaaaaaaaaaaaaaaaaaaaaaattaaaaaaaaaaaaaaaaaaaaaaaaaagggtgcgcatatatacaaaaaacaataaactaatataaaaaaacaaaaaaaaaaaaaaaaaaaccaaaaaagctcatccctttttactgaacaaaccttgcctttccttcacttaatgaccttcctctacattctccttacttaatttaaattaatttcccggattttttcttcgataccccttgccaacatttgctctcccttactctattttccta

SEQ ID NO: 75141 - DNA, 376 bp, Zea mays
  Clone ID: LIB3079-054-Q1-K1-C8
cagggacctcatccacatcgcgtacagcctctccaaggacttcggcctcccgggcttccgcgtcggcatcgtctactcgtacaacgacgacgtcgtggcctgcgcgcgcaagatgtccagcttcggcctcgtctcctcgcagacgcagcacttcctggcgaagatgctgtcggacgcggagttcatggcccgcttcctcgcggagagcgcgcggcggctggcggcgcgccacgaccgcttcgtcgcgggactccgcgaggtcggcatcgcgtgcctgcccggcaacgcggggctcttctcgtggatggacctgcggggcatgctccgggacaagacgcacgacgcggagctggagctgtggcgggtcatcgtacac

SEQ ID NO: 75142 - DNA, 440 bp, Zea mays
  Clone ID: LIB3079-054-Q1-K1-C9
cggacgcgtgggcggacgcgtgggtgcaagagagggagcaaagaacataatggataacacagttgagtgttttccttgggatgtcaagcttgagatagatggatccaaaattgatattcctcaggactccgaaggtatccttgttgccaatatcaggagttacatgggaggggttgacctttggaagaacgaggatgatgtctctgacacttacctccctcagtccatgcatgacaagaagctggaagttgttagcttcacaggaatgctgcatctcgggaaactgcaggttgggctttctcgtgcaaaaagattagcccaaggccatcatataaaggttgaagtcagtactacaatgccgatccaagttgatggagagccatggtcccaggagccgggaaccatagaggtttctcatcatagccaggccttcatgctta

SEQ ID NO: 75143 - DNA, 440 bp, Zea mays
  Clone ID: LIB3079-054-Q1-K1-D1
cccacgcgtccgggcctatgttgataaaacgggcagcgagaaaggtattgcgattttgagggaatgggaggcctatttgccgctcttctggcaactggtaccgcccagtgaagaagactcgcctgaggcttgtgcagagtttgagagagtacttgccaagcaagcaaccacccaattgtctgcgaagtgatcgaatcagactacaggaaggtggtaggtgttttctatttgacacaaagtgatctcatcttatcacttcaagaaaatcgaagaccataaccggcgctctgaggcaccgaagtgcccgtctgaagactgcaactttgtggaggctctgcccaagccatctttttgagttgagctaacagaaccgagggttcttctcgacgctcgtgcacctaggtaacccctgtaaattggtttgctgacgctaggctgca

SEQ ID NO: 75144 - DNA, 365 bp, Zea mays
  Clone ID: LIB3079-054-Q1-K1-D11
cccacgcgttctactaaacatgcacataaactgacttactttcagtcaactttatgaagtgtgacttattgttggtcaaatgtatgaagtttgagtttttaaaatctaatccgcctagtaaaaatgaactgaaggagtatctctgaaaaattgcagcttcaaaatcacgtactagatgttcatgagcttttcatagaagactactattcatacatattatgttcccatacttgtttcacgattatccttgcagccattcaaatgttgatgccctgtactctttatggaggttacaaaccgtatagtcaaacttatatgtgtcaagtttgtaagggttttcatggaaaatctgaattgtattgcag

SEQ ID NO: 75145 - DNA, 241 bp, Zea mays
  unsure at all n locations
  Clone ID: LIB3079-054-Q1-K1-D12
cgacccacacctactcctactcataattaataacaactataaaatttaattttctgaaaaaaacatatcacacaaagacgagttaaatttataaaaaaaaaaaaaccaaccactaatngttctgccttcctaaagaaccaaatcttacttcccctttcatccaacataataactattccatagtgccacccaaattaaaaaaactccccgaacatttaacaacattaataacttaaaaacc

SEQ ID NO: 75146 - DNA, 197 bp, Zea mays
  Clone ID: LIB3079-054-Q1-K1-D2
taaaaaaaaaaaaaaaaaaaaaaaaaaaaaataaaataaaaaaaaaaaaaaaaaaaaaaaaaagaaagaataaaaaaaaaaaaaataaaatacacacaaatacaaaaaacttaaaaaccaaaaaaaccaacaatactacttttcaattcattgacccttattcttaatctcttcataccctatccttcacttttccc

SEQ ID NO: 75147 - DNA, 295 bp, Zea mays
  Clone ID: LIB3079-054-Q1-K1-D3
cccgggcgtccgggcttctcctccccctccggttcgggttcgggttcgtgaggttctccgggggtcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggca

SEQ ID NO: 75148 - DNA, 449 bp, Zea mays
  unsure at all n locations
  Clone ID: LIB3079-054-Q1-K1-D4
ctttctttgatttgctgattgtcaccactggtttttagggctcaatatgactttgtttcacattgtaacatcctcaacaatgattttacttcttacaacaaacactactacggatgtcctgatgataagacattccagcacatggcatctgtgtatagtcggtctcactataacatgtctttgagcaaagaatttgaaggagggataacaaatggagcattctggtacccaatatatggtggtatgcaagactggaactatatacatggaggctgctttgagttaactctggagattagtgacacaaagtggccaaaagcagatgagcttnctatcatctgggaacacagtaggatgagtatgctcaatcttctagcaagcctaataaaggccattgagcgacgaggaacgccgtgtcacttgcaatgaccagagacgggaggtcttcg

SEQ ID NO: 75149 - DNA, 235 bp, Zea mays
  Clone ID: LIB3079-054-Q1-K1-D5
aaaaaaaaaaaacaataaaaaaaaaattaataaaaaaaaaaaaaaaaaaaaaataaaaggagcaattttaacaaaaaaaacaaaaaacaaacaactaaaacacaaacaataaaaaaaactcaaacaaaaacttacacaaaaaaaaaaaaaaatacttacccaccaatcaaccaccccaattttcttcctaacttattcttctcacactacatcattttttatatctcccccctat

SEQ ID NO: 75150 - DNA, 431 bp, Zea mays
  Clone ID: LIB3079-054-Q1-K1-B9
acaaaactctcgctccctctcgcagacgcgcctaggtctagctagggtctggtctcgctggcccggcgcgcgcgcattcacaagcttctagacgttccgaggaggaggggaggtacccgccgccgcagccatggcgtcgactaaggtccagcgtatcatgacccagcccatcaacctcatcttccggttcctacagagcaaagcgcgcatccagatctggctcttcgagcagaaggacctccggattgagggtcgcattatcggattcgatgagtacatgaacttggtcctcgaagacgctgaggaaatcaacgtcaagaaaaacactaggaaatcacttggccggatactcctcaaaggtgacaatataactttgatgatgaacagtggcaagtgaagattcttatggcaggaacgatgtttggtgctcg

SEQ ID NO: 75151 - DNA, 454 bp, Zea mays
  Clone ID: LIB3079-054-Q1-K1-A2
tttaattataactcttggtggtgatggaactgttctgtgggctgcatcattgttcaaaggacctgttcctccggttgttgcatttgccctgggatcactgggcttcatgacgcctttcccaagcgagcaataccgtgagttgttggacaatgtgctgaatgggccatttagcatcacgctgagaaaccgcatacagtgtcatgtaatacgtgacgaggcaaaggatgaaatcgtgtctgaggagccattcttagtgttgaacgaagttacaatcgaccgaggaatatcatcctaccttaccaacctggaagtctactgtgacagctcttttgttacttgcgtacaaggggatggactaatcatatcaactacatctggaagtacagcatattcattagcagctggagggtccatggttcatcctcaggtcccagggatccttttcaccccaatc

SEQ ID NO: 75152 - DNA, 414 bp, Zea mays
  Clone ID: LIB3079-054-Q1-K1-A3
gcccaacaccccttcagctgttggacaagctgcatcagtcatgtgtttgggagagatgggtacggatgatgatgaaaaccgtgtaagaaaactgttcagtgccattggaaaagtctggacagctgaagagaaatattttgatgctgtaactggtctgagtggtagtggcccggcctatatcttcctagcaatagaggccatggctgatggtggagttgctgctgggcttcctcgggaccttgcccttggtcttgcatctcaaacagttcttggtgctgcaactatggtgagccagacaggcaaacatccagggcaactgaaagatcaggttacttctccagcaggtactaccattgccgggattcaagagctcgagaagggcgcattccgttgaacgctgattagtgctgttgt

SEQ ID NO: 75153 - DNA, 437 bp, Zea mays
  Clone ID: LIB3079-054-Q1-K1-A4
ggacgaccgagcggagtctagactcgagagcaacctcgacctcccggatctctctcccacccacgcctcgtcggcgccgtcgtctgctgcagcgatggcctcccccgacctgctcttcaatctgcggaacctcttctacctgggcgcctaccaggcagccatcaacaacagcgacgtcccgggcctcgacgccgacgccgccgctgagcgcgacgccatcgtcttccgctcctacatcgccctcggctcctaccagctggtgatcagcgagatcgactcgtcagccgctacctcgctgcaggccgtgaagctgctcgcgctgtacctcactggagacaaggaaggtgctatctccagtctcaaggaatggttgagtgattcagcaattggaagcaatcctgttctgcggttgaatgctggaattgtatttatgcatg

SEQ ID NO: 75154 - DNA, 438 bp, Zea mays
  Clone ID: LIB3079-054-Q1-K1-A6
gggatctacgacgagttcgtgaagaaggccgtcgagctcgccagcaagtccgtgggcgagtacccgttcaacccgagtgtcagccaaggcccccaggttgacaaggaccagtacgagaaggtcctcaggtacattgacatcgggaagcgcgaaggcgccacgctggtcaccggagggaagccctgcggcgacaagggctactacatcgagcccaccatcttcacggacgtcaaggacgacatgacgatcgcacatgatgaaatctttgggccggtgatggctctcatgaaattcaagaccgttgaagaggtgatccataaagcgaactacacccggtacggcctggccgtcggcatcgtgaccaagaacatctacgtcgccaacaccgtgtcccggtccattcgcgccggctccatctggatcaactgctacttcgcg

SEQ ID NO: 75155 - DNA, 445 bp, Zea mays
  Clone ID: LIB3079-054-Q1-K1-A7
cgtaggcatcactatctctataagtctacgctcatgcatactctgccacatccagggccgctttcttttcgcagttcttcctgcatctgttccaaggtctgctcaaagcacgacaccgaacgggaaagataatggcaacgatgatcgccgcgatgcgcgtgctgttccgcgcgctgaacgacccggtgatggacacgctcatggccacccgcacgtgcccgcgctcctgccgggccttcgtcgccgtcgacgtggacagcgagctccacttcctgcgcctgtcgctgtgcctgcagatcaagctcaagtactagtgcacgcactgcctcagccggttcctcaccctgtacagctgacagctcaagaacgagctacactacgctacacatgcacctatacatctattcttgccaatctccttgccaagcgcccgtcggccatgaca

SEQ ID NO: 75156 - DNA, 408 bp, Zea mays
  Clone ID: LIB3079-054-Q1-K1-A8
cccacgcgtccgcttatacccagactgatggacagaagctgcaatccttccctggggatgttgatacccttgagcaagtacaggtcaactatgaggttctgcctgggtggcaaagtgacatttcttctgttcgaagatacgatgaacttccccaagctgcccgcctttatgtggagaggatagaagaacttgttggtgttcccgtgcactacattggtgttggacctggcagagatgctctcatatacaagtaaaagcaactttatttggtccttggttgggcggaaaccaggctgggactcgggagcatttgcattttcttggcgtggtaacttttgatacggtgaagtcactgactcgtggagtgatgttgctcaataatcattaatcagaaccttgtcctaatac

SEQ ID NO: 75157 - DNA, 426 bp, Zea mays
  Clone ID: LIB3079-054-Q1-K1-A9
gtcaaattgagtctgtggcagaagtgtgggatcttgcgaccgaaccagcattcctgtgctgggcagctgttgtgcttgcagcagcttttgtgctcatattccattttgtccctgagtatggtcagacacatatcatggtatatgttggcatatgttctcttgtgggatctttatcggtcatgagtgtcaaagctcttgggatagccttgaagctgacattttctgggatgaaccagctagtctatccacaaacatgggtgttctcatccgttgtaaccttatgcattgtaacacagatgaactatctgaacaaggccctcgacacattcaacactgcagttgtttcacccatatattacacaatgtttacatccttgaccatcttggctagtgtaataatgttcaaggattgggatcgtcaaaatc

SEQ ID NO: 75158 - DNA, 371 bp, Zea mays
  Clone ID: LIB3079-054-Q1-K1-B1
gacggacgcgttctgccgacagcctttcagctgttgtacaagctatctttattcatgtgtttgggagatatgagtaggcttttttatgaaatccgcgtaataaaactggtcagtgccattcgaaaaatcttgtccgcttacgagaaatattctgatgctgtaactggtctgagtggtaaagacccgtcctatatcttactagcattagaagccatggctaatggtagagattctactaggctctcttgggaccttgcccttgagtcttgcatctcaaacacttcttggtccttcaactattgttagccatacatgcaaacattcaaagcatctgaaagatcatgttacctctccaccatgtactaccattg

SEQ ID NO: 75159 - DNA, 416 bp, Zea mays
  Clone ID: LIB3079-054-Q1-K1-B10
gaggaattcaaggacaaggaaatcaagttccttattggtgacatcaaatccagccagtgtggcttgcagtactttggcctgaaagaggaccagacaccccttatcctcatccaggatggtgactccaagaagttcttgaaagttcacgttgaggctgaccatatcgtcgcttggttgaagagaatactttgatggcaaattgacgccgttcaggaaatctgatcctattcctgaagtcaacaatgagcctggtaatgtggttgtcgctgacaacgtgcacgacttcgtcttcaaatctggcaaaaatgtccttattgaattctatgcccgctgttgcggacactgcatgaagctggtgcccatcttggacgaggcattcaccactctccatagcgacgaggaagtcgtgattgcta

SEQ ID NO: 75160 - DNA, 445 bp, Zea mays
  Clone ID: LIB3079-054-Q1-K1-B11
aaaataatgagagcaacacttattctacctgttctgaagcaggaccaaatttggaaagacgagtcaaaattcgaagacatctttgatgttgatcattttataaattatttgaaggatgatgtacggattgtccgagatatccctgactggttcacagagaaggatgagctgtttactagtataaagcgtactgtgaagaacatcccaaagtatgcttcagcacagttttatattgataatgtacttccaaggatcaaagagaaaaggataatgtctatcaagccatttgtggacagattggggtatgataatgtaccaacagagattaaccggctgagatgcagagttaactatcatgcattaaagttcctacctgatattgaggaaatggcttgtaagcttgctgcaagaatgaggaacaaaactggcagcataaatccataca

SEQ ID NO: 75161 - DNA, 449 bp, Zea mays
  Clone ID: LIB3079-054-Q1-K1-B3
ctcgagaactccatttcgatctcatttgaaatcaacccatcctcgtttcctccgtctaggagggtctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaagttgtcatttctgct

SEQ ID NO: 75162 - DNA, 446 bp, Zea mays
  Clone ID: LIB3079-054-Q1-K1-B5
ggcgcttctcaagagtaatgacactagggctctcttcctgatggccatcgtggtcatgggcatggccatcgtgttgacaccctgccctgtgcacggacgaaatgatggtagctatacatgtgcatcatgcccactctaaccatatttatttagtttctaaaagattgtatgcattggatattggtattgtcattattgactagttttttttatttcaaaaaaaacttttgtgtagagaggtgcacgcatatgccggggtgcactatcagccgttgcctcagccagtgcaagcagtgggggtatgccaaccctgtgataaactgctggaacacaccaccgaatacagttttggacacatgctgctgctttagtaatgctgctagaaaattggcttgattttatcactgacagctctagctgttggatcttgactgaacaatccaaat

SEQ ID NO: 75163 - DNA, 386 bp, Zea mays
  Clone ID: LIB3079-054-Q1-K1-B6
caactaatcacgcccaatcagaacagactcggtcgcttcaccactccactcgccgcgggcggtcgggcgccgccgaggggatcggagcaagatgttcttccacatcgtgctggagcggaacatgcagctgcacccacgacacttcgggccgcacctccgcgacaagctcgtttccaagctcatcaaggacgtcgagggcacctgcagcgggcggcacgggttcgttgtggcgatcacgggtgtggaggacatcggcaaggggctcatccgggaaggcacgggatacgtcaccttccccgtcaagtaccagtgcgttgtctttagacccttcaagggcgagatcctcgaagctgtcgtcaccatggtgaacaagatgggcttctttg

SEQ ID NO: 75164 - DNA, 444 bp, Zea mays
  Clone ID: LIB3079-054-Q1-K1-B7
ctgagtaagaacagcattggggaaaaccttcacctcatagacttcgaacttaggagcaagcactcgtttagcaggagtcccagcggaaatattgtcgcaaatgtatgaggaggacaataaagagcagtcagaggagggcttcagccttgctgtttctagaaaccttctgaggctcatgaatggtgacattcgtcacctcagggaagctggcatgtcaaccttcattctcactgctgaacttgctgctgctccttcagcagttggacgatgagggcaaactgcaacaagtgtcaaatgctctctcagagttcattctgaaagcctctgtggtttgctgagaatgagaaatggttgaacggcttgtatgatcacctaatgcatatttctggctccattactttgtctcagtttcttcctttacttaacttagaaaagttttaaact

SEQ ID NO: 75165 - DNA, 301 bp, Zea mays
  Clone ID: LIB3079-054-Q1-K1-B8
gcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaagaccaagtgcgcccggcgttcgtgccggacgatgtgatcggcagcgccgggagccccgacaagtactggagcccccacccca

SEQ ID NO: 75166 - DNA, 363 bp, Zea mays
  unsure at all n locations
  Clone ID: LIB3079-054-Q1-K1-A11
ccaaaatccaaatcaccacatccccccatttatttatggggtttttatgtccacctccgccgccaggtccaacttatcccacnaccaccctctaccatatcgttctctctgctctccttccccgctaaacccaccatcacctccaccaccatatctaccccttccccaagaccctcccgctccacccatgtccatttcctctattacgcccgctgcctcctcctccgccttcgcgcgtcgtctcaatatcctacgacttcgtccacccctcggtctctgccttcttattacttccacaacctcatttactaccccaactactttcgcattttttacaccactctgttcgtactatatcattca

SEQ ID NO: 75167 - DNA, 392 bp, Zea mays
  Clone ID: LIB3079-053-Q1-K1-F7
ccgggccgaccgacgccaacgctcggaccacccaaccctaaagggtcagcatgccttgaagcacgtcgctacatcaaacatggcccatttatacagggagcagagccacccctacaacaaccaaagccacaacaccctcaccaactcaaccaacatccagtacactcaggctatcatgaaccactagctaacgaccaacccatgacaacataaccaactaaaccttgaacgatgcagcagcacctactaacagtctcgctaaaactacatccacatctaaacctaccaatccgccaactaaaacaggatgcccatccaaacagcttaacggaactaactttcaataaggacacaataaaattcgccaaaaaactccaaataaatcctcccaa

SEQ ID NO: 75168 - DNA, 233 bp, Zea mays
  Clone ID: LIB3079-053-Q1-K1-F9
gtcggtgtgttcccgctttcctgctctcgtacggttctggatggtggcatgcggagcccggatagtctgtctggtgttgctgccggcttgaacggagatcatcgtctcttggatccgcttacgcttgcgccgtccctcacctagaaggccgcacggcaatggaacgaccttgctaccaagggccatgttgattcccaatggtcctcatgttcttgccaatattttggtctctt

SEQ ID NO: 75169 - DNA, 219 bp, Zea mays
  Clone ID: LIB3079-053-Q1-K1-G1
aaagaaaaaaaaaaaaaaaaaaaaaaaaaataaaaaaaaaaaaaaaaaaaaaaaaaaaaaagaaaaaaataaaaaaaaaaaaaaaaaaaacaaaaaaaaaaaaaaaaaaaaaaaaaaaaaaaaaaaaaaaaaaaaaaacaaaaaaaaacaaaaaaataaacaacaacaaaaaaaagggccaccgactaccaggtccccacgaacatcccccatcatcaa

SEQ ID NO: 75170 - DNA, 374 bp, Zea mays
  Clone ID: LIB3079-053-Q1-K1-G11
gaacatcatgttggtgagccccgcgccgtgcacgcccaccatcgcgtcgcacgaggtgatgagtcccccgacctgcgagatgtcgttggccacgtccgactcgttgacgacggcctcgaaccccacctcctccgcggcccggaccacggcgtcgaggttgaggagcaggcgagtgcggtggcgcgagatgaccagcagccggggcttcctccccgtgccgtcgccgaggcgcgtgggcgcgtcccggtgcagcgagagcgcgcgccggaggaaccgcgtgaagtccggcgtggcgagcccgtccaggctgcggtcgcgctcgatgatgagctccttgtgcgcgcgcaggctgaccacggcgcgcgggaaacagt

SEQ ID NO: 75171 - DNA, 183 bp, Zea mays
  Clone ID: LIB3079-053-Q1-K1-G12
gcccaccatcgcgtctcacgaggtgagtagtcttccgacctgcgagatgtcgttcaccacgtccgactcgttgactacggcctcgaaccccacctcctccgcggcccggaccacggcgtcgaggctgacgagcacgcgagtgcagcggcgcgagatgaccagcagccgatgcttcctccccgt

SEQ ID NO: 75172 - DNA, 452 bp, Zea mays
  Clone ID: LIB3079-053-Q1-K1-G2
tctcgctgagccagatcgagcacgaccttccgatgccgccgcacctgctgagccgcccggttcccgacgccatcaaggccgagctcgagaggctcttcttggacaaggtaatcacaaaacttgggctgtgcgtgtctgtctatgatatccgatccattgaaggcggttccatccatccaggggagggctgctcgacttataaagtttcatttcgtttgctgatgttcaagccttttaatggggagattcttgttgggaggattactggatatgacgataagggattgcaggtttcacttgaattcttcagtgacatttgcatacctggacacttgatgcagtttggcacagtaaggggaccagatggtaggtggatgctgaagactgaattaggcgatgagctttatctagatctagatgacgagataaggttcttggtttctagcacaaaa

SEQ ID NO: 75173 - DNA, 444 bp, Zea mays
  unsure at all n locations
  Clone ID: LIB3079-053-Q1-K1-G4
acgcgtccgccggcgcgtccgggagtcctgctttaacttcctcaaaggttctcctgtcaatctgctcagtnctctttgacccaaaccctgatgatcctcttgtccctgagattgctcacatgtacaagaccgacagggccaagtatgagtccaccgcacgctcctggacacagaagtatgccatgggctagaagcaaggctaaaagctggccaaactggtgaatgtgccggaccccaaatcgttatcacctaaataaccagtcaagtcgcaagtatgaatggacttttgaggaccattgtgccctgttgaactcatgtattaccttgtgaagtccgttgtgtctggtttctacctgaccgtttcgttatctgatgctgattctttaaaaaaaaaaatgataaatcggggccttaatttagggtcctatttaaaggtttaaggct

SEQ ID NO: 75174 - DNA, 328 bp, Zea mays
  Clone ID: LIB3079-053-Q1-K1-G5
gttggcttctcctccccctccggttcgggttcgggttcgtgaggttctccggggttcgggtgcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaagtcccgcggcttcggcttcgtcaccttctccacggaagaagcgatgcggaacgccatcgagggcatgaacggcaaggagctggacggcccgaacatcaccgtcaacg

SEQ ID NO: 75175 - DNA, 273 bp, Zea mays
  Clone ID: LIB3079-053-Q1-K1-G6
gggagcaagatggggtccggatctttcctttaggtgctggccaataacttcgatgtccttggcgggcttccattttggtcgtatgcaaagctgttctttaactgctggttggtcttgccttggttcaatggtgctgcctatgtttacgaccattttgtccggtcaatgtttgtgaaccgtcaaatagtgaacatatggtacattccaagaaatgagaagctaggtaaatctgatgatgttctgtcagctgcagagagatatattgaacaaaac

SEQ ID NO: 75176 - DNA, 95 bp, Zea mays
  Clone ID: LIB3079-053-Q1-K1-G7
aaaaaaaaaaaaaaaaaaaaaaaaaaaaaaataaaaaaaaaaaaaaaaaaaaaaaaaaaaaagaaaaattttaaaaaacctatttctaaatccca

SEQ ID NO: 75177 - DNA, 98 bp, Zea mays
  Clone ID: LIB3079-053-Q1-K1-G9
aaaaaaagaaaaaaaaaaaaaaaaaaaaattaattaaaaaaaaaaaaaaaaaaaaaaaaaggaaaagaaaaataaaaaaattagagaaaacccaaccc

SEQ ID NO: 75178 - DNA, 290 bp, Zea mays
  Clone ID: LIB3079-053-Q1-K1-H1
caactcgacaccgagaaaagcgcagcaaattaacgcaaagcccacgccgctacagtgctagagcgagcgagcctcttgcctgccgctacgagccaacgactcgaacgcatacactccaatggcagcgacggtgatggcctccatgagccccctcgcctccgccacccccggcgcgcgtcgcgctttccctgtacggctgctgctccaggcatctgcgctcgcgccgcgccggcgcgccttggccgtgaccgtgagggcccagagcgacgacgccgaggccgagccaaaag

SEQ ID NO: 75179 - DNA, 359 bp, Zea mays
  Clone ID: LIB3079-053-Q1-K1-H11
accgacggatgcgttcgggagtacggcttaaccatggataacttgtattcccttatcatgaacgtgttcgtgggcggggtatctaccatagatctggtgctagagtacgtcatggcctagctcatgaaccacaggctcgtgatgaagaagctgcacgctgaggtacagacgtaccgagcgtagaataagctggacatgatcagggaggactacctgagcagcctgtcgtacctaaactcgttcatgaagtatgcgctgctgctgcaccgatctgtgaacatgctgatgccgtactactataccgatgactgcctgatcgacagtgaaaacatccctttcatcactcgcgttctcgtgaa

SEQ ID NO: 75180 - DNA, 152 bp, Zea mays
  Clone ID: LIB3079-053-Q1-K1-H12
cacctcttctctaaaatcaacttactttttcaacccaacaacccagttcaaggcatgcttccatcccacatatgacaatcaaccatcttccataatctaaataatcaatcacatacacatcattaaacagcaccttccaaccatacagacac

SEQ ID NO: 75181 - DNA, 345 bp, Zea mays
  Clone ID: LIB3079-053-Q1-K1-H2
aattcccgggctcgaggacgcgtccgaggacaaggagggcatccctcctgaccagtagcggcttatcttcgccggcaagcagctgcaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggatggcatgccacctgaccagcaacgtctgatatttgccggcaagcagttggaggatgggaggacccttgctgactacaacat

SEQ ID NO: 75182 - DNA, 293 bp, Zea mays
  unsure at all n locations
  Clone ID: LIB3079-053-Q1-K1-H3
cccacgcgtccgctaaattcaggttagcaaataagatctcgcaagcaaggaagagatgggggctttcaagaagcatgtaaccagccttgctgcgctggacttcctggtatgcctgaagtcggacgtgttcgtcatgacccacggcggcaatttcgccaagctgatcattggctaccgtcgctaccatgggccgcacatgctcaagtcaatcaagccggacaagggtctcatgtccaagttcttcggtgacccttacatgccgtgngcgacgttcgtggaggacgtggtgataa

SEQ ID NO: 75183 - DNA, 190 bp, Zea mays
  Clone ID: LIB3079-053-Q1-K1-H4
gggggtgctgctctccgaccccgagctccgaaggccgcagcatcaggcgcggcccccctcgggtgtgaccgagatggcgctgccgaatcaggggaccgttgattaccccagcttcaagctcgtcatcgtcggcgatggtggaactggtaaaactacatttgtgaagaggcatctcactggagaggttggg

SEQ ID NO: 75184 - DNA, 334 bp, Zea mays
  Clone ID: LIB3079-053-Q1-K1-F6
gggaactggctagagaagctgtcaggaaattacttgttctgttaaaaaatgggaactctcgcgatcagcaattcctacctgtgcctaagagagctagaagtatcctggtagctggaagtcatgctagcaatttggggtaccagtgtggtggatggtcaatccaatggatgggggacagtggtaatatcacaactgggacaacaattcttgatgcgataaagtctaccgttgctgactcgacgtctgttgtctactctgagaaccccgatgacagtttcatgaagcacaatgacttctcattcgctatcgtcgttgttggcgagccaccatacgc

SEQ ID NO: 75185 - DNA, 147 bp, Zea mays
  unsure at all n locations
  Clone ID: LIB3079-053-Q1-K1-H6
ttaccccatcttcaatctcttcatcatcatctatacttaaactactaaaactacatttttnaatactcatctcactccacacttttataataaatattaaccaaccattctttcataacatcatcccattaatttcaccactaacta

SEQ ID NO: 75186 - DNA, 361 bp, Zea mays
  Clone ID: LIB3079-053-Q1-K1-H8
gttttgctgctctccgaccccgagctcctattgccgcagcatcaggcgcggcccccctctggtgtgaccgagatggcgctgccgaatcacgggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcacggcaagagaagtttggtggccttaaggatggatactatatccatggccagtgtgccatcatcatgtttgatgtaacct

SEQ ID NO: 75187 - DNA, 291 bp, Zea mays
  Clone ID: LIB3079-053-Q1-K1-H9
cttggtgcaaccgtcgttacgtatccccttctagttgttaaggcaagacttcaggcaaaggacatgattaacgatgacaagaggcatcgctacaaaggtacacttgatgcgttcacaaagatggtacgatatgagggtctgtcagggatgtacaaaggaatgggcacaaaaattgtgcaaagtgtttttgcttctgctttgctttttatgattaaggaagaactggtgaaaggtgctcgactattggtaactggtaacactagtctggttaagaaactaccatcaaagtca

SEQ ID NO: 75188 - DNA, 77 bp, Zea mays
  Clone ID: LIB3079-054-Q1-K1-A1
aaaaaaaaaaaaaaaaaaaaaaaaaaaaatttaaattaaaaaaaaaaaaaaaaaaaaaaaaagaaaggtttaatttt

SEQ ID NO: 75189 - DNA, 275 bp, Zea mays
  Clone ID: LIB3079-054-Q1-K1-A10
aaaaaaaaaaaaaaaaaaaaaaaaaaaaaatttaaataaaaaaaaaaaaaaaaaaaaaaaaagaacgggttttataatttaataaaaaaaaaacaaacacataaaaaattcgggctccccctttatataatccaaacttacttccccttacttgcaacttctttccttttttatagttttaccaaaattaaattcaccccccttctttttccaacccctttactggaaaacccctattcttccccatcttattctctttcaaacaaatccccctt

SEQ ID NO: 75190 - DNA, 435 bp, Zea mays
  Clone ID: LIB3079-053-Q1-K1-D8
acaaaaaaaaaaaaaaaaacgaaaaaattaaagaataaaaaaaaaaacacaaaaacaaaaaaaaaaaaaaaaaaacaaaaaaaaacacaaaaaaaaaaaaacaaaaaaacaaaaacaaaaaaaacaaacaacaaaaaaaacaaaaaacaaaaaaaaacaaaaactaacaaacaaaaaaaaacaaacaccaaacaaaaacataaaacaacaaacaaaaaaaaaaaaaccaaaaaaaaaacaaaaaaaaaaaacaaaaaaaaaaaaaaaaaaaaaaaacacaaaaaaaacaaaaaaaaacaaaaacaaacaacaccaaaaaaaaaaaaaaaaaccaacaaaaaaaaataaaacaaaaaaaaaaaaaacaaaaaaaacaaacaccaacaataaaaaccacaaaaaaaaaacaaaaaacaaaaaaaaaaacaacaaaaa

SEQ ID NO: 75191 - DNA, 226 bp, Zea mays
  Clone ID: LIB3079-053-Q1-K1-D9
ctatcgacccactcgtcctgtggtgcaagttctgaaataaaataatcttttttttttcaaaaaaaaaaaaaaaaaaaaagaaaagaataaaaaaaaaaaaaaaaaaaacaaaaaaaaaaaaaaaaaaaaaaaaaaaaaaaaaaaaaaaaaaaaaaaaaaaaaaaaaggtcactcccttttaaaatatccaaacttacctacccttacatccaacttaaaacttttt

SEQ ID NO: 75192 - DNA, 255 bp, Zea mays
  Clone ID: LIB3079-053-Q1-K1-E1
aaaaaaaaaaaaaaaaaaaaaaaaaaaaattaaaaaaaaaaaaaaaggaaaaaaaataaaagaaggtctttgcgttcttgcggcgtccatgctaacgtactcgtgcttgcaacgtgatacctaatttatagtgacagctaaatgcatttcactggccggacttgtacaacgttggggttgccaaaaccatggggttaccaaactaaatcgctttggacaacttccgtctttggcaagatgccgtaatagatagga

SEQ ID NO: 75193 - DNA, 400 bp, Zea mays
  Clone ID: LIB3079-053-Q1-K1-E10
gaaggcgtatctgatgagaggagctggggctgtcattcacagccatggaatagagacttgcatcgcaacaatgctcatccctggtgcaaaggagttcagagtgacccacatggaaatgatcaaaggaatcaaaggtcatggctaccatgatgaattggtcattcctattattgagaataccccttatgagtatgagctcactgactccctaagtgaggcgattgcagcatacccaaaggcaactgctgtgcttgtaaggaaccacggaatatatgtatggggggagtcttggatcaatgccaagacacaggctgaatgctaccattatcttttagatgcttgcatcaagctctatcagctaggtattgattggacaacccctgaacatggttcaataaac

SEQ ID NO: 75194 - DNA, 344 bp, Zea mays
  Clone ID: LIB3079-053-Q1-K1-E11
tcgatcccttggcttcattgcccttccaggcactgtttttaagattgcaacagctagctagtggcgcgggtgactttctactgggaaaagataagatacaaaaggttttactctcaaggctaactgaaacagttatcatgtggctctccaatgagcaagagttctgggatatctttgacgaccgatctgtccaactccagccttcggggctgcagcagcttattcttgatatgcacttcattgtcgagattgctgtgtgtggaaggtttccatatagaccagttcagcaacttgggtccacaatcataaccagagcagttgcagctttctcagcaaggggtgtt

SEQ ID NO: 75195 - DNA, 442 bp, Zea mays
  Clone ID: LIB3079-053-Q1-K1-E2
cggacgcgtggggtcatgaagtccatcgtgcccgtggtcatggctggtgtgctcggtatgtacgggctcatcatcgccgtcatcatcagcacggggatcaaccccaaggccaagccctactacctctttgatggctacgcccacctttcgtccgggcttgcctgtggtctcgctgggcttgcagctggcatggccatcggcattgtcggtgatgctggagtcagggcaaatgcgcaacagccaaagcttttcgttggcatgatcctcatcctcattttcgcagaagcgcttgctctctatggtctaattgttggaattatcctttcgtctcgcgctggtcaatcccggccggattaagtgcaccaccattctgtgattaccgaaccgttaattatgctattctgagaggattggaactctattccctggcctagttaatcct

SEQ ID NO: 75196 - DNA, 384 bp, Zea mays
  Clone ID: LIB3079-053-Q1-K1-E3
cggacgcgtggggttgctgtgcaggtatgtgcaaggaagaggaagacgtttgtcctcacggacgagggctcagttgttgcgtttggatggatgggttttgggagtctagggtttcttgaccgaggaacatcagacaaagtaatgaggccccgcgttcttgagagcctgcaggatcactacgtctcccaaataagcaccggactggatcacactgtcgcagtgacaaataagggcattgaattcgggttcggggacaacgagcgaccccaactggggcaggagtacattcgtgggtgcttaaaacctaccgggataatgttccaaaggagtttcgaagacttaccaattgcggggcctatgggttgacctaaaggccaaaaggcc

SEQ ID NO: 75197 - DNA, 438 bp, Zea mays
  Clone ID: LIB3079-053-Q1-K1-E4
cgtccgggggaccaacttttggagaaatgccaccttttgggcatgtttgacagcattgcatcactgtctgttgctcaaaacatgcgtgagctttatagattggttctagtcgatacaccactggccccttacttctcagagtgcattacatctgaggatttggatgacatgaatattgagattatgaggaacactctctacaaagcatatcttgaggacttctacaaattttgccagaaactaggtggtgcaacagctgagatcatgtgtgatctcctttcatttgaagctgacagaagagctgttaacattacaataaatagtattggtactgagttgacaagagatgaccgcaggaagctgtactccaactttggttaatggaatccatatggccacgaagaattggccgttggtgaagatgttgaccagtttcgt

SEQ ID NO: 75198 - DNA, 145 bp, Zea mays
  Clone ID: LIB3079-053-Q1-K1-E5
ccaaaacataaaaacaataacccacatctaaacctcaaatcacactatcaaaaacaccaactaatcacacttcacatacaaaaaatcattatacaaacatacaacacatccacaatcataaacatacaatactaaaaccaccaaa

SEQ ID NO: 75199 - DNA, 248 bp, Zea mays
  Clone ID: LIB3079-053-Q1-K1-E6
ccttccaaataaccaactaaaaaaaaaaaaaacaaatttaaaaaaaaaaaaaaaaaaaaaaaaaaaccgaaactttttaaaccttacatgccaaaaccaaaaaaaaaatccaaattaaataacacccaattccctcaccttaaatttccaacgtaaaaacctcaaaaaaccctcccataacccaattaaatacccttccacaacaacaacctttttccaaaaaacctctaacacaccacccaaaaacc

SEQ ID NO: 75200 - DNA, 340 bp, Zea mays
  Clone ID: LIB3079-053-Q1-K1-E7
aaaaaaaaaaaaaacaaaaatataacaaaaaaataaaaacacaaaaaacctcacgtacaatttcaaaggtgtggcgcccgaccacataaactataacaaaaaaaccactctagaccaaagaacaccaaacaaaataatcaacccccaaactcacgacaaccaccacaatcactacaactcccaaataaacaccgaactctatcacacttacacacagacaaacaaacgcattccattcaccaacacacacaaccaaccagcacaactaatccaataccacaaccaacaccactcaaaacctaccgagataaccatccaaaaaacaatccaatacatacca

SEQ ID NO: 75201 - DNA, 241 bp, Zea mays
  Clone ID: LIB3079-053-Q1-K1-E8
caaacatcctaatacaccaaaatcaccctaccaatcatagttcccaacatcttataatttcaatcacattaatattgaaaatattataaacaacatctacaaaacaaatctttaagaccattacaaatactaccacaaactatcatacacaacaacacacatcaaatctcaactactttcaaattaaactcacataataactcttaacaatacaataaataacatagacaccaaaatcaca

SEQ ID NO: 75202 - DNA, 369 bp, Zea mays
  unsure at all n locations
  Clone ID: LIB3079-053-Q1-K1-E9
gttgttcttgctgatggtgcagtcgtaacagtgaatggtgctagagctgtgagcctccgggtgcggcttgaattaccacttgctctcaaccgtaccacttacaagggtcgcctctcaagcctgatatccatcgcacaagccctgcgtggtgcagcccggtctaatcagaaacccctgctctctcttcgcgttgagggtccagtttccttgtcctcgactccttccatgtctcccaaggacaagctcaagctcaaacggttggccccaggccaagtggagctctcctcacaggcgggggcaatccctgctatcaccgaagacgaggatgaaccacantaaccctgattgtggcctcttttggctctgaat

SEQ ID NO: 75203 - DNA, 437 bp, Zea mays
  Clone ID: LIB3079-053-Q1-K1-F1
cccacgcgttcgaagggcgtgtatactgtttccgagactatgccggagagcgacaggttgtactcgtgcttggcgaggcctatgagcagctgccatctacattgcacacggcggtgtgatgctcactctggggtgaagatcacttacaacaaatcgtatgggaacccgcacaccgtcaagcctttgctctacaagccggtcaccggccctctgtcttgtcgttaaacaacacatcttgctggaacgcatacgatagaacatacatggatgaaaatatgtattcgtgcccagactccatatgacaatatgtaagtaaacactgttagatgtaaatcaaaaattcacttgctaatggaagctggtcatatgtctgtcaaccaatccttgtcaggaaccagaattggcggcctaatggtggttattttaatggttttctt

SEQ ID NO: 75204 - DNA, 63 bp, Zea mays
  Clone ID: LIB3079-053-Q1-K1-F11
aaaaaaaagaaaaaaaaaaaaaaaaaaaaaataaataaaaaggacaaacaatctaaaaaatgg

SEQ ID NO: 75205 - DNA, 336 bp, Zea mays
  Clone ID: LIB3079-053-Q1-K1-F2
gtgggagtaacggaagctgcccatgctgctctagggacagctaacaataactacctatggacattttcaaggttaggggtctaagcctcactcatatacctcgcacacgacgatgtgatgccaactctaagctgaacatcacttacaacaaatcgtatcggaacctgcacaccatcaagccttttctctacaagcctgacaccttccgtctgtctagacattaaacaacacatcttgctataacacatacgatattacatacaggaagaaaatatgtattcctgccatgactccatatgaccatatataagtaaacactgtacaatgtaaattaaa

SEQ ID NO: 75206 - DNA, 428 bp, Zea mays
  unsure at all n locations
  Clone ID: LIB3079-053-Q1-K1-F3
gatgcatggattatttgagatctttgaacatataaagcaatcattatcatctcaaagggggggtattgatttcatggccgtgattccccctctcccagtcaaagccatccaagccgcaattacttcagggacagggtgttcactggggctagaaggattctgttcttattgcacgacacatgacaacatatccaagtagtccttgattgatttagcagcagggagtaagcgtcttgctaaaagtggctccacangtgaacttagcgatcgtcttgctaaaagtggttgtaaaggtgatcgctttgaaggaaactcaggttcaggaaggacacatgaatatccgagaaaaaactccaaagaatctttccaaaacctgatggtggccttctaccttaaccacctttggaagtcttaggtggttaattttg

SEQ ID NO: 75207 - DNA, 413 bp, Zea mays
  Clone ID: LIB3079-053-Q1-K1-F4
gtgcaaacttggcttgaatgatagggttcttttggaggctcaaggcagagcaactaagggcaaagcgatagacctcgatgatatcaaatttcatcagtgtgtacgtttggctagatttgagaatgatagaactatatcgttcatacctcctgatggatcttttgatctaatgacatacaggcttagcactcaggtaaaacctcttatctgggtcgaagcacagattgagaaacattctagaagccgtatagaactcatggtgaaggcaaggagtcagtttaaagaaagaagcacagcaacgaatgttgaaattgaagtgcctgttccttcagatgccacaaacccaaatataagaacttcaatggggtctgctgcatatgctcctgagagagatgcaatggtttggaaaataa

SEQ ID NO: 75208 - DNA, 197 bp, Zea mays
  Clone ID: LIB3079-053-Q1-K1-F5
cacgcgggcgttccccaaggccgcccccaactccgtcccgggcaagccgctggcctactaggcgctgttcgaggaggtccagaagcagctgcagaagcacccgaacgccaacgtcgtggtcaccggccacagcctcggcgccgcgctggcggccatcttcccggcgctgctggcgttccacggggagcggggcgttc

SEQ ID NO: 75209 - DNA, 277 bp, Zea mays
  Clone ID: LIB3079-053-Q1-K1-D7
gacgttcagcaccgaggaggaagctgcagaggcctacgacatagcggccatcaagttcagaggcctgaacgccatcacaaacttcgagatcagccggtacaacgtggagaccataatgagcagcaaccttccagtcacgagcatgtcgtcatcagcggcggcggctgcggattggccggagcagcaaggagctggagacccctccgtccgactcgcttgacggcagaagcggcatgccagtcttctaaaccagcacggaaccgtcactgttaattcc

SEQ ID NO: 75210 - DNA, 288 bp, Zea mays
  unsure at all n locations
  Clone ID: LIB3079-053-Q1-K1-C10
cagttagaacaagtcaagagggtttgattttttggatgtatggttccacagaagagcctgagaatgcattatcgaatctcaatggagctatgagttctgaaacccttttttcttccccttgctgctcgcggcatagcatttggaaattgaagtacaatttgtctttcaggatatactgaattgatttatcattgtcctgcangacttggatgatagatccgggttacgataccagcatcaaagccgnctagaagcaatactgaactttcacttgagatgtgaagtagt

SEQ ID NO: 75211 - DNA, 441 bp, Zea mays
  unsure at all n locations
  Clone ID: LIB3079-053-Q1-K1-C12
gagaccgaatactcagtgaatgttgtgaagcatatttttgatcgacatgttgtgctccaggacagctgtaccaatacaattgctgaacaattgcttgaacaggttattgttttggttgatgcttctgaggctgacgaatttttagaagttgcttcaaagcctttagaatcattaccatatgattctcctgggcagacctttgtggcttttgaaaatccagaaagtgtcattgccaccggcaagttctcaaatatcctgaaattctttgntaaagagggtgatccatcncacgggtgaagctgaagatgatggtgtcgaggatgagtaccagcttgaagatcttgaaatcgtttctgctgattatatgttgaaggtgggagtatctaactttcgaaatgcctgggaaaacatggattcagagactgagcgagttgacgagta

SEQ ID NO: 75212 - DNA, 201 bp, Zea mays
  Clone ID: LIB3079-053-Q1-K1-C2
aagggccataaaataaaatagaaacacaagagtttgaaagacatgcatagaaagaggaaacaggagcagcttttcaaaaggtctgcgcaagctacgccgagaaactggtccgatggcctggtctgcacgtgctcatggccggctctgctccggtgacctctcgtgggtcgcagcagcaccgtgcacttacgggccctgagc

SEQ ID NO: 75213 - DNA, 422 bp, Zea mays
  unsure at all n locations
  Clone ID: LIB3079-053-Q1-K1-C3
tcttgctccaccgtccgcccgccgccatgagcttcatcttcggcaagaagaagactccgggtgagctgctgcgggagaataagcggatgctggacaagtccatccgggagattgagagggagaggcagggcctgcaggcccaggagaagaagctcatcaacgagatcaagaaggtggccaagcagggtcagatgggagctgtaaaaattatggcaaaggatcttatccgcacaagacaccaaatcacanaattctatgcactcaagtcccagctacaaggtgtatctctacgtattcagactctgaaatcaacacaggccatgggtgaagccatgaagggtgtgacaaaagccatggggcagatgaaccgccggatgaatctgcctgccttgcaaaaaatcatgcggaagttggagatgcaa

SEQ ID NO: 75214 - DNA, 271 bp, Zea mays
  Clone ID: LIB3079-053-Q1-K1-C5
ctggacaagtccatccgggagattgagagggagaggcagggcctgcaggcccaggagaagaagcttatcaacgagatcaagaaggtggccaatcagggtcagatgggagctgtaaaaattatggcaaaggatcttatccgcacaagacaccaaatcacaaaattctatgcactcaagtcccatctacaatgtgtatctctacttattcagactctgaaatcaacacaagccatggttaaatccatgaagggtgtgacaaaatccatggggc

SEQ ID NO: 75215 - DNA, 233 bp, Zea mays
  Clone ID: LIB3079-053-Q1-K1-C6
aaaaaaaaaaaaaaaaaaaaaaaaaataaaaaaaaaaaaaaaaaaaaaaaaaaaaacgaaaaataaacaataaaaacccaaacaaaaaaaaaaaacaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacaaaaaaaaaaataaaaaacacacaac

SEQ ID NO: 75216 - DNA, 427 bp, Zea mays
  Clone ID: LIB3079-053-Q1-K1-C7
ctacaccctccgtccgccgccaagtgctttatcttgggcaagaagaagactcctgctgaacttctacgggagaataggcggaccctggacaagtccatcctggagattgagagggagaggcagggcctgcaggcccaggagaagaagctcatcaacgagatcaagaaggtggccaatcagggtcagatgggagctgtaaaaattatggcaaaggatcttatacgcacaagacaccaaatcacaaaattctatgcactcaagtcccagctacaaggtgtatctctacgtattcagactctgaaatcaacacaagccatgggtgaagccatgaagggtgtgacaaaagccatggagcagatgaaccgacagatgaatctgcctgccctgcataatatcatgcgggagtttgagatgcaaaactagaaga

SEQ ID NO: 75217 - DNA, 423 bp, Zea mays
  Clone ID: LIB3079-053-Q1-K1-C9
gcaggaagccgagctgcatgcccagaaggttcaggaacggaaagccctcattggggtcaggaacactgcggacaccgcgtatctacagcatcgagaagagtcttggagagtacagggacaagatcccggcagaggttgcatctgagatcgaggcagccatcgctgacctccgccaggagatggcctcggatgacatcgagaagatcaaggccaagcttgaggctgccaacaaggctgtctcgaagattggtcagcacatgtcaggtggtggctctggcgactcacagtcgggatctggacctcagggtggcggtgaccaggcgccggaggcagagtatgaagaggttaaaaagtgaggctgcgggaagttgaagcgaaattgtagtgacctgtttagaagtagctactcttttttgggaacac

SEQ ID NO: 75218 - DNA, 172 bp, Zea mays
  Clone ID: LIB3079-053-Q1-K1-D1
aaataacactgacgcagaaggaaggctaacacttgctgatgctttggtctatgcttgcagccaatgtgttgaaaagattattgatttggcaacgctgaccggcgcttgcgttgtcgcactcgggcctagcattgccggaattttcacgccgagcgacgagcttgccaaggag

SEQ ID NO: 75219 - DNA, 452 bp, Zea mays
  Clone ID: LIB3079-053-Q1-K1-D10
gcttctgtgctgctgaagacgctgttgctacctcgcccaaatctgttttccactgctttggcggggagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaaaccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagat

SEQ ID NO: 75220 - DNA, 309 bp, Zea mays
  unsure at all n locations
  Clone ID: LIB3079-053-Q1-K1-D11
ccgcgaccgggagagagtcagagagagactcccgtctccagatcgtccggcggngatgggggcagcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcattccaccgtcgccgtcaagggtacatcaccctatggcaatactgggcatcataatggaaatgcttcaac

SEQ ID NO: 75221 - DNA, 457 bp, Zea mays
  Clone ID: LIB3079-053-Q1-K1-D12
agaaatcacaatttctacagactatagcattcagggtgatgagaaaatgatatcaatgagctacgagaagcttgctgttgatctgaagccaggcagtgtcatattgtgtgctgatggtaccatcactcttactgttcttcactgtgataaagaacaaggcttggttcgctgccgctgtgagaacactttcaagcttggcgagaggaagaatgttaatcttccaggagttattgttgatctccccacactcacagacaaggacaaggaggacatccttaaatggggtgttccaaacaagattgacatgattgccttgtcatttgttcggaagggttcggatcttgtggaggttaggaaggtacttggtgagcatgccaagtccataatgctgatgtcaaaggttgagaatcaagagggagtagctaactttgatgatatccctggcaactctgatgct

SEQ ID NO: 75222 - DNA, 270 bp, Zea mays
  unsure at all n locations
  Clone ID: LIB3079-053-Q1-K1-D2
cgacgtctcaactcccaaggtccctttttttttctcgatctggaagcgccgcagtagcatgcatggacgtgagcggagcatgcggtaaggcgaagaagggcgcggcggggcgcaaggccggcgggccgacgaagaagtcggtgtcgcggtcctgcagggccgggctgcagttccccgtcagccgcgtcgggcggtacctcaaaaagggccggtacgcgcagcgtgtangcacgggtgcccccgtctacctcgccgncgtcctggagtacc

SEQ ID NO: 75223 - DNA, 371 bp, Zea mays
  Clone ID: LIB3079-053-Q1-K1-D3
catctaccgaggtgtaaccagacatcaccagcatggacggtggcaggcgaggatcggaggggtggccggtaacaaggacctctaccttgggacgttcagcaccgaggaggaagctgcagaggcctacgacatagcggccatcaagttcagaggcctgaacgccgtcacaaacttcgagatcagccggtacaacgtggagaccataatgagcagcaaccttccagtcgcgagcatgtcgtcatcggcggccgcggcagcgggtggccggagcagcaaggcgctggagtcccctgcgtgcggctcgcttgacggcagcagcggcatgccagtcgtcgaagccagcacggtaccgccgctggtcattccggtga

SEQ ID NO: 75224 - DNA, 224 bp, Zea mays
  Clone ID: LIB3079-053-Q1-K1-D4
cggacgcgtgggcggacgcgtggggcgaatttcgtggtattaaaaaaaaaaaaaaaaaagaaaaaatataaaaaaaaaaaaaaaaaaaacaaaaaaaaaaaaaaaaaaaaaaaaaaaaaaaaaaaaaaaaaaaaaaaaaaaaaatcaacaaaaacaaaaaaaaacaacaaaacaaaaaaacacaaaccaacacaacaataacactaaacaacatcagcaacaat

SEQ ID NO: 75225 - DNA, 75 bp, Zea mays
  Clone ID: LIB3079-053-Q1-K1-D5
gctgaatctactaaaaaaaaaaaaaaaaaattaaaaaaaaaaaaaaaaaaaaaaaaaaagaagatggcttttcga

SEQ ID NO: 75226 - DNA, 354 bp, Zea mays
  Clone ID: LIB3079-053-Q1-K1-D6
cgcgtccggcggcggcgatgacaacgcgcttcaagaagaaccgcaagaagcgcggccacgtgtccgccgggcacggtcgcatcggcaagcacaggaagcacccgggaggtcgcggtaacgccggtggcatgcaccaccaccgtatcctcttcgacaagtaccatccgggctacttcggcaaggttggcatgcgttacttccataagctccgcaacaagttctactgccccgcggtcaacatcgagcgcctctggtcgatggtgcccaccgacaaagcggcggaggccggcggcgacaaggccccgcagatcgacgtcacgcagttcggctacttcaaagtgctcgggaaagggg

SEQ ID NO: 75227 - DNA, 362 bp, Zea mays
  Clone ID: LIB3079-053-Q1-K1-C1
ctgaaccatcttatctctgctaccatgagtggcgtgacatgctgtctgaggttcccgggggagctcaactctgatctgcgcaagcttgccgtgaacctcatcccattccctcgtctgcacttcttcatggtcggctttgctccgctgacctctcgtgggtcgcagcagtaccgtgccctcacggtccctgagctgacccagcagatgtgggatgccaagaacatgatgtgcgcggccgacccccgccacggccgctacctgacggcctcggccatgttccgcgggaagatgagcaccaaggaggtggacgagcagatgctcaacgtccagaacaagaactcgtcctacttcgtggagtggat

SEQ ID NO: 75228 - DNA, 373 bp, Zea mays
  Clone ID: LIB3079-052-Q1-K1-H4
ggccacgcgtccgcttatacccagactgtagtttagaagctgcaatccttccctggggatctgtatacccttgagcaagtacaggtcaactatgaggttctgcctgggtggcaaagtgacatttcttctgttcgaagatacgatgaacttccccaagctgcccgcctttatgtggagaggatagaagaacttgttggtgttcccgtgcactacattggtgttggacctggcagagatgctctcatatacaagtaaaagcaactttatttggtccttggttgggcggaaaccaggctgggactcgggagcatttgcattttcttggcgtggtaacttttgatacggtgaagtcactgactcgtggagtgatgtt

SEQ ID NO: 75229 - DNA, 61 bp, Zea mays
  Clone ID: LIB3079-052-Q1-K1-H5
aaaaaaaaaaaaaaaaaaaaaaaaaaaataaaaaaaaaaaaaaaaaaaaaaaaaaggaagg

SEQ ID NO: 75230 - DNA, 270 bp, Zea mays
  unsure at all n locations
  Clone ID: LIB3079-052-Q1-K1-H6
ggcaatttcgatctggactggatcgctacatttggatcgtggggatgatatatgcgtgttaccatccaactgttgagaagtggttggagaagctggaagaaactgaaatgagaaccaaactctatattaagacctcaatagttacagtgtcaatgatggctggatatttgtggtatgaatacatttataagctggataagattacttacaacaagtngcattcatatacatgctggatccccataactgtctacatatgtctacgcaact

SEQ ID NO: 75231 - DNA, 87 bp, Zea mays
  Clone ID: LIB3079-052-Q1-K1-H7
ggcgtaagcagccatgcaggtatcaaaaggtatcagcgtcaccaatcttcatggagcgcacatgctccacgcttccgcaatacgcgc

SEQ ID NO: 75232 - DNA, 308 bp, Zea mays
  Clone ID: LIB3079-052-Q1-K1-H8
cccacgcgtccgcgccaccctcgatcacgccgtccgtcgaggtaaggtcagcatggggagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggctgaacaagtgcggcgtcatcagccctcgctttgatatcggcgtgaaagaca

SEQ ID NO: 75233 - DNA, 64 bp, Zea mays
  Clone ID: LIB3079-052-Q1-K1-H9
tcctcccatccagttcttctccaatgctcacgccactttaacttatgctctgactcaaactcaa

SEQ ID NO: 75234 - DNA, 304 bp, Zea mays
  Clone ID: LIB3079-053-Q1-K1-A1
tggactcacaggttgtgacagttggaaagtttcaaggaggtggagccttcaatgtgatgcgtgattcggtaactataggtggcaccttccgagcctttctgaaagagagttttaatcaattgaagcagcggattgaagaggcgattgtgtctcaagctagcgtgcagcgctgcagcgctgccgtggacttcctcagcaaggaccgtactttcttgccgccgaccatcaacagccccgagctccacgactgcttcgtgaacgtggccggcgagatggtcggctcgaggaacgtgagggacaggca

SEQ ID NO: 75235 - DNA, 330 bp, Zea mays
  Clone ID: LIB3079-053-Q1-K1-A10
ggagattatgataacagagggcgcgggagatggcttctacgtggacgaggtgggagagggggtggtggctactacggaggtgggaggcgtggtggctacggttatgattatggctatgcccccagaggcgggtactatgaagagcaagacgaatactatgatgagcccgaggaatatgctcctccccctggccgcggacgtggcagagggagaaggggcggcatgccttggcgtgggcgtggaggccgcgggccaccgcgcggtggccgagggagctactactaggcgcgagaaatgcgacgtgccgaatgcgtgtgcttattagttatc

SEQ ID NO: 75236 - DNA, 267 bp, Zea mays
  Clone ID: LIB3079-053-Q1-K1-A12
gcggcgtctcaggtcgggactttctggcaagacgaccttcaaagcgtggttcacatggacgtcgggcaaagccaggagatcgctcccacctcttccaacagctacaacggttcattgcagacagtccacatgaaaatggagctttgaggcatggccggggaaaaagaaagaaagaaaaccccagtccgaagctcgacgccgtcgtcccccctgtacatacggagaagagaggacacagctcgcaccggaagcagcgggctctttggg

SEQ ID NO: 75237 - DNA, 241 bp, Zea mays
  Clone ID: LIB3079-053-Q1-K1-A2
gatggcggcagcaccggacgggacgcggtttactcggagtcgaccccgatccagaggaggagatattcatgccgagtggtgtgccgtacctatctacaatttggacgacgtgccagcagtagctagcgatgctgatgtgcgtacatgaacaaggtcgaggagccagacacgatgtgcctatgcatggagctcagctcctagcttatgaactatggtcagatagagcatgcgcagaacgcct

SEQ ID NO: 75238 - DNA, 161 bp, Zea mays
  Clone ID: LIB3079-053-Q1-K1-A3
taaaaaaaaaaaaaaaaaaaaaaaaaaaaaattaaaaaaaaaaaaaaaaaaaaaaaaaaaaagaaaaatttacaaacaacaaaaaaaaaacccaaaaaaaaaaacctaacaaacaaaaaaaaaaccaaaaatactacacctttctatacttcccaaaccct

SEQ ID NO: 75239 - DNA, 302 bp, Zea mays
  unsure at all n locations
  Clone ID: LIB3079-053-Q1-K1-A4
gggggctacggcgacctccagcgcgggggctgcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgncatcgcgctggcgctcatggcggccgngttcgtcacctncggcggcctcggcgtcgctgcgctgtccgtgttctcctggat

SEQ ID NO: 75240 - DNA, 116 bp, Zea mays
  Clone ID: LIB3079-053-Q1-K1-A5
acgcgtgcggtctgaataatcattacaagaaagaagacaattgtttcgaatcatcattgatagaccactggtgagatattggctaatccttaagttaataaatcttcagtcgatac

SEQ ID NO: 75241 - DNA, 355 bp, Zea mays
  unsure at all n locations
  Clone ID: LIB3079-053-Q1-K1-A6
gccctaccggaaggtaccaagttctgcggccacggcttcctcgatcccgagaggtttgaaggtcnancggatgcggatgccatcccgttcagctacagccagctcgacaccatcctgaggatgtttcggatccctcgggggtccaagaaggcagagcaagtcgccgccacgctccggacatgcgaggctgagtccccagaggctcatgcctgcgccacctccgagcaggcggcggccgacttcgctgccttctcgctcggggtcagggccagcaagctggtcgcgctcgtcaccaccgtccatggggggaaagacgccactagatacgtggtggcgcccaacggcatcacacgca

SEQ ID NO: 75242 - DNA, 360 bp, Zea mays
  Clone ID: LIB3079-053-Q1-K1-A7
cccacgcgtccggccagcatgaaatacctatctacatgggctcgaatgaaaaacttgaccgctcctataatgtcaccgttcacatattgatttggattccattttggtgttacacagatccgaattgcaacctgtattgcatttattggtagctcggtgtggaaaatgtgcatattctggaggaagcaaaattatttcttgccaaattgagattcagtacaggtgcttattctgttctttgcagagagatgtatgaatgcaagatctgtacttccatggcaaatgaactgtgcaatatgagatggtacgagaatgttgcacatcatgaacgaaagtaaagagctttatatagcatacagc

SEQ ID NO: 75243 - DNA, 167 bp, Zea mays
  unsure at all n locations
  Clone ID: LIB3079-053-Q1-K1-A9
ctnccgtaggagatgatcttcttgttaccaaccccaccagggtcgccaaggccatcaatgacaaggcctgcgatgctctcctgttgaaggtgaaccaaatcgggtctgtgaccgagagtatcgaagctgtcaggatgtccaagcgctccggatggggagtgatggcg

SEQ ID NO: 75244 - DNA, 322 bp, Zea mays
  Clone ID: LIB3079-053-Q1-K1-B1
cccacgcgtccggcgtttcgagacaggggggtccctaagccgacgagtgagtgtgctgggtgccctagcccagatgggtcgagcgcgtgggcgagcgcgaaggggggagaggcgaggtggccggagccgagcgtgaggcaagcaacgcggaccgtgagcacggtgcggagtcggacagcgaggaggagaggaggcgccgcaaggcaaagaccttcggcaagtcgcgtgcgccggagcgcagcagcttcaagggagctgccgccttcaagaagccaaagttcaggtgaatgctgccttcggcaattcgctcgtgccaaagtgc

SEQ ID NO: 75245 - DNA, 314 bp, Zea mays
  Clone ID: LIB3079-053-Q1-K1-B10
cgcactcacacggtcacactcacacccccgccgtctagccgtttcagctgcagagcctctcgagcgtcgcccgcggcaggagctggctacccctcgaccaggtctgggagcggcgccgccgcgcccgcacgagacggcggagctggacgcggaggcggcgctgggcggggagtcggcggaggagcgcaaccgcttcctggtgctgcggctgtacgaggcgctcaacgcccgcgacgcgcgccgggcgcaggagctgctggcgccggacctcgagtggtggttccatggccctcccgtgcgccagcacatgatgc

SEQ ID NO: 75246 - DNA, 440 bp, Zea mays
  unsure at all n locations
  Clone ID: LIB3079-053-Q1-K1-B11
gcaagaagccgagctgcatgcccagaaggatcaggaacggaaagccctcattgaggtcaggaacactgcggacaccactatctacagcatcgagaagagtcttggagagtacagggacaagatcccggcagaggttgcatctgagatcgaggcagccatcgctgacctgcgacaggagatggcctcggatgacatcgagaagatcaaggccaagcttgaggctgccaacaaggctgtctcgaagattggtcagcacatgtcaggtggtggctctggcgactcacagtcgggatctggacctcagggtggcggtgaccaggcgccggaagcagagtatgaagaggttaaaaagtgaagctgcnggaagttgaggcgaaattgtagtgacctgtttagaagtagctactcttttttgggaacacagatagtcagatgagatg

SEQ ID NO: 75247 - DNA, 163 bp, Zea mays
  Clone ID: LIB3079-053-Q1-K1-B12
aacgatctcaccaccgagtgctgctacaatgatacagtggtcctacacccacaactcgggcaaggggttcagctccagcgtgatcacacgaacaacgtctcgaataccatcgtccatcccggcacttgaaagaacgagcacatcacagattcatggtatctga

SEQ ID NO: 75248 - DNA, 135 bp, Zea mays
  Clone ID: LIB3079-052-Q1-K1-H3
tcgaaaaaatcaaaaaatacaaaacaaattttatacaaataaaaaaaaaaaaagaggggcgggttactaatcctaaattacatcgcgtgcattctaaaagatccctcttctctaacgccacctaacttcaataaa

SEQ ID NO: 75249 - DNA, 409 bp, Zea mays
  Clone ID: LIB3079-053-Q1-K1-B2
ggctgatgaggtggggaacacagctgcattcctggtttcttcattggcttctgccatcagcggctcgactgtttatgttgacaatgggctcaatacaatggggcttgcaattgacagccctaccataacgtcatagatgtggttgtggtagatagacgacctttcctgctgcattgcggtatcatccttgaataaagatcatagttagttataaatatgagaggtaagggcaggaaagggggaaaattatgaactggtcttttgcgctatctttgctggagaggaacattagagcgatttccaaaatgatgggatgctaatatgtgatttcatatgattcaaaagcagtacaataacttcctagaataagctgcataactatacttatggttaaaaaaaaaccatatat

SEQ ID NO: 75250 - DNA, 59 bp, Zea mays
  Clone ID: LIB3079-053-Q1-K1-B3
aacaaacaaaacagagaaacacagacaagattattcataaaaaaataagaaaaatgaaa

SEQ ID NO: 75251 - DNA, 238 bp, Zea mays
  Clone ID: LIB3079-053-Q1-K1-B4
cggaggcgtgcgcggacgcgtgggaaaaataaaaaaaaaaaaacaaaaaaaacagcaaaaagaaaattttctagaaaagagatagggtgcgtcatctggcacagactgcagaaaatccaaggaatccgtatcctacacgtacttgcatagcgtccacaagctgacctctgaatcggacgtgctcgatgatgagtgcacgctgaccatggagacgcgccacatcgagaacaatgacgtg

SEQ ID NO: 75252 - DNA, 323 bp, Zea mays
  Clone ID: LIB3079-053-Q1-K1-B5
ggatggtagagctaataaaatcaagagttatagattctactcctgaaacccatgagtatcgaaagcatgaagaaatcccaagtaggaatgcaggcattgcacatgacttcacaggaacatgccgctccttgagccgtgataggaatttcactgaatcggtcccattctctagtatgagaatgagacctggtcattcttctccaggctttccactccaagcatcacctcagctatgcactgcagcagttagggaagcaaaaaaatggttggaagagaaaaggcagggactgggcgtaaaacctgaagacaatggatcatgcaca

SEQ ID NO: 75253 - DNA, 107 bp, Zea mays
  Clone ID: LIB3079-053-Q1-K1-B7
aaaaaaaaaaaaaaaaaacgaaaaatttaaaaaaaaaaaaaacccaacccaaaataaaaaaattaaaaaaaaaaaaaaaactaaaacaacaaaatacaaaaataaaa

SEQ ID NO: 75254 - DNA, 347 bp, Zea mays
  Clone ID: LIB3079-054-Q1-K1-G8
tcgggaaaaatgaaaccacatactgctatgattttcccctggcatttgaaacagcgctgaagagatcatggaaatcaagtagctatggtgttagcgaagctaatgagcacaatcgattctatgctgaagtgaaagagcttatatttgctgattcggttggagcatggggcacttcattggtttcaggtgaacgttcttcaagcatcaatgatattggcatcggtgcttggaacatgaagctggccacgccagaatttccacgtggcccggagattataaggtgtgccaatgatgtgacatttaaagcttgggtctttggtccaagagaaagatgcatttttgatgct

SEQ ID NO: 75255 - DNA, 405 bp, Zea mays
  Clone ID: LIB3079-054-Q1-K1-G9
tgaagctgcccaggcacttgaggtggcatgctggatagccttgttgaaagggccgagatgtgttcgggctggagaccatcttcaacttcctccaacaattcaaagtgttgaggctgaaaagaaggggatgggaaagacactctttgaacgccttactgaagcttatggagaggaaatcacatccatgctcactgtgcagtacagaatgcacgagcacattatgagctggtcatctaaagaactttacaataataagatcaaagcacattctagtgttgctgggcatatgctctatgatctagaagaagtcactagatcttcttcaacagaaccaactattgtactcattgacactacaaggtgtgatatggaagaaagtaaagatgaagaggagagcaccatgaa

SEQ ID NO: 75256 - DNA, 416 bp, Zea mays
  Clone ID: LIB3079-054-Q1-K1-H10
agaaatgggtctatgtgggatatctcagagctcacactcatgatataagggcattaaccggggctgtgcctatctgtagagaagatgcattacctgaggaaaaggtggtgaagattcgccggcgtgaaaaacatgaattcagctaccacagatgggctcatcttggggttccgatgcttatatctggtggtgatgacgccaagctgtttgcatattcagcaagagagtttactcagttctcacctcataacttctgccctgcacctcaacaccctttgataaagctggctaggaatagcacagtcaatggagattatgtaatgcttgtccagtcttcgaacttcttggatgttttacttgtgacagttcagaacaagctgacgactccaagtacatcatcatctagaggagatgct

SEQ ID NO: 75257 - DNA, 306 bp, Zea mays
  Clone ID: LIB3079-054-Q1-K1-H11
acaacgcgtagtacctgtacgagtcggtgctgtggacggagagccacgacgtgggcaagggcttccgctgcatccgcatggtcaacaacatccacctcaacttcgacgccttccacggcgacaaggaccacggcggcgtgcacgacggcaccaccgtggtgctctgggagtggtgcaagggccccaaccagagctggaaggtgctgccctggggggacgaggcctacgcgccgcgcccgtacgctcctcctccgcctgcccaggtggaaccaggctacggcgggtaccgtccccccgcttcaaggg

SEQ ID NO: 75258 - DNA, 449 bp, Zea mays
  Clone ID: LIB3079-054-Q1-K1-H12
ccagcccccaccacatgcacagtctttcgtcatctcttctgcggcgaagaacccccagggagccagcggatcactcgctaaactttgttgagggctgatggcagtttctttcgcaaacctcaactccgaggcagggcttaaaaagcttgatgagtaccttgtcactcgcatctacattactggctaccaagcttgcaaggatgacttggctgtctacacttctgtttacgctgctccctcgtccaagtatatcaacgtagctaggtggtttaaccacattgatgccctcgtgaggctgatcggaattactgcagagggccaaggtgtgaacgttggatcctcagcagtttcttcagccccaacttcagatgttgctgaagcacatgccccagttgctgacgaagacgacgacgatgatgttgacctttttggtgaggataccgaagatg

SEQ ID NO: 75259 - DNA, 455 bp, Zea mays
  Clone ID: LIB3079-054-Q1-K1-H2
cggagcccgtggccgtcgcctccgccttcgcgattcgccgccgttgcccacgagcgaggcttgctcctcttcgtcgccgccgtcgcaggaggggaaagaggataaactgccatggcgggcaggcttctcgcgaatctaatcgtcatgggcggaaccgtggttggcagggccatgctccaggcctaccgccaggccatcgtcaatgcaaacaaaactggagctgcccaagaagctataaatggtattagacgggctagcaaggccatgactgagcaagaagcccggcaaattcttggtatcagtgaaaattcgacgtgggaagagattgtccagaagtacgacacaatgtttgagaggaataacaaaaacggcagcttctatctccagtcaaaggttcatagagcgaaagaatgcctggaacctttatatcaaaagcctgatgtactgaactgaga

SEQ ID NO: 75260 - DNA, 456 bp, Zea mays
  Clone ID: LIB3079-054-Q1-K1-H3
tgaaaatctcgtctgcatctgccagcgccgccacggtgaccaagacgctgctcgacaaggcgcggctctccgtctacctcatcgacgcggtgctcctgccaaggcagcagtctaacgacgaccagggacacactgcgcccgcccctgcgccggcctcctcgcctgcacatgcacctacacctgcccttgcgccggtctcgccgtcgcctgcccctgtaccggtctcgccgtcgccgtcgccgtcgcctgcacatgcacccacacccccacttgcccctgctccggtgactgcacctgcgcccaggcgtcgcccagcgccatcgccagagcacactaccccagctccttcgccagacgcggacgggcaaccgcctgcagatcagaagaacaacgcagcaagggacacggcatcttggactatcggcgcggcgctggcgatcgtgtgcctcttgtcgt

SEQ ID NO: 75261 - DNA, 353 bp, Zea mays
  Clone ID: LIB3079-054-Q1-K1-H4
cccacgcgtccgcccacgcgtccgatcgtcgatgatgagcatcacgagtaggaagtcgggcttggtcctcatactcatcgtcgtcctcgtcgcctcgaaggatgaggcgagcattggggcggacgctgaatgcaacaaccttccagtcagctgctatataaagtgcctgcggccgggcgcctgcaacagctgctgcaagcagaatcacttcgtacgtggagagtgcattgggtgggactgctggtgctgcagagcctaactagccctgctctcatctgaccaatgcaaaggagatttacttgtaataataatcatcataataatcaatggtaccagcatgcattgatcgatgg

SEQ ID NO: 75262 - DNA, 321 bp, Zea mays
  Clone ID: LIB3079-054-Q1-K1-H5
cccactcgttcgaacaaaacaaatacttgctactaatcactgaaatgacaacaaaagcatggagtttctgacagggtatcaaaagcactgcatgatgcaattgctgctgagtatcatgtaacatgatcaattatcctgcctatgcatatgacatcttcattacatacacgtacaagctctgctgtccactatgatgatgcaattactgattatgcatgtgacagattgcattttgagcccaacttctcacttccctttgtactcaacctccattgctcctgatggtggaacttttgctttctactaacttaatgcaaaaac

SEQ ID NO: 75263 - DNA, 415 bp, Zea mays
  Clone ID: LIB3079-054-Q1-K1-H6
gctgatgattcgctggatccaaatggcaacatcaccataaaatgggatatcatgcagtggactcctgatggatatgtcgctgttgtcacaatgtttaattatcaacaatttcggcatatcggcgcacctggttggcagcttgggtggacatgggcaaagaaggaggttatatggtcaatggttggggctcagaccactgaacagggcgactgctcaaagttcaagagcagcccaccccattgctgcaagaaagatccaacaattgtcgatttacttccaggcactccatacaacatgcaaattgccaattgctgcaaggcaggagttgtaaatacctttaaccaggacccaacaaatgctgctttctccttccagatcagtgttggtcttgctggaactaccaataaaactgtta

SEQ ID NO: 75264 - DNA, 324 bp, Zea mays
  unsure at all n locations
  Clone ID: LIB3079-054-Q1-K1-H7
accacgcgttcgggtaaatgaatctcttggtttgcaatccaaggatgatcctaagaggtgtgnttctactgagcatgagattgctcttcacgtggtgatgactctatatagcactttgcacagtcacaatccttccatccttatcatgagttccattagttcaaatgcacatacacctatgcttttgctgctgtttacgttgattacccctgtatcatactctaaatctacaatatagcgtatcctgcacattcgctcacacccccactttatcctcctatcttgactgtccatctacccaaacattaaccatagccatttact

SEQ ID NO: 75265 - DNA, 435 bp, Zea mays
  unsure at all n locations
  Clone ID: LIB3079-054-Q1-K1-H8
ctcgtcacgactcacgaccatgatttggtaaagaaagcaggaggaagccggcggtgtaggcgacccatggctccacagacgaggagagagaggttggcggtggaggcgcggccgagctcgtcggggctaacaccggcgaagccgggggcggtcgaggtgcagcgccgacgggtgggcagcggttggacgagccgtcggatctccatctacgcctnccgagtctacttcctcctcatcatgctccagatcccgctcttcagggtcccttgtagagctggcacatgcacaactcctattcaagtaacatcatctcaggtggtctcaaatgatatattcccagcagctgttgtgaaggccatgctctaccctggagctaccgtgagcagcctaacttaaagccagacatttccgagttggaatgacctgtttgacatg

SEQ ID NO: 75266 - DNA, 298 bp, Zea mays
  Clone ID: LIB3079-055-Q1-K1-A1
aaaaggactgacctcggccctctcctcttgttcttctgcttccccaccgagtctcctcaggcccgtctctctctctctgtcccctcccttcctcgcctccgatgccgccgactcctccgctcctcgagccgcgcgactacctcggcgccggcgccacctagtcgtgctgctcgtcgtgctgctcctactgccgctagggcacattgccccacctcgcgctgcggatcgtgcttccggtgtccgacgactcccccggtcgcggcgcggacactgaacacgcccgcgcccacgtctactc

SEQ ID NO: 75267 - DNA, 322 bp, Zea mays
  Clone ID: LIB3079-055-Q1-K1-A11
cccacgcgtccgccgcagctaggtaactgcccccctacgttccagttgggctggggtccggcttattcgaagatggttggcatgctccaatctgtgtgcgtgtggtgcaatagcccattccagcatttcggcaccgtcgctgagcagcaggcagattcacttggttacatttgcccgtcgtgcaagggaaagttttctggtcatcttggcattaacggtccatctatttgaaatcagtttcttgtaacctgaactggtgctgctgccccaccatcaatttatagtctagttgatatgaatacgtttgtacttgtagtatgta

SEQ ID NO: 75268 - DNA, 422 bp, Zea mays
  Clone ID: LIB3079-055-Q1-K1-A12
gcaagaagaactcgactgcagttaccaagttcctcgatgagctggctaagattgggttccgtggagccaaggtggtgagcgaggcggtggccaattccggcgcctcgcccctgtctccggcgatcaccttcatcttggacaaggtcgcaccgtacatccccaaggaggagcccaaggcggaggacgcggtggctgaggccacttcccgggaagtcgccgtggaggtggaggatgccgagccggctatagctgatgcagcggccgagacaccatcggaggcgaagaagggagaggaggaaaagccggctgccgaggaggcggcgccaccggcagcggctgctactgaggagaagtaatactccgatccacagccatgccttttcctacgtagctgcagcagagtgaaaagtgattcagtcagt

SEQ ID NO: 75269 - DNA, 422 bp, Zea mays
  Clone ID: LIB3079-054-Q1-K1-G7
cccacgcgtccgtccacgcgtacggccacggctgtgccggtgcctggacgcggcgggccgggggtgccacccggcctgcagggactgcgtcaagtccagcctcagcgccgacccgccggtgtaccagtgcatggaccgcgtgcccgacttctgcctgcgccgctgcaccgcgcccgccgtcgccgcgcggtgaccaggcgactggtttctgcttgctcttgagtcttgacccacccacccaccaccaaccgctgcagcctttcgtccacccgaccgacggcgaatcgtgtcgtatgaactctgagccacactgtggattaggttttttcttagttgatgccgcatggaaagagaggctgtgagagacgacggatgtgcaatctgatgagcgaacaaccgaccaaaccaaccttggacgctgt

SEQ ID NO: 75270 - DNA, 462 bp, Zea mays
  Clone ID: LIB3079-054-Q1-K1-F2
gacgaggagcctgtgcccagcactaccgctctcatccaccacgccccctcctcccctcgcgacgtcaagccgcacctgctcgccgacgtcgatgtgaagccgctgcttcttctcccgccgccgctccaccccccgggctacggcgcgctcgtgcccgtgaagaccgaggagcccgtgcccgtggccaccgtctcgtcaccgcccagggcgctcccgccgccgcgcctctgccgccagttctggaagtccggcgactacgtcgtcgcgcgccgcaaccccgatgtggccggccccggtgggcggaaccggttgcggataaaccccaagtttctgcactccaatgcgacttcccacaagtgggcttttggcgccattgccgagctccttgacaatgcaatcgatgaggtgaacaatggggcaacatttgtccgtgttaataaatttaaaaacccacgagatggg

SEQ ID NO: 75271 - DNA, 344 bp, Zea mays
  Clone ID: LIB3079-054-Q1-K1-F3
cccacgcgtccggcaatcagcagaaaaacatctccttggccttccatccatatgatccatccctgcaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcagccggcggcggcgggcgcggcgaagggcaccgacgctgagaagctccagttcatcgaggacatgacctccaacgtggacgccgtgcaggagcgcgtgctgggggagatcctcgcccgcaacgcggacaccgagtacc

SEQ ID NO: 75272 - DNA, 454 bp, Zea mays
  Clone ID: LIB3079-054-Q1-K1-F4
ctgtatttgcttttcagtcaacaccagagttaatgtttggactgtaccttctgtattacttccgtgtgtttgagaggcagataggctctaacaaatactcggttttttgtctcttcactatcacagcatcatcgctcctcgagatcctgtcattggttatcttgaaagatacaaattacatcagcacgcttgcatcagggccttatggtctcatatttgcctcttttgttcccttctttcttgacattccaatcacatcacggttccgtatttttggtctgaatttcagtgacaaatcattcatttacttagctggttttcagcttcttttatcttcttggaagcgcctccttattcctggtatatttggtctggttgctggttctctctatcgtctaaatgtgctcggcatccgcaagatgaagcttccacaggttatttcatcattttttgc

SEQ ID NO: 75273 - DNA, 376 bp, Zea mays
  Clone ID: LIB3079-054-Q1-K1-F5
aaaaaaaaaaaaaaaaaaaaaaaaaaataattaaaaaaaaaactaaaaaaaaaaaaaaaacgagcgtcttttctaagaggctccatgcattacttacgcatgcttgcaacttcgtatctcttctatcgcatcaccttaattcaattcaatgcccgcatttttacaacttcaagactcgaaaaacctttgcgttcccgaattaaatcctcttggtgtaatttctcctttcaacagttaccttaatttcgaaattgccatcacatcacggctttgcctacaagggctcaacctgaatgacaaatggtacacgcacttaactggtccttaaatcgcaacatctttactgattacccccatcatgcccggtacatttgcc

SEQ ID NO: 75274 - DNA, 386 bp, Zea mays
  Clone ID: LIB3079-054-Q1-K1-F6
ggcactggatgagcatctcaaagctcatggcccctacatcaacggggagaacgtatcaggagctgatcttagcctggggccaaagctcttccacctccaggtcgcactggagcatttcaaaggctggaagatcccagaaaacctaaccaacgtccacgcctacaccaaggctcttttcagccgtgaatcttttgtcaagactaagccatccgaggagcacgtgattgcgggatgggcgcccaaggtgaacgcgtaagcacatcgtgatttggtgctaactggtggactccatccatttatctgatcagtcgttgtcagtggtgtgtgtaggtgtcacatctgtagcctagacacatgattcagttggaataaatgcagtgtcgtgt

SEQ ID NO: 75275 - DNA, 399 bp, Zea mays
  Clone ID: LIB3079-054-Q1-K1-F7
cgccaaggtcgtcgggagttatgaggaggccaagaagaggatgtatgcttttagtacgaggacttatgttggttttcaggctgtaatgaccgaggaaatgtcagaaaaatttcgcggtttgcctggagtagttttcattttgcctgattcatatctatatccagaaacaaaggagtacggaggagacaaatatgacaatggtgtcatcactccaagaccaccacctgttcattatagcagaccatcaagaactgacatgaaccgtaactaccgaggaaactaccaggattgcccttcacagcaaggaaattaccagaacaaccgtccttcaccagaaagtggttaccagaacaacccgtcgcagcaaggaaactaccagacataccgctcgcagcaaga

SEQ ID NO: 75276 - DNA, 443 bp, Zea mays
  Clone ID: LIB3079-054-Q1-K1-F8
cgccaaggtcgtcgggagttatgaggaggccaagaagaggatgtatgcttttagtacgaggacttatgttggttttcaggctgtaatgaccgaggaaatgtcagaaaaatttcgcggtttgcctggagtagttttcattttgcctgattcatatctatatccagaaacaaaggagtacggaggagacaaatatgacaatggtgtcatcactccaagaccaccacctgttcattatagcagaccatcaagaactgacaggaaccgtaactaccgaggaaactaccaggatggcccttcacagcaaggaaattaccagaacaaccgttctacaccagaaagtggtaccagaacaacccgtctcagcaaggaaactaccagacataccgctcgcagcaagatggaagaggctattccccacagcagaattatgcacaaggtggtca

SEQ ID NO: 75277 - DNA, 280 bp, Zea mays
  Clone ID: LIB3079-054-Q1-K1-F9
caaggagaagggactcaccaacttcatccgcgacgtccgcgacgaaggatacttcaaatggcttggggacgggtaccttttgcaaacgaaaatccacaatattggcgcaacacttgtaggagttgacaagtttggtaacaaatattatgagaaactacatgacactcagtatggaaggcataggtgggtagaatatgcagagaaaggtcgttacaatgcatcccaagtgcctgctgaatggcatggatggctgcaccacatcacagatagcaccggggat

SEQ ID NO: 75278 - DNA, 345 bp, Zea mays
  Clone ID: LIB3079-054-Q1-K1-G1
cccacgcgtccgagcagctcgccctggcccgacgcctctgctcggccagcagccttcgcgcccgtattcccctgctcgttctcccttacgcagcagcagccgtaccttccctgcagcgcccctctccatttttcccctctgctccctgtgcggcgagctcatgtgctcacagcacctctccctgccttctctctgtccccagcgaccagcagcaaggacaacccccttccctcgctcctttcggatgtgcgcgaggtgttcgacacaatgcctgcgaggaaggaccgagagatgatgatcgagccagtgatgtggtgccaaccacaagatgccgtggtggacgac

SEQ ID NO: 75279 - DNA, 434 bp, Zea mays
  unsure at all n locations
  Clone ID: LIB3079-054-Q1-K1-G11
ctctgcgctgtccaggctgccctctccgactagtcctactccaccctcgcctccctctgcgacgaggttctcctccaggccgcgtcccacggattcaccaccgacgaatggccctactctgtccacctgcttgcccacctctacatcaatgacctgaacagcgcgcggttcttctggaagtcgttgccgcaggaggtcaaggacacgcggccggagctcgccgctgtctggaggattggtcagtgcctctggaaaagagattatgctggcgtcaacacggctgcacaggggttcgagtggggtcctgacctcgctgacttcatcactgccttcctagagagctacagacagaggatattcaagctgttgacttctgcatattccacaattagagttgctgatgtggctcatttcatggngatgagtgaggagga

SEQ ID NO: 75280 - DNA, 451 bp, Zea mays
  Clone ID: LIB3079-054-Q1-K1-G12
gacatccaccaccaccccatggcgtgtacccgccgccgccgcagggtccttaccccccagcgcaggagcctccaccggggtaccagggctacttcaacgaccagcagcgtccttactacccgccgccgcatggagagcatcaacacaaccaccaccagggaaaccagggtagctcctctgggttcctcaaaggatgtttggctgctctctgctgctgctgcgtgctggaggaatgctgcggctgcttctgagacgtgagatgtccgggaatccgatcgcaagttatcgtcgctagcattcgggagcaccccagttattatcatataatagtaactgtgcttgtaaataatctggagcagcagtgttcatgagctcccagccccgcatttatattctcataatttgtagtacgttctatgatttatccgaaaataaaggactctatatatgg

SEQ ID NO: 75281 - DNA, 458 bp, Zea mays
  Clone ID: LIB3079-054-Q1-K1-G2
cgaacagcaaggtcagctcccccacagcctgcatgatgtctccatcttcagtgaaagaggctgacgaggagtcgtcgatggatcttggtctgagctttgatctctgtcttggtcatgacactgcacatcgtcacaagaagccatcggcaggtgctccgaagttggaccttcagttgagcctgtccacctgttcgcctgaatcagccttgaccaatgtaagtgccaatgatggcttagagacagtggcagatactactactactctggaaaagctagagccctggatcttcaggaattacatggcttcatcatcatcatatgcatatgcttctgaaacaacctacggcctttctttgccaaagatacctgaagatgtcgtggtcgtgccttcaacaacagacgtgtcatcagccgttacggtgagcgtgaaaaagcccgctccgaaacggagcaatatt

SEQ ID NO: 75282 - DNA, 149 bp, Zea mays
  Clone ID: LIB3079-054-Q1-K1-G3
atcccggtcgacccaccgtcgcccacctccgaaaaaaaaaaaaaaaaattaaaaaaaaaaaaaaaaaaaaaaaaaaaaggagggaaaaaaaaaaaaataaaaaaaaaaaaaaaacaaaaaactaaaacaaaaaaaacgctgcccatttt

SEQ ID NO: 75283 - DNA, 350 bp, Zea mays
  Clone ID: LIB3079-054-Q1-K1-G4
cggtgatgaagagcagcacaatcgtcgcgcttctgttggctgttgccattctgtcctcggtgtctccatgctacgaagccggcggctgcatcgggaaacccaagaagtcaccgccgccgccgagaaggccatacctctcgtcctattccgaggaccaccagaactgccgcttgatctgtagctcgaagggtttcaaggacggtggctggtgtgacgaaagcgtcgagcacaaagtgtgctgctgctcccattagaaatataatatcgtatgttatgttgatgcatatatatgcatcatccatctacctgtgtggtgcaaaaattctgaataaaatctacctgtgtggtgc

SEQ ID NO: 75284 - DNA, 459 bp, Zea mays
  Clone ID: LIB3079-054-Q1-K1-G6
cccacgcgtccggacctgtgccgcaaatacgcctttggcaagatgcttgtggtaggctctgagccccctttcaaggtcaaggggctctggctcttcaggggctcagaaattcccaagtttgtcatggacgaagtctatgacatggagctttatgagtggaccaaggttgacctctctgatgaggcacagaaggagcgggtcaatgccatgattgaggaccaggagccattcgagggcgaggccttgctggatgcaaaatgcttcaagtgaggaaagagtttttgggtccaattctaaaacagccatggatgatagcttttgattatgcgtgctggttatgattatgctgtggagttttggccatgttaacgggaggtcgtgctcgcgaaaccttctgcattatcgcatcggaatcgtttgtcatgtgcatcctagtgaatagatatattatgaaaatat

SEQ ID NO: 75285 - DNA, 437 bp, Zea mays
  unsure at all n locations
  Clone ID: LIB3079-054-Q1-K1-F12
ctcggcgtcttcacaaacgccggcgcaaactctcgcccgagcccgacagatcttcaattgggcagggcgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgncagctcttncaccctgagcagctcatcagtggcaagga

SEQ ID NO: 75286 - DNA, 454 bp, Zea mays
  unsure at all n locations
  Clone ID: LIB3079-054-Q1-K1-D7
gccacgcgtccgagaaaacaacaaaagttctttcccaagattcaaattgacgacgactgtggtgctgattgatgaagacagtctcttgactgaggaggacctgaagaaaccacaacttccagttgttggggactgtgaggtgggggcagcaaagaaagcatgcaagaactgtacttgtggcagggctgaggccgaggagaaggttgggaagctggagctcactgcggagcagatcaataaccctcagtcagcttgtggcagttgtgggttgggtgatgccttccgctgtggaacctgtcctacagaggtcttccaccattcaagcctggcgagaaggtttccttgtctggcaacttccttgctgctgacatatgatggcatcgccaacatcggcaaaacaaggagacggnggtacctacgttgttagtcgactgaactgcattccaaatagctt

SEQ ID NO: 75287 - DNA, 365 bp, Zea mays
  Clone ID: LIB3079-054-Q1-K1-D9
cccacgcgtccggcatgagtacacccttcttcagaaggacaccaagtggcctctcggttggccgctgggcggctaccctggccctcaggtagattagatggatctgcgtgcctccaggctccagccatatcgatggctttgatcagctgacggaatgatcctggcagggaccttactactgcgccgtcggagcggacaagtcctacgggcgggacatcgtggacgcgcactacaaggcctgcctctacgccagcatcgacatcagtggcatcaacggggaggtcatgccggggcagtgggagttccaggtcggtcctgccgtcggcgtctcggccggcgaccagctctgggtggctcgctacatt

SEQ ID NO: 75288 - DNA, 309 bp, Zea mays
  Clone ID: LIB3079-054-Q1-K1-E1
gcattgcagatattcaatacatctagtgtttctctacacttcattgcatctaacaatgactggggtgtaagagagtatgatatgcatagctatcattcgtttaaccataatctatttaatctcccactgaatcctacgtcatctatccctgttggaaacctggtaatcatcgttgttgatctcacaaatcctcaactattgcttcctatttcaggaaatcctattcattccattaaaggtcacttgtatttctcctttgctccgacttggagcccaaatggcctaacattacccacatgcaaccaagac

SEQ ID NO: 75289 - DNA, 389 bp, Zea mays
  Clone ID: LIB3079-054-Q1-K1-E10
cccacgcgtccggcagcgcctcttcctcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcatcacccgggtcaaggacgaggaaggcatgccggcgttcgcgctcgtcaacaaggccacggggctcgcaatcaagcactccctcggccagtcccacccggtcaagctcgcgcctttc

SEQ ID NO: 75290 - DNA, 272 bp, Zea mays
  Clone ID: LIB3079-054-Q1-K1-E11
ccagatcaccgagcccaagaggccttcagacaagcccctgcgtctgcccctccaggatgtgtgacaagattggtggtattggaactgttccggttggtcgttggagactggtgtcatcaagcctggaatggttgtcaccttcggtccaactggcctgaccactgaggtgaagtctgttgagatgcaccacgaggctctccatgaggcccttcctggtgacaacgttggcttcaatgtgaagaacgttgctgtgaaggatctcaaacgtgggt

SEQ ID NO: 75291 - DNA, 410 bp, Zea mays
  Clone ID: LIB3079-054-Q1-K1-E12
gaccaattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatcttcggcgggcaca

SEQ ID NO: 75292 - DNA, 460 bp, Zea mays
  Clone ID: LIB3079-054-Q1-K1-E2
aaagccaaacgctcaacctgacttacatgatgctagagccgcgctgacgcccatagaggtggtgtggctcgccaagaaggacacggacgctgaatatggacaggactgcatgcattggtgcctgcctggcgtgactgacacttgggtcgacatctgggctgcacagatcatgcatcacttcaagcaggagaaaggctgatcacaatttctttaaatctgtagttttgcgataactacagcaactgtgctagaactttttagatttgtattttagggataacataacaaacattaaatagttttgcaaatattcattaggttaggtctcccataatgctatagtgatgcacaaaactaatgggcaccacaccgaacatcggaacatcccagtgctggagttttcaaataaggtcctctttaaatctgtagtgtttaaataaaggtttggtagagtttctct

SEQ ID NO: 75293 - DNA, 432 bp, Zea mays
  unsure at all n locations
  Clone ID: LIB3079-054-Q1-K1-E3
ctcctacgtctccttctccgagtccatcgagttggatctcgcctgcccacgcgacgtctggtccgcggggtttgatcccgaaaccctaacccacatcccggggtccccaatctccttcgactccgaccccgacctccgccacctctctccctcgctgacctgctccccgcccttctggggctgcctcgatgacgccgctagcttcgagtgggaggagatcgcggacgctgccctcggcgtcggcggtggcgctggcggcgccggagggggaggacaaggactagaaggagacgccgatgccgacgccgacgtgttcgggttcctcgacgagcgggagatgctgggcgtgatggagggcatcgacagcggtgacgacgactcgatcttctncgatgagcctccgtttgacttcggcgatggcgacacggagct

SEQ ID NO: 75294 - DNA, 188 bp, Zea mays
  Clone ID: LIB3079-054-Q1-K1-E4
aaaaaaaaaaaaaaaaaaaaaaaaaaaaaataaaaaaaacaaacaaaaaaaaaaaaaacgagaaagaaatacacaaacatacaaaaaaaaaaaaacaaatataaaaaaacctaaatggcgctccgttttacaggatccaacattacgtccccttgcataccacgtgttagccctcatcttaatcccct

SEQ ID NO: 75295 - DNA, 452 bp, Zea mays
  Clone ID: LIB3079-054-Q1-K1-E5
tgttactctagagatgtgcatgactgggctggacaagaagaaagcttctgtcttctggaggaccactgctgatggttactcgctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggctttaacccgggctctttctcttatggtgacctggttaagagggtgctgaagtgctttggtccaactgagttctctgttgccgtgaccatcttcggtgatcgggacaatgcgaagacctgggggacgaaactggatgctgaggcctatgcttgcagcaacatggttgagcaggtgctgccgtttggtg

SEQ ID NO: 75296 - DNA, 451 bp, Zea mays
  Clone ID: LIB3079-054-Q1-K1-E6
cccacgcgtccgctgttatcgaagaaagtgtgcaagaatctgcaaaaaagcttctgtcagagcttactgaatttagtgacacaacaatcgatccatctcttccgaaacctgcatttcaagttgctaggaaggctcagggctcagtggggaaggggagagaaacgactgcagttgaaatgaagaagggtgactggttgtgcactaactgtaacttcttaaattttgctcgcaatcgtcactgtctcgaatgcaaagcagatggaccaaagaagatagaagcggccgtggatgcaatgaaaatgggcgattggatctgcacacagtgtcagtttatgaacttctctcgcaacaagatatgttttaaatgtgaagaacctcacccgaagaggcaactcaatcctggagagtgggagtgcccctcatgcgactttgttaacttccgacgcaacgc

SEQ ID NO: 75297 - DNA, 378 bp, Zea mays
  unsure at all n locations
  Clone ID: LIB3079-054-Q1-K1-E8
caaccttctccgccgccggccgccggctcctctccaccgccgcggcagcggcagagaaagccgagctccccgtccctatcgcccgtcttcgccagctcgcccgcgctggccgcctcgacgacatcgacgcgactctcgcgcccctgttcccttcccaccccgtcgccgcgctctcggccctctccacgctgggcctncccgaccgcgcctncgctctgctcggcaccatgacgtcgcccaataccgcgcacctgaacgcggtcctcggtccactcctccgccgncgncgcctggccgggctcgtgccctcaatcctcgccgcgcatgcctctgtcccgcgggacgccgtcacggacagcatcctcgccaagtcgctct

SEQ ID NO: 75298 - DNA, 422 bp, Zea mays
  Clone ID: LIB3079-054-Q1-K1-E9
ctttgatggagaattgttcccaagatattttagctttgtgaagggtgttgttgactcaagggaccttccattgaatgtttctcgtgagattcttcaagaaagtcgaattgttcgtataatgagaaaaaggctggtgcggaaagcctttgatatgatacttggcatttcttgcagtgaaaatagagatgattatgaaaggttctgggagaactttggaaaatttttaaagctgggtgccatggaagataaggaaaatcacaagagaattgctcctttgttgcgcttcttctcttctcaaagcaacaatgaattaattagcttggatgaatatgtggaaaacatgaaacctgagcagaaggacatttacttcattgctgcagatagtatgagcagtgccataaatgctcctttcttagagagac

SEQ ID NO: 75299 - DNA, 125 bp, Zea mays
  Clone ID: LIB3079-054-Q1-K1-F10
tcccactcgtcctaaaaaaaaaaaaaaaaattatatataacaaaaaaaaaaaataataaaatagaaaagtttaaatattaattttacactccccccccctctatttttttccaacacttcttaca

SEQ ID NO: 75300 - DNA, 418 bp, Zea mays
  unsure at all n locations
  Clone ID: LIB3079-054-Q1-K1-F11
gagctatgacgccccgtctcagaagaagaatggcttcgtgctgccgaggcctaatatgtcgaacgcggacctgtgcaggatcatcaactctgacnaggtgcagtctgtggtgaagccactcaacaaggaagtgaagcgcatggagaagaggaagaacccactcaagaacatggctgctgtgctcaaactcaacccctacctcggcactgcccggaagatggccacccttgctgaggctgctcgtgtgaaggccaagaaagcgaaactcgactccaagaagaccaagcttaccccggagactgccaaggttaaggctgctggcaaggcatggtacaagaccatggtctcggacagcgactacaccgagtttgagaacttctcaaagtggctcggcgtgactcattgagcggcaagggta

SEQ ID NO: 75301 - DNA, 331 bp, Zea mays
  Clone ID: LIB3079-051-Q1-K1-H6
cggattcccggtcgacctcactgccggttctcaaccggataggtagcaccttagcaggtagaacgctgcacaatccccttctcgtccttcaagatggtgaacgttcctaagaccaataagacgtactgcatgaacaaagagtgcaagaagcacacactccacaaggtgactcagtataagaagggcatggatagcctgtctgcccagggaaagcgccgttatgaccgcaagcaggcaggatatggtggtcagaccaagcctgtcttccacaataaggccaagtctacttagaatattgttctgaagctgcagtgccagagctgcaagcact

SEQ ID NO: 75302 - DNA, 252 bp, Zea mays
  Clone ID: LIB3079-051-Q1-K1-H7
atccagttcatagaggtgatcctaacttcaactcatcttgcaattgtgatggagtagtcggcttgtggtgaactatttgatcgaatcgtagatcgtgggcgatttagcgaggatgagaccaggtatttcttccagcagttgatctgtggagtgagctattgccattacatgcaaatatgtcatagagatttgaagcttgagaatgttctcttggatggcagcccagctccacggcttaagatttgtgatttt

SEQ ID NO: 75303 - DNA, 304 bp, Zea mays
  Clone ID: LIB3079-051-Q1-K1-H8
cgtcaggatgacgtaaagcagaactcaccaggcatttgaggggcatggcaggtgtgtgaatcaatgtccggaaacggaagccagttgtttccagggttttctcgagaaatcttcacctgccaagcctgaagacctgaactcggatgcactgggttttgatttgaaatttaatgtatcctatgttgcctaccattgtttgacaaccatttatccgaacttttgatctaaaagacagcgggaatataattgtgcgcgagttaagcttgaggtcggtcgttttgacgcttcctctatgtactatctt

SEQ ID NO: 75304 - DNA, 253 bp, Zea mays
  Clone ID: LIB3079-052-Q1-K1-A1
cacgcgtcccggagaaaggaggaaaagaggatccgtgctctaaggcgcatgctgggaaacattacgttaagttttagaggtgtacaaaacgaggatgttcaccgaaaggattatgcctgaatgccttaaaaaattgtttggaaatcatgatgatcctgatgaggagaacatttaaacattatgcaaattgatgagtacaattggtgatatgattgatcatgttaaggcaaatgagcacatggatgcctatttt

SEQ ID NO: 75305 - DNA, 379 bp, Zea mays
  unsure at all n locations
  Clone ID: LIB3079-052-Q1-K1-A10
agtcacgtctcccagatctaactgccctcctactcacgaatcccaaagcctccatggggaggcaccgtcactgcctgccactcctcctcctcgtggccgtcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgtcgacgggctgcggttccgccgcgtagtgcgcggccagcagcaggtcgtgtccgcgatgaactaccgnctgtacgtcgactccgtccaccccgccggccgtaccgtgccctacgtggtcgtcgtgta

SEQ ID NO: 75306 - DNA, 438 bp, Zea mays
  Clone ID: LIB3079-052-Q1-K1-A11
atgacaatggattgccaaagtcaaagttttgggagcctacttatgaagactgcttaggtgggattgctcggcttccaccagtggcttcttatgtttaccggagaattttcaagagtgggaaatcaatagaagccgataattctttggactatgcggcaaatttctcacacatgcttggttttgacgacccaaaaatgctggagctgatgcggctctatgtaacaattcacactgatcatgaaggcgggaatgtcagtgctcatactggtcatctggttgggagtgctctgtcagatccttatctttctttcgcaacggctctaaatgggctagctgggccactgcatggccttgcaaatcaagaagtgcttttatggatcaaatctgtaattgaggaaactgggagtggtgttaccacagatcaactcaaagactatg

SEQ ID NO: 75307 - DNA, 429 bp, Zea mays
  unsure at all n locations
  Clone ID: LIB3079-052-Q1-K1-A12
cacttatgctggtctaagtgatgttgggctacccctttccgaagcagaaactgcaggtgaagcatatgcaaagaggcttgttgactatgatagaaatgctgcagcaaggactaaagtttatgatgaccaaagtgactactatgaaatggaaggaaacagttggctctcttcaaaggagaggtcagtcctgaagcagcagcaagaggaagctgaggaagcagctaaaatccaaaagggtaaagtgattgttacatttgatttggtgggccgtaaggtgattttgaacaaggatggaagtactgaggtggaaacagagcacccgatcatgcgaccgccggaagagaaggaccagagccaccgcatacagnccaaccccacaatcagagagcaacctgtgttcgtcgaaacaagtccagtcaaaccaaaaac

SEQ ID NO: 75308 - DNA, 436 bp, Zea mays
  unsure at all n locations
  Clone ID: LIB3079-052-Q1-K1-A2
ctcttctgggggatcaccgccgacggctgcgtcgccttctccgacgacatcgacatgctcaaaggctcatgcggcaagtcgctcgcgccgttcccgcaaggctgcttctactccaacgccctcggagggctcaagtgctacgagaaccccaagcacaaggtcaccgctgtccccgccgacgaagaagagatctgcggtgccactttcaaggtggtggaaggctctactgtcctgacggcgctgcactgatcggtcatcagctggcggaggcgatgcgatgatgatgcagaactttgtacatgcgttggtggatggtggtggaacataatggctgncaacaagtcatgctcatgcaaaccgatgaatctatctctggatcatcgatctcggttgcttgctagtccagactccagacatggctatatatatatagctg

SEQ ID NO: 75309 - DNA, 314 bp, Zea mays
  Clone ID: LIB3079-052-Q1-K1-A3
gaagaaagggaggaaaagaggatccgtgctcgaaggcgcatgctgggaaacattaggttaattggagagttgtacaaaaagaggatgttgacggaaaggattatgcatgaatgcattaaaaaattgtttggaaatcatgatgatcctgatgaggagaacattgaagcattatgcaaattgatgagtacaattggtgatatgattgatcatgtaaaggcaaaggagcacatggatgcctattttagtatgatgcagataatgtcaacaaatcagaagttgtcttctcgtgtaaagtttatgttgagagattcaat

SEQ ID NO: 75310 - DNA, 436 bp, Zea mays
  unsure at all n locations
  Clone ID: LIB3079-052-Q1-K1-A4
cggacgcgtgggcggacgcgtgggcggtacgcgtggggtccatgctcttttgctcctgcgccgagcttcatggtggacgacatgcccatcagggacttccgcaacctggagagcaagggggtggcgttccccaagagccagccgatgcggctctactccagcctgtggaacgcggacgactgggcgacgcatggcgggcgcgtcaagacggactggtcccacgcccccttctccgcctcctaccgcgggttcaaggccgacgcttgcgtcgccgtcgcgggcggccggacccgctgcggcgccaccgtcggcaccgagggcaccggcgcccccgtctccgncgncggcgccggggactggtacaaccaggagctggacctnaccctgcagcagcggatgcgctgggtgcagcgcaagtacatgatctacaactact

SEQ ID NO: 75311 - DNA, 375 bp, Zea mays
  unsure at all n locations
  Clone ID: LIB3079-052-Q1-K1-A5
cacgcgtgcgggccttattaattcacaagcgcaatatcctctgcaaattggagagcagttgacgcgcggcttatgtgccggtggaaatccgaatttgggagagcaggctgctgaggaatcaagagaaaccatagccactgccctgagggattcagatcttgtcttcataacagctgggatgggagggggtactggatctggtgctgctccagttgttgcccagatatcaaaggaagctggttatcttactgntggtgttgtcacctatccattcagtttcgagggccgtaagcgctctgtacaagcattggaagcactagagaagctggaaaagagtgtagacacacttattgtgattccaaatgattagttatt

SEQ ID NO: 75312 - DNA, 271 bp, Zea mays
  Clone ID: LIB3079-052-Q1-K1-A6
gatccgtcgcccgcagggccacagcagccgcggcgaggtcgtccgtcggattcggaggctcagttattactgaaaagataatacagtacctatggcttctctggacgccgtgcgaggagacctcgccctgctgattctgtacctgaacaaggccgaagcgcgggacaagatctgccgagcgatccagtacgggtccaagttcatcagcaacggggagccaaggcctgcgcagaacgtcgacaagtccaccagcctggcccggaaagtgttc

SEQ ID NO: 75313 - DNA, 325 bp, Zea mays
  Clone ID: LIB3079-052-Q1-K1-A7
gcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaacttgtgtcacttgcatttaaccttttcatcgctgtttatgtgagtggcctatttc

SEQ ID NO: 75314 - DNA, 324 bp, Zea mays
  unsure at all n locations
  Clone ID: LIB3079-052-Q1-K1-A8
atcgcggcatgcatcctggcgctgctggccccgccgccggcgcgcgcggcgggcggcgggcggtgcgcgggtgagtccttctccgcgaaccgcgcctacgcggcgtgcaacgacctgccccgcctcggcgcgtccatgcactggacctacgaccgcgcgtcgggcgacctccacgtcgcgttcgtcgccgcgccggccgcgccgggcggctgggtggcgtgggcgctcaacccgtcgggcgacggcatggcgggcgcgcaagcgctcgtggcggggccctntcccgacggccgcggcacgtgggccgtgcggacgtacaacgtg

SEQ ID NO: 75315 - DNA, 322 bp, Zea mays
  Clone ID: LIB3079-052-Q1-K1-A9
cacacatttactgctaaccgcatctcacacacaggctgggtgggcttgttgcgcaacgagctttgcctcactttacccgcctcggagccatggctaagctcgcgctggcgctcctcctcctgctggccgaggctgcctccgcagttgtcagcagtgctagccacctggatctcgacctgggcttactgtactctggtgaacgcccgagggagagccgtggaacggtggccgagtgcctcgcctaggagtctgatgaggagggccttgatctggctggatcccaccgtcgtgcgctctacggctgtaggtacattagctacgg

SEQ ID NO: 75316 - DNA, 433 bp, Zea mays
  Clone ID: LIB3079-052-Q1-K1-B10
gttctgatcgcgagggccgcccttttttttttttttttttttttttttttttttttggttggattttttttttttttttttttttttttttttttttgttttttttgaaagggacattgataactttttttcatataaaacacattcactggaaaaaagattgtaacacaagcgtttccacggcaaataaaggctactctctagtaaaaagatttacaattccaaaagggaatgctccgaacggggctacaagcattttggcaaatgaacaccttttaacgaccctttggttaaaataaaggtcataacacaatagctggtccaggcttttaacctaatccacaaatttggtggaaaaaaaataggcctgacaaccgggttaaccgaaaagcccaagaaccctttgcaaaacccctcagaaaaaacaattaaa

SEQ ID NO: 75317 - DNA, 168 bp, Zea mays
  Clone ID: LIB3079-052-Q1-K1-B11
cccacgcgtccggttggcttctcctccccctccggttcgggttcgggttcgtgaggggctgcgaggttcgggttcgtgggtgagcggatcgagatggcggcgtcggatgttgagtaccgctgctttctcagcagccttggcttggccaacgaccaacaattccttcaa

SEQ ID NO: 75318 - DNA, 227 bp, Zea mays
  Clone ID: LIB3079-052-Q1-K1-B12
gccacgcgtccggttggcttctcctccccttccggttcgggttcgggttcgtgaggggctgcggggttcgggttcgtgggtgagcggatcgagatggcggcgtctgatgttgagtaccgctgcttcttcggcggactcgcctgagccaccgacgaccactctctgtacaacgcctttagcacctacggcgaggtgctctagtccaagatcatactctatcgtgagac

SEQ ID NO: 75319 - DNA, 360 bp, Zea mays
  Clone ID: LIB3079-051-Q1-K1-H4
ccggatctcctgggggttctgtgtttacttggaagctgtttcagtgcttccgcagtacacttgatgcaaaatactaagattgttgaaccctttacagctcactatgtatttgcattgggagttgcaaggtttcttagctgcgcccactgggttctacaggttttggacacgcgtggtcgtctggtgacagctcttggctatggtttgtggccgtctatggtgcttttatcagaaatcgtgcatacattcatccttgcagatttctgctactactatgtgaagagtcttgttggtgggccactggtgctaccgctttcctcaggggtggtgtaagaagtgcataatagatactttgaataa

SEQ ID NO: 75320 - DNA, 353 bp, Zea mays
  Clone ID: LIB3079-051-Q1-K1-D12
cttggaatctcacttagatgaccaaatgatctcataccccaaattcctttctatcaagtcagtttattcatagaatgacatccactctcatatacaaagatcactcaagcagtagcaacaagtaaattcgcaaatgcaaacttgggtatcatcaggaggacctcaaattcttactcacacacacactactcactctaacacctttctagaccccactcaagaataatatcagctcatataaatttataatttttacccccaccctttttttatgcctcccctcgatccactactcattactaacctttatattgatttttctataaaaaaaattctaccacaatccttttttt

SEQ ID NO: 75321 - DNA, 145 bp, Zea mays
  unsure at all n locations
  Clone ID: LIB3079-051-Q1-K1-D7
ctgactgcttgctctagctagctagctgctcctggcccatatccactaggagtacagaantatgctagcagcaatggcctcggtgacgaggttcccggccgtggccctcgtcctgctgctcgccgccagcgccttcctggccagc

SEQ ID NO: 75322 - DNA, 325 bp, Zea mays
  unsure at all n locations
  Clone ID: LIB3079-051-Q1-K1-D9
ccggaccggaaaacccggggggacgggggcgtcgggaaggataacgcaagtgtcctaagatgagctcaacgagaacagaaatctcgtgtcccagcaaaggtnaaaagctcgtttcattctcatccccagtacnaataccaaccgtgaaagcgtggcctatcgatcctttagaccttcgggttgattaaaaaaataatttataaatattaatagttaaataatataatatttttatttattttagggtggactttttaatggttttcaagtttcttttttctttcattctctcttccttttcttctttattttttgttgttaatct

SEQ ID NO: 75323 - DNA, 269 bp, Zea mays
  unsure at all n locations
  Clone ID: LIB3079-051-Q1-K1-E10
cagccaactcccccggcgtcgggccccaatcaggtgttcaagatcttctgccgccccgactagaactactgcctggccgaccgcnaccccnccgtcntgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcc

SEQ ID NO: 75324 - DNA, 224 bp, Zea mays
  unsure at all n locations
  Clone ID: LIB3079-051-Q1-K1-E11
gccagtgactcnatcttagcgtgctacaatggcggcagctgctagtgccctgctcctcgtnctctgctcagccttctgctcgcttgcccaccgggcggccggcgtcgactacggctcgtggcagagcgcccacgccacgttctacggcggcggcgacgcgtctggcacgatgggcggcgcgtgcggctaccggaacatgtacagcacggggtacggcaccaaca

SEQ ID NO: 75325 - DNA, 410 bp, Zea mays
  unsure at all n locations
  Clone ID: LIB3079-051-Q1-K1-E12
ggcacttcttcgccgcatgaaccgctatgggctgcttgctgagggtcagaacaagcttggttatgttcttgccctcaccgctcagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgagggtggagtctgagaagcacattgacttttcactgtcaagcccattcggtggaggccccgcangaagggtgaagagaaagaatcagaagaaggcaagcggtggcggggatgctggtgaataggatgaggagtgaggattgacaagtagtgttacaccaatataataatattatctaattttcttga

SEQ ID NO: 75326 - DNA, 167 bp, Zea mays
  unsure at all n locations
  Clone ID: LIB3079-051-Q1-K1-E3
cagctagctacatggactcctgcttttactttnctcatacagccactcctgcactgtccgccttcttctcctactcccctgcctgccaccaactgccaagtttccaagtgcatataccctccctgcctcacaaacaactccaccctttactaaataccatcatgttc

SEQ ID NO: 75327 - DNA, 139 bp, Zea mays
  Clone ID: LIB3079-051-Q1-K1-E4
tggatcctcatcatatgcatgcttatctacatacgattgtgatgtttatcgttcagatgttctttcatagcttattgtatatcatagatcatatcatcgttctccatatcttattccttgagttacttcttgtctttct

SEQ ID NO: 75328 - DNA, 338 bp, Zea mays
  Clone ID: LIB3079-051-Q1-K1-E7
cgcacgcgtccggcctcttcctggcgcgccgcaccgcgctggagatgctccgcgacgcgggtacgccgttccggaggaagagctcgcccgcaccctcccggagttccgcgcctggtgggaatacaggccggagctcgaacgcctcgccttctccactaccctcacctccgacccgtccagcaaggtgaaagttgtgttctgtccacctggacctgtcaaaatcgcagctatccggctgatatataccgaattcaaagattagaacttgtccagactgattctgatactgcagggcaaaataatgtttacaaccatagaatgcatcaaggggatctttc

SEQ ID NO: 75329 - DNA, 350 bp, Zea mays
  unsure at all n locations
  Clone ID: LIB3079-051-Q1-K1-E9
gggagaaagaggacttggcctcgccttcccttgcgtgtttaccgacgccaccggccnccggtatattttcacccaactccntccctctctcccggcccagatagatctttcccccgtcctccctcgccttcgccttcgccggcaggagatttccaccaccaccgccgaaccgccccgaccctcctcccctctcgcgctatggcccagactgttgtgctcaaagttggcatgtcctgggagggctggggtggagccttccaagcggtccctggccagattgaaggcgtccaggcctaccacgtagacatcatggaacagaaggtcaccgtgaaaggcaatgtgacacctga

SEQ ID NO: 75330 - DNA, 73 bp, Zea mays
  unsure at all n locations
  Clone ID: LIB3079-051-Q1-K1-F10
aaacccnncccgacccacgcaaccgcacgacccatacnaaaccaaccaaatcatctacaacaacaacaccaaa

SEQ ID NO: 75331 - DNA, 377 bp, Zea mays
  unsure at all n locations
  Clone ID: LIB3079-051-Q1-K1-F11
agcgacaccatatacagatgcagaagtgaatactgcttttagaacaaaagcgatgggagggcatccttaccaaaatcaaaatgatanacatgctgcagaagagaagttcaaggaggttgtcaagtcttacgaagcaattaaatcggagagaaaaaacggtgtaagttgatgcaaacttccagtgtggtcggatcaagtggtaaagactgggaccggatcacgcgggaatcagttgtgccttgtatatgtaaataaattgtgcccgccacttgataaaaatggtctttttttgcttgttaagaacttgaacaccaattccaattattaaccttggccgatttaaatttgaataggttcaaaagatttcttttttgttc

SEQ ID NO: 75332 - DNA, 274 bp, Zea mays
  unsure at all n locations
  Clone ID: LIB3079-051-Q1-K1-F12
cccacccaacgcacccagaccancgacaccaaaaacaaanacagttttntttacngcnnnganaacaaaaacactcgcccgttttatttaaaatttcaaaaccccaccaccncnncanaananaaattcaaagagattgtcaagtcttacgaatcaattaaatcttatagaaaaaactctttaaatttattcaaacttccacttttatcttatcaattgttaaaaactcttaccttatcactctcgaattaatttttccttttatatttaatca

SEQ ID NO: 75333 - DNA, 55 bp, Zea mays
  Clone ID: LIB3079-051-Q1-K1-F3
gggcgcgcgagggaggagaataagtttttgcctatagcccggtctcgtctgtctc

SEQ ID NO: 75334 - DNA, 51 bp, Zea mays
  Clone ID: LIB3079-051-Q1-K1-F4
attccctgctctacccacgacatccccgaccactccccaaatcctatctcc

SEQ ID NO: 75335 - DNA, 82 bp, Zea mays
  unsure at all n locations
  Clone ID: LIB3079-051-Q1-K1-F5
cccactcgtccgtatatatataccttttaccgtatacctgtctcaaattctcaactnagaanatttatagataggtctttgt

SEQ ID NO: 75336 - DNA, 241 bp, Zea mays
  Clone ID: LIB3079-051-Q1-K1-F7
gagcaactagcaacatagaaagcacattagtgtaccaacaatggcagccaaaatattgttccttcttatgctccttggtctttctgcaagtgctgctactgctaccatttttccgcaatgctcgcaagctcctatagcttcccttcttcccttgtaccttttaccagctgtgtcttctgtatgtgaaaacccaattcttcaactctacaggatccaacaggctagcacagctggcatttta

SEQ ID NO: 75337 - DNA, 120 bp, Zea mays
  unsure at all n locations
  Clone ID: LIB3079-051-Q1-K1-F8
taccggctcggaatanncgggggcgacgcgtccgcgcacgcgtccgcccacgcgtccgcctactcgtccgggccaaacgacgcgagagcgctgctncttttatataaccaccgcggtggc

SEQ ID NO: 75338 - DNA, 304 bp, Zea mays
  unsure at all n locations
  Clone ID: LIB3079-051-Q1-K1-D11
ctcgctttccccgagctctcgaaaccctatgtgcgtgccgaccggcggcggcggcnaggttatggctatggacccggacgcggtcgccaaagccttcgtggagcactactaccggacgttcgacaccaaccgcgcggcgctggtggggctgtatcaggagacctccatgctcaccttcgagggccagaagttccagggcccatccgccattgccggcaagctcggatctcttcccttccaggcctgcgagcaccagatcgtcaccgtcgactgccaaccgtcggggccctcaggaggcatgctc

SEQ ID NO: 75339 - DNA, 99 bp, Zea mays
  Clone ID: LIB3079-051-Q1-K1-G1
ccgttgataaagtttgcgtccttagctttggtatttctaccggtcttggtgcatcaatgaatgtttcaaaacctccgaagggttcgacagtggctgttt

SEQ ID NO: 75340 - DNA, 330 bp, Zea mays
  Clone ID: LIB3079-051-Q1-K1-G10
cggactcgtgggcttaaaattaattacttacagaagtcttccagcaattagaacgtacgtgcgagttccaaggtatgcaatggaaaccttgatactggggacagatctgtggccatgtggtggattgtatgacctctcccacccactcatgctaagacaaacttgggttgggcgcccacccttcgttcgttgaatcatgagctcgagccttagaggagaattttcagaaaaggaaatctacatgcccgagtgaccatgtaaatatttaccattgcagttcgcggacccatgagtaccaaaaaaaagagatgattcatattgacctgtaac

SEQ ID NO: 75341 - DNA, 297 bp, Zea mays
  unsure at all n locations
  Clone ID: LIB3079-051-Q1-K1-G11
cctgcctggaanggtttaatgaactcattccacgggagctgatatctatcttcaaccagaaagatcttgagcttgtgattagtggtcttccagatattgacttggacgatttgaaaacaaatacagaatattctggctacagcatagcctctccagtcgtccagtggttctgggaaatcgttcaggggttcagcaaggaagacaaagctcggttcctccagttcgtcactggcacttcaaaggtaccgttggaaggttttagtgaacttcaagggatctctggggccacaaggtttc

SEQ ID NO: 75342 - DNA, 156 bp, Zea mays
  Clone ID: LIB3079-051-Q1-K1-G12
taagcacgctacagcaaaaaaaaaaaaaaaaaacttatttcacaaaagccgacctctatataccgccccgtttaatttaaactttcatacaacccccccccacatatatacttcaactaaattaaaacaaatacccaatattttacctccatcata

SEQ ID NO: 75343 - DNA, 117 bp, Zea mays
  Clone ID: LIB3079-051-Q1-K1-G2
ctataatacccagctctacccactcttccgaaaaaaaaaaaaaaaaaaaaaaaatattaaaaaaaaaaaaaaaaaaaaaaaaaaaaagaaaattttaaaaaaataaaaactccaacc

SEQ ID NO: 75344 - DNA, 297 bp, Zea mays
  Clone ID: LIB3079-051-Q1-K1-G3
cggacgcgtggggcgagaaaggaaaattaaaaagaaggggtaatctcatgaaccatctgtgtacatctgcggtccgtggactggactgaagcgagcaagcctgcgccggctccgtcgttctcccaaacagaaactgtagttggtcaagaactgggatactgagttgaatatgatctcaaatccggtggactggtatagtttctgacccggatagaattggtagggatgcaagattggaaggtgcgtgagttcgaatgttaatttactgatgagtttgcccacaacaatagcaacgaa

SEQ ID NO: 75345 - DNA, 56 bp, Zea mays
  Clone ID: LIB3079-051-Q1-K1-G4
tctacccactcatccggcaagatgatctactccagctccaattataggttcaagct

SEQ ID NO: 75346 - DNA, 76 bp, Zea mays
  Clone ID: LIB3079-051-Q1-K1-H1
ttcccggctctacccactcatcctaaaaaaaaaaaaaaaaaaaaaaaaaatttttaaaaaaaaacaaccactctaa

SEQ ID NO: 75347 - DNA, 236 bp, Zea mays
  Clone ID: LIB3079-051-Q1-K1-H10
ccacgcgtccgcccacacatccgcggacgcgtggtataaaataaaaaaaaaaaaaaaaaaaaaaaaagaccgtattaaaaaaaaaaaaaaaaaaaaccccacccacaaaaaaaagggcccacctttctaaaacatccaagcttactcccccatccattccacgtctatcccctttacactgccacctaaattcaaaccacttcccaaccttttacaacatcttaactccaaaaacc

SEQ ID NO: 75348 - DNA, 241 bp, Zea mays
  Clone ID: LIB3079-051-Q1-K1-H11
aaaaaaaaaaaaataaaaaaaaaaattaaataaaaaaaaaaaaaaaaaaaaaaacacccgcttataaataaaaaaattttccacacccaaccaaaccaaacaaacataccctttcttccaacactcaaaactcaatttcacttgccacctaattacaactccctgaccttcatttcacaacctcaacccttctaaaaccctttcctaccccaactcatttcccctccatcacatacccctt

SEQ ID NO: 75349 - DNA, 200 bp, Zea mays
  Clone ID: LIB3079-050-Q1-K1-H1
atagctcccaggcatccgcaccacaccttttctgcttcttcctcctcctcctagcacagctgacactgttcaattttaaacctgtgatcacctctcccagcatctgcaagtgcaactgttactccatctgctcctacaccagctcattcatcttcatgttttttaacttttataccttctataccatcatttttaatacc

SEQ ID NO: 75350 - DNA, 64 bp, Zea mays
  Clone ID: LIB3079-050-Q1-K1-H12
aaaaaaaaataaaaataaaataaaaataaaaaaaaaaaaaaaaaaaaaaaaaaaaatatatatt

SEQ ID NO: 75351 - DNA, 192 bp, Zea mays
  Clone ID: LIB3079-050-Q1-K1-H2
tcatgccttgatgattgtctaaaatatttctccggtttaaggtcaactaattaacactaacgcaagggttaaatctaaaaacttaccaacctacccctattacagccttacatatcataccatcatctccattttacatcttatcatctacttctttttattgctatcaaactatatccactacaaatatat

SEQ ID NO: 75352 - DNA, 237 bp, Zea mays
  Clone ID: LIB3079-050-Q1-K1-H6
aaaaataaaaataaaaatacaataaaaaaaaaaaaaaaacaaaacaaaaataaaaaaatataaaaaaaaaacaaaaataaaatataaaaataaataaaaaaaattttaaaacaaataaataataaaatataatcaaaaaaaaatataaaatacaataaaaaataaaaataaattaaaaaaaaacaataaaaaacaaaatataacaaaaaaataaaaaaacaacaaaaaaaaaatata

SEQ ID NO: 75353 - DNA, 306 bp, Zea mays
  Clone ID: LIB3079-051-Q1-K1-A1
ctgttatttctatcgcctacactctaatattcagaagtatcagattctctcataattgtacgtctatggtgatgctttactttcttgcattatactgatgctcaatcatatattgatgatgattatgatttgagtatgactcatgagattaattcacacccctgaaggtaaatgaagtattatttgaggttggtattgtatctgaaggtaaatgaagtattatttgaggtttgtgttgtatctgaaggaagtgaagtttattgatgtttgtagcatgccttatacattgcatgactcatttgcata

SEQ ID NO: 75354 - DNA, 206 bp, Zea mays
  unsure at all n locations
  Clone ID: LIB3079-051-Q1-K1-A10
cgggagtacaaggtcaaggatctcttgcatgcggacttcggccgcctcgagattnaggtntcttaggtcgaaatgcccggcctcatngcgtgccgcgccgagttcggcccgtccaagcccttcgccggcgctaggatctcggggtctctccacatgaccatccagaccgccgtcctcatcgagacctctaccgcgctcggcgccga

SEQ ID NO: 75355 - DNA, 396 bp, Zea mays
  unsure at all n locations
  Clone ID: LIB3079-051-Q1-K1-A11
gtcgacccgagcgcacgcgtgcgcccacccctccgcttgatagaaggtttcttgtaaaatgtttgcttgataggatntttganctcgggtctcgatccccttttgctcntctggagatagttgggatgcgcggagaagcggctaaagttggacatacggggaattgaattgccagaggctgcagatacagaagtccgaatcttgatctttttgttcattcaaaacacggatggatacaacaagtaagcaatccttccattcttttggaagttgtagcaactgttccctagactatgttgatgcaacctctttgtatgagttatcctgtagaacttcacccgtttgtgccataagtattcttaaacctttaaaaaaaccaccggcattttttttttc

SEQ ID NO: 75356 - DNA, 254 bp, Zea mays
  unsure at all n locations
  Clone ID: LIB3079-051-Q1-K1-A12
ggaaaacccgggccgaccgcacgcgaccggatcaacntncataacgcgatgatgttgcattcccatatagagtacgggatcccaganagatcaatataaaagatactgctaaccaacccatcctacatcnttagtggccaaagagtaaacgcggagctgatagagtaccagatcctgtgctgccgagcacactcttctggacagtggcttctgctgctgctccacccgaaatggaagtccggcatggacaggga

SEQ ID NO: 75357 - DNA, 131 bp, Zea mays
  Clone ID: LIB3079-051-Q1-K1-A3
agctaactaccctcacgctggctcgccaccgccgcctcagcaggcgtgggaatctgttcgtcgctccctcggagaataggaggcagctctctcttcgtccgccattgctggctcttcctacccctacatgc

SEQ ID NO: 75358 - DNA, 97 bp, Zea mays
  Clone ID: LIB3079-051-Q1-K1-A4
atgcaagcagcgccgcgtgccccgctgtagcaccaagtgggtctgcctccagactctgatcgtcttgtgcctggtcgtctccatcgccgtcgccgcc

SEQ ID NO: 75359 - DNA, 251 bp, Zea mays
  Clone ID: LIB3079-051-Q1-K1-A6
ctgagtgtatttccaaagagatttgttttcctctctccatgtcttcatatgatgcctgtacagtatggtgaaggaagtgcagtgcctgtaccgtggactctagtaatgtgtaggaacatcgaaaattatgttttgagggaccaggaaactttgtatcggcaaaggtattttgatcttatggtaaaccatgtagtgaggcacatcttttagacacgatctaaaattgtctcatttattctaaagttttttga

SEQ ID NO: 75360 - DNA, 220 bp, Zea mays
  unsure at all n locations
  Clone ID: LIB3079-051-Q1-K1-B10
actcgccntctgccttctgcgcctctatttctgcctctgtcccttgcaagttcaatcgcatctccatccatgggtaaagagaacccccacatcaacattgtggttattggccatgtcgactctggcaagtcgaccaccacaggacaccttatctacaagcttggaggcattgacaagcgtgtgatcgagaagttcgagaaggaagctgcttaaattaaca

SEQ ID NO: 75361 - DNA, 268 bp, Zea mays
  unsure at all n locations
  Clone ID: LIB3079-051-Q1-K1-B11
gccggagaagagcgcccaccagatcatgctcttagaaggcgcgctggccggtgnaggacgatggctggtggcggtggactgaaccggtcttcatcgagggggcagctgccgccgcaagagctgcttgacgatctctgcagccggttccttctgaatgtgcccaaggaggagctggagtcgttcgagcggatcctgttcctgctggagcaggcgcactggttctatgaggacaactccgttgagcacaactccaacctcaagtccctct

SEQ ID NO: 75362 - DNA, 341 bp, Zea mays
  unsure at all n locations
  Clone ID: LIB3079-051-Q1-K1-B12
gcaaggaagagtgttgctccaggtccaagtttcaatgtctccagaaattttgattgggggtgcaatggaagtcgcgaagcaagccnaacaggagatactcagggctgatgccagcataagccaaatcagcttgcagctaagattgggccaacaaatcaagcaacttcagctagcatcgcaagaacgtcgctgatctacatgcaagagatcactgatccaattgctggctgcttcatgagtctactcgggagtatttccttttgctaatttttctgacatacattaacttggtctgcttatgaagcaataagctataagattctaagaaccgactgtgtaca

SEQ ID NO: 75363 - DNA, 251 bp, Zea mays
  Clone ID: LIB3079-051-Q1-K1-B2
atcgccttgttctagtggtggtactgatgggggaacgaataattgtaccgagtatggggcgccgtgtcgtgtcgtgccctgtcctgtcctgtcctgtccttcctggggctcatctagcattcagactgtgttgtgttgtgttgtgctgtgtgggccgagtgtgcactacagcatcgggccatgcccctgttcgatctgtctgcgactttaatttgtttgtgctgtgtcatctatctatctaattcatctat

SEQ ID NO: 75364 - DNA, 80 bp, Zea mays
  Clone ID: LIB3079-051-Q1-K1-B6
ccgacaccaacactgagactatgactgagactattaatgaaactatgaatgaatcaagtaggtttgtagacaggaatggg

SEQ ID NO: 75365 - DNA, 82 bp, Zea mays
  Clone ID: LIB3079-051-Q1-K1-B7
agtcgatatacatcatccttaatcgatctgaaacgttatatgtaaaaaaaaaaaaagaaaattttaaaaaaataggacagcc

SEQ ID NO: 75366 - DNA, 223 bp, Zea mays
  Clone ID: LIB3079-050-Q1-K1-G8
atttttaacaacatctacctcaacatttactccttccacttctacaattaccacttcttcttccactacttcaccaccttcttcctcttttatttttccaatttctacaaccatctctttaaaatccttcctcttttaactttaacatatactatctatattaattcaattatccttacctatcttctttcatcttcttctaattctttcttcttctctctat

SEQ ID NO: 75367 - DNA, 176 bp, Zea mays
  unsure at all n locations
  Clone ID: LIB3079-051-Q1-K1-B9
acccgngccgacccacgcatccnaacagaacataaaataaaaaaaaaaattaaaataaaaaaaaaaaaaaaaaaaaaaaccgaaacgtttaaataaaaaaattaaaaaaacaaaccacaaaaaaaaaaaaaaaaaaaaaatnctcctcctttaaatacacccaatccttaattaca

SEQ ID NO: 75368 - DNA, 84 bp, Zea mays
  unsure at all n locations
  Clone ID: LIB3079-051-Q1-K1-C1
tggtgtttactgtgacccttatcccttatatcaagttgatcataccatcacttatccagatnttttattcttctggggtctcat

SEQ ID NO: 75369 - DNA, 317 bp, Zea mays
  unsure at all n locations
  Clone ID: LIB3079-051-Q1-K1-C10
accggctgganacccgggcgggacgacgcgtcgggccgggttaaaaaacacacctagcttagctcactagcaacgacctaacaacaatggggngcatgatattatacgtcctcccacccctccccctacttganagtccaacaaattccttcattattccacaattctcacttnctcctactgccattattccacatttcctccctccanttacttcaatantcttctaacacccatctnttcaaacctatattctacaacaatctcttatcactatcatcttaaaacaaccatattcccaattacaacaacaattc

SEQ ID NO: 75370 - DNA, 247 bp, Zea mays
  unsure at all n locations
  Clone ID: LIB3079-051-Q1-K1-C11
gagagaangaaaaatatccccaaactctatctcccgatctcgatggcgaaccctcncgtctttttttacatgaccgtcngccgccccccggcgggccggatcgtgatggagctgtacgccaacgaggtgcccaagaccgcggagaacttccgcgcgctgtgcacgggcgagaagggcgtgggcaagtcctggaagccgctccactacaagggctccaccttccaccgcgttatccccgagttcaatg

SEQ ID NO: 75371 - DNA, 323 bp, Zea mays
  Clone ID: LIB3079-051-Q1-K1-C12
gcagattcaacagccttgcaacgagtgcattgggactggggagagcatcaacgaggagggcctctttccatggtgcaagggtcacaacctcgttcaagagaagaaggttcttgaggttcatgttgagaagggaatgcaacacaaccagaagatcaccttccctggtgaagctgatgaagcgcctgataccgtcactggaaacattgtattcgtcctccaacaaaaagaccactccaagttcaaaaaaaaaggtgaagatctcttttattagcacaccctttctctgacctaaactttatgtgggttccaaattgttcttacac

SEQ ID NO: 75372 - DNA, 94 bp, Zea mays
  Clone ID: LIB3079-051-Q1-K1-C4
ctgctcgtctcccgtccgttttctgattcccactccgaccaaaaccctatctacttggtgattgtggaggggaggagatggcgtcagctgatgg

SEQ ID NO: 75373 - DNA, 61 bp, Zea mays
  Clone ID: LIB3079-051-Q1-K1-C6
ttaatacccggctctacccactcatccagagagcaactattcttgatctcgaatctaccac

SEQ ID NO: 75374 - DNA, 361 bp, Zea mays
  Clone ID: LIB3079-051-Q1-K1-C7
cgttcccccgtcctccctcgccttcgtcttcgccggcaggagatttccaccaccacgtccgtaccgccccgaccctcctcccctctcgcgctatggcccagactgttgtgctcaaggttggcatgtcctgtgagggctgtgttggagctgtcaagcgggtcctcggcaagatggaaggcgtcgagtcctacgacgtagacatcatggaacagaaggtcaccgtgaagggcaatgtgacacctgacgccgtcctgcatactgtttcaagactggcaagaagacttcgttctgggaggctgaggccgttgcaagttaattcttcacacctgccggtgccaccgtctgacatggtcgatgatct

SEQ ID NO: 75375 - DNA, 292 bp, Zea mays
  Clone ID: LIB3079-051-Q1-K1-C9
tgagcattcacaaacacacctagcgtagctctactagcaacgacctaacaacaattgcttgcatgacattatacgtccttgccctcctcgccctttttgtgagtgcaacaaatgcgttcattattccacaatgctcacttgctccgagtgccattattccacagttcctccctccagttacttcaatgggcttcgaacacccagctgtgcaagcctataggctacaacaagcgcttgcggcgagcgtcttagaacaaccaattgcccaattacaacaacaatccttagcaca

SEQ ID NO: 75376 - DNA, 190 bp, Zea mays
  unsure at all n locations
  Clone ID: LIB3079-051-Q1-K1-D10
accggaacggannacccggcgggaccgacgcgacggaaaggcatacactacgcccccacccatgactacaaccagacgagcaaccnnttcatccgatcatggaataaagggtgtcccaccacatcaccaancccaacacnacngacatgagcgcggacgccggcaccgacagggtgatggggggggctgg

SEQ ID NO: 75377 - DNA, 432 bp, Zea mays
  Clone ID: LIB3079-020-Q1-K1-A2
tgaacaggcacatgagttggtcagggggctgcttggtatgtttccagatagtgtattggctggtttacttcaagccgctgttcatgttaaagaaaagaagattcacaaagctgaagatgttcttagccagtacgctgagaagcgtcctgagaattctaaagggctcctccttgcacttgcccagattgctgctaatgccaaccattttcagcttgctgctgactcactatccagaatacctgacattcagcacatgcctgcaacagttgctacattagtggcccttaaagagcgcctaggtgactccaatgctgcagcttctgtacttgattctgctatcaactggtggaagaattccatgaccgaggataacaaattagatatattaacacgggaggctgctgcatttaagctcagccatggacgtgatga

SEQ ID NO: 75378 - DNA, 340 bp, Zea mays
  Clone ID: LIB3079-020-Q1-K1-A3
tcttactggaggttggcttccccttctggtcagaaatttggtcagcgagtttgggttgataggcaggtggaagaccctgtgttttgttaatgacaataacaggaatgctgctattaacctgaatctgcctccagagagctatagttcaaacacaaccaacttaattgatgtgaacattgagcctgctgactcagcccttagtgcacatgctaagcgcacaaaggagttccatttctgttcaactgattttcctgaacccagtaagtctgtgccttttacgttggccactacctctttgtctgcagcagctgctacaaaccaaactggtgatgttcccatg

SEQ ID NO: 75379 - DNA, 400 bp, Zea mays
  unsure at all n locations
  Clone ID: LIB3079-020-Q1-K1-A4
gcaaaacgagctatgcaagaactttcccaaattgggataatgccagaaatgtggggtggggggtccccaatgatcgagataagtgctcttactggggataatgttgatgaacttctggaaactgtcatgcttgttgcaaagttggaagaattaaaggcaaatccacataggaatgccaagggcactgttattgaagcatgccttgacaaggccaaaaggcctcttgctaccttagttgttcagaatggaaccctaaacaaagctgatattattgtgtgtggtgaagcttatggaaagatccgtgcattgtatgatgactgtgggaagctcgttgacaaagcangaccattcaatgcagtgcatgttattggcctcaataacgttccccttgccggtgatg

SEQ ID NO: 75380 - DNA, 311 bp, Zea mays
  Clone ID: LIB3079-020-Q1-K1-A5
aacccacgcgtccacccactcttccgttcaactcctatgcttatcactgccactaccaccagatcgagctagtccttctcacaaacccgcatgctttactgatacacctacaaatcttcatcttaacacacatatatctccactacatctaatcctcacacacatccaccattaatctcatacctaacacataaccctcttcacttatcccatacttcacatactcaacgcacaaacgaattccactatcgtctaactgatcctcaccatccccataatactgatcctttcactttccacactcaatatta

SEQ ID NO: 75381 - DNA, 235 bp, Zea mays
  Clone ID: LIB3079-020-Q1-K1-A6
ttttatctcaaaaaataaaaaaatcattaaaaaaaaaaaaacaaaaaaaaaaaaagaaagaaaaacttaaaaccgagaagaacatattaaaaaaaaaaaactcctctaacatacccattcttccttaccactacactcaaaatcattccccttattttaaaaaacttctccttacacttacccccattgttcctaaccccaccatttttaaccccactgcttactccctatccaa

SEQ ID NO: 75382 - DNA, 289 bp, Zea mays
  Clone ID: LIB3079-020-Q1-K1-A7
aaaaatcttaaaaaaaaaaaaaataaattaaaaaaaataaaaaaaataaaaaatggtagcaaaataaaaaagggctgcgggcatttaaaattacaacaacgattgctaagaacaacattaccattgctccactgttctatactcatttacacatgtcaattcctcttcacaatctatacacactctttatacaaaacttatatcatacacaaaccttaatttttacactcgctactcttccgtaccaacatccaatctcactcgatataaatccctttcactatgacct

SEQ ID NO: 75383 - DNA, 408 bp, Zea mays
  Clone ID: LIB3079-020-Q1-K1-A8
ccgcgaccgggagagagtcagagagagacgcccgcctccagatcgtccggcggggatggcggcgtcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgccgtcaaggttacatcaccctatggcaatactgtgcatcataatgaaaatgctacaacgggccagtttgcattcaccacttcagaagctggaaactaccttgcatgtttctggatagacagcgtggagaaaggatcatgaacatctctaaatcttga

SEQ ID NO: 75384 - DNA, 332 bp, Zea mays
  Clone ID: LIB3079-020-Q1-K1-A9
cccacgcgtccgcccacgcgtccgtgaagctgtacatggttgcgccatttttgacgggtcttaaggcttggattgccacacatcctccaccactgcatcagaaaccagagacatctgctagaggtactgtgtggagggcgaagggttcgtcgagcggcacaaccccagtggagaatcctgttgctaaagcaggatctgacgtgcagcacgctgccgaccgccctggttgcagcttcagaaacttcaggtttgacaccgcaagcatcctgcaggccatggaggcttccttcctacgcacctagaatcctgacgaagcatcaacacctgcaccc

SEQ ID NO: 75385 - DNA, 285 bp, Zea mays
  Clone ID: LIB3079-020-Q1-K1-B1
gtggcccatgacatgttcaccatggactaccgatgcccgctctcggccttccaggctgtcggcatctgcttgagctgcttctacaccaaattggcctgcgcgtaaaggagggatagaagcagtggaaccggagcctctatgattttttatgcatatcggtcgtgcatggttgaattctgctacctgactgttaacctggaaccgggaccctctttgcattttgttcatgggttcgatgggaatgtgaaaaaaaataacacaaaaaaaaaaccttaaacaataacc

SEQ ID NO: 75386 - DNA, 414 bp, Zea mays
  Clone ID: LIB3079-020-Q1-K1-B10
cttggattgaagctagtttttatcacatttcacccgatgaaatggggaggcactttagggaactccttcctgtttaatgttgggctcatactactttgctccatcagtgtgattcagttctgtgccacggcttttgcctactacgcacaagcaactgcagctcaagagatatttggccacactttgcaatcccttcgtggaattaagtatctttacaagtacaatgttttccagtatggctttgttgctcttgccatcctcactctcttctactatgctatatttggatggagaaagaggaaaccaacaggaagattccagctctcaaattgatttgctctgtaagtgaagtttgacggattcatcatatgtgccccctgagtggtagttcagttagcatcttaaaaatgtata

SEQ ID NO: 75387 - DNA, 371 bp, Zea mays
  Clone ID: LIB3079-020-Q1-K1-B11
cttgtcttgtgggctgtgcctgtgacggactgacggcacacaggtaatggagggcgggcctaccaccatcaccgtccaggtcaagttcgccgggcggacgatccccgtggaggtcccggcagcggcttccggcgcggagctgaagcgcctcctacagccgctgaccaatgtcctcccgcgcggccagaggctcatctgcaaaggcaaagtgctccaggatgccgcaagcctgagctcgatgcaagtagtgggcggatccaaggcgatgctcatcgcgtcgcaagggctccatcacggggatggtcctatcacaagtcatcgcagtagctcagcaacaactgtgagaaggccttcaaatgttaaggagaatc

SEQ ID NO: 75388 - DNA, 390 bp, Zea mays
  Clone ID: LIB3079-020-Q1-K1-B12
cagacgctgccgcggtctcctgatactgtgatgacggcaagggttgtgctgctgggcgcaagcaagctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctg

SEQ ID NO: 75389 - DNA, 380 bp, Zea mays
  Clone ID: LIB3079-020-Q1-K1-B2
cccaagtcaaatcaccaacaaaacctacacaaacgacatggagacgaagcacattgacgtttgtggatgatctccaagcaatgttcccatggaaggagaagcaccaggtaaccaatttatatgttgagctactagtggagatcatgagggcacagagcaacaaccaacatgttgtgccaagtagcgtccttgtgaatgataactttgggatgctgtcaaaacccatggacaacatgaaagtgatagaagggtatctaatggatgagatggaggccatgaggattctagaggagcaaccaaatatgctgaatgtcattcataagaaaaagaggcatggagtgaagttttggaccacagacgagcacaggaattttcttcgt

SEQ ID NO: 75390 - DNA, 353 bp, Zea mays
  Clone ID: LIB3079-020-Q1-K1-B3
cccacgcagatcaccaacctatcgtatacatacgacatgtagacgaaccacattcggtttgcatatgatctgcaagcggtgtgcccatataaggagaagcaccaaatgaccaatttatatgttgagctactagtggagatcatgagggcacagaacaacaaccaacatgttgtgccaagtagcgtccttgttaatgataaccctgggatgctgtcaaaacccatggacaacatgaaagtgattgaagggtatctaatggatgagatggaggccatgacgattctagaagaacaaccaaatatgctgaatgtcattcataagaaaaagaggcatggagtgaaattttggaccac

SEQ ID NO: 75391 - DNA, 390 bp, Zea mays
  Clone ID: LIB3079-020-Q1-K1-B4
gtgcccacccagcgtgcaacctaggcgagaaccgccttcccctccgctccttccagcgcgcgctgtaatctgcatcagcctcgcccgccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaaaagactaaacataaaggcactgagggtattattcagattgaaaatccaaacttggtgaaagccaagaatataaaggccaaggaagttgattttggcaagacaactgaac

SEQ ID NO: 75392 - DNA, 352 bp, Zea mays
  Clone ID: LIB3079-020-Q1-K1-B5
gttctagatgcgagcgccgccctttttttttttttttaacaagaatctttatctttagaatctaaattctcgctacaacatgttggcttacaacgagattgtaaaaaacagcattaccagtgtacgactgtacaacgctcatttacaaggacaattacggttcacaatttatacacacacatcatacaaaatcgctatcatacacaggcgttgaggtgtacacgcgcaacgctcccgtgccaacagccaggctcacgcgaaaaaaagcccttccacgatgaccgaaaaacaaagcacatccaaatccatccccaaaaagggcaaccgcgacatgcgaaacctctcaaaaacg

SEQ ID NO: 75393 - DNA, 397 bp, Zea mays
  Clone ID: LIB3079-020-Q1-K1-A12
gatttaggcacatcgtacatgttcttgtcatattaagtgtcacctatgctcaagagttggtagtgtagataattttctctatgcaaatgcaattgttagagaccgcatttattctatgatggtattttttagtaccaacaatggacaaggaccccatcgaaatggtagagagcacagtgtgagtgatccagggaagccttgatatcattcgcagcctggtcactaatggtgttgtgaatgtaacccacctcagtctatctattcccttaagaccacattgtttcaaataatagatgtgtgtgacatgcttgacaagtgtgtcgtctccatgatttttttgctaaagctaagagggaagaagttattcaagcttaagatacatccaccacaacagatg

SEQ ID NO: 75394 - DNA, 373 bp, Zea mays
  Clone ID: LIB3079-020-Q1-K1-B6
gttctagatgcgagcgccgccctttttttttttttttaacaagaatctttatcgttggaatctaaattctcgctacaacatgttggcttacaacgagattgtaaaaaacagcattaccagtgtacgactgtacaacgctcatttacaaggacaattacggttcacaatttatacacacacatcatacaaaatcgctatcatacacaggcgttgaggtgtacacgcgcaacgctcccgtgccaacagccaggctcacgcgaaaaaaagcccttccacgatgaccgaaaaacaaagcacatccaaatccatccccaaaaagggcaaccgcgacatgcgaaacctctcaaaaacgaccatccggacgttggacaca

SEQ ID NO: 75395 - DNA, 380 bp, Zea mays
  unsure at all n locations
  Clone ID: LIB3079-019-Q1-K1-G10
gccaaatagggacatgaactgcatcgtcgatctgctcacgcctccagagagggcgagacacggtgtcgacaagataaaacgtctgaaagatctctgcgacaactcgcctcatcatcaggtggtggtgtagacagacagcagctgtcattgctaatggagttcggaggcaagatatatggtctagtaaataaagtcgtcgatcaaagcatgacaactgtcaaatgtatctntgattaaagtaaagtatcacttcaagaattcccaagttcttttttttttaaaaaaaaaaaacataaacagtatatacaaataaaataaaaaaaaaattataaaattgtaataatttaaaaggttacaaaaattaaataatacaatctttt

SEQ ID NO: 75396 - DNA, 282 bp, Zea mays
  Clone ID: LIB3079-019-Q1-K1-G11
caatttatgactgtggggataaaggaaattcattctggttacaggattgagagtgcggttgctgaaaagtcacatgaagatcacgcagagcatgatcatgaacaccatgagcatgagaatgaacacgaccatgaccatcatcaccatcatgatcatgatcatggtaagccttgatgttggaacattattatggcatgagctgactgacgtggtagtatcaaactcctgattctctatgatcagtagcactcacttgtaccaccaattaggaaatgatgtgca

SEQ ID NO: 75397 - DNA, 340 bp, Zea mays
  Clone ID: LIB3079-019-Q1-K1-G2
gccaccgtcggctcctagcaagggtgctatgacgacgactgctatagctccgtgtcaggattcagcacattagtcatgacatgctgaaactccatctatatagacactagatctattgacataactgtaaacgtatataataaatgcagtcattgtcacattatgcttgtgaagtcctcataggaaaggataactcttgaataaaatgctctggaaagtacctgcctacaatctggacttgcgaacaatcgaataaatggtgacaatgaggctaattgtcttacgttgtacttgatgaactctagagtattatcactcgtcaaactgaaaacgggaacta

SEQ ID NO: 75398 - DNA, 297 bp, Zea mays
  Clone ID: LIB3079-019-Q1-K1-G3
cccacgcgtccttccactcgtcagtcctctcttcctaccacgcttccgctcagttcgcgtgggtattatccaaattaagaccgaagctccttgaccgtctgatctcctgtccaaatacaacctactaatcactatcgaccaacatctcttttatgccacggtctacacccgagcaaagttcattttaccagtggatccctactaataaaggaagatgattgcgatctcatcttgtggatctatactaactccctactcactttcgctacacatgatgtacactcataataaatgtat

SEQ ID NO: 75399 - DNA, 168 bp, Zea mays
  Clone ID: LIB3079-019-Q1-K1-G4
attccctctcgacccactcgtcctcccacacttccttccactctccaaccttcttttcctaccacccctcctctcacttcacgaagcttttatccaaatttagacctaacctcctattccttctaatctcatcaacaaatacaacaccctaatcatcatctaccaaca

SEQ ID NO: 75400 - DNA, 366 bp, Zea mays
  Clone ID: LIB3079-019-Q1-K1-G5
cccacgcgtccgggaggcgcgtgctcttctccactccacctccccctccccccccgcgggcgccactgacgccgctcgttcgcgcagttttggtcttctggccatcagggcaggcggggaacccgcgggagccaggcgcgcgatcgagcgagcggagggaggaggaggatgatgcacgccaagtccgagtcggacgtgacgagcctggcggcgtcttcgcctccgcggtcgccgaagcgtggcgttgccgtggtcggcaccggcggcagctgcggccgctactacttgcagagcccgtcgcggtagtcgcacgactgtggcggcagctggcgcaaggtgctcaacgaccagggctggaccgagtgc

SEQ ID NO: 75401 - DNA, 52 bp, Zea mays
  Clone ID: LIB3079-019-Q1-K1-G7
aaaaaaaaaaaaaaaaaaaaaaaaatattaaaaaaaaaaaaaggacaaacaa

SEQ ID NO: 75402 - DNA, 261 bp, Zea mays
  Clone ID: LIB3079-019-Q1-K1-G9
ctcatatacaacctcgacctcccgtatcgctctgggcaccacgcctactcggggccgtcgtcaactccaataatcacctcctccaacctgctcttcaatctgcggaacctcttctacctgcacgcctaccaagcatccatcatcaacagctacgatcctagactcgactccaactcctactctgagctcgacaccatacaataccgctcctacatcgccctcggctcctaccacttggtgatcatctagatcgactcgtca

SEQ ID NO: 75403 - DNA, 432 bp, Zea mays
  unsure at all n locations
  Clone ID: LIB3079-019-Q1-K1-H1
caaggcaggacatcacgtcgaggtgaccgggatacaaacggcacaggctgacgtggaggtgagcttcgaggtgtcgccggcggccctggccggtgccgagacgctggacccggcgctggcctacgacgcggagaagctgtgcggcgtgaagcgcgcggacgtgaggggcggcgtggggccgttcgggctgtgggtgctggcctncgccaaccgcaaggagagaaccgccgtgttcttcagggtgttcaagcccgccgccggcagcgacaagcccgtggtgctcatgtgcaccgaccctaccaagtcgtccctgaacccgaacctgtaccgnccgacatttgcaggatttgtcgacacggacatctcgaacggcaagatatccctgagaagcctgatcgaccggtcggtcgttgagagcttcggagccggggc

SEQ ID NO: 75404 - DNA, 311 bp, Zea mays
  unsure at all n locations
  Clone ID: LIB3079-019-Q1-K1-H11
ctgcatggcggctggagggtaggtggtaggagagaggaaattggaaaagagaacctagctctatagtatgtgggaaaccctaacttanggttgggagttgcattaatagaccaagtgatgttggacctggcccattacacatgggtatgaatgtaattacaaggggctaaccccaaaaccctaaatgggattctaacaaagttgttttttccgttggtgttaatcatataagtattagcatttcagttgaattttctactctcaaatatattgaatgaactggtttacaattctagtatgtaaatattctt

SEQ ID NO: 75405 - DNA, 447 bp, Zea mays
  Clone ID: LIB3079-019-Q1-K1-H12
cccacgcgtccggaaggaggctgaaggcaagcccgactgggtgaaggatcttgatgctgttggcgagaatggagaggagattgagaacccacttactctgttgaatgatccatcctctgttgagccactggggaactgtgggaagaaggtcctactgtggtggcttcgtgttgaagcacgggcggatagcaagtttcctcaagggtgggtaattgagccacctttggaagtcgtcgtccccgcaaagcgcactccatggcctgaaaccacccccgagcttccatccgagttattggatgacaagcaaaagctggaggataggcacttgtcaagaggcaacaaatcgtctcagccccgaggcaccacgaaacggaagggcgaccctcaagggcaagataactgatggagaacgcactggcattgtaatgtatatctcttgcaccctgc

SEQ ID NO: 75406 - DNA, 57 bp, Zea mays
  Clone ID: LIB3079-019-Q1-K1-H4
cccacgcgtccgaaaaaaaaaaaaaattatttaaaaaaaaaaaaaaaaaaaacaaaa

SEQ ID NO: 75407 - DNA, 426 bp, Zea mays
  unsure at all n locations
  Clone ID: LIB3079-019-Q1-K1-H5
caccggggaaccctacccgagcatcagccatggcgatcgcggcgcgcgtcctgcgccggctcccgctccacctctacccctcgctcgctcgctctttctgcgcagtttccccggccgccgcctcggccgccccggcgtccgcctcggccgccccggcgtccgccaaggtcgccgatcgcatcgtgcgcgtcctcgccatcgatctcgagggggcgcgccgcgaggtcgtcggcctctccgggcagacactcctccgcgcgctcgccaacgcggagctcatcgagccggcctcccaccgcctcgaggatatcgacgcgtgctccgccgagtgcgaggtccacatcgcgcaggagtggctcgacaagctgccgncaccgtcctacgaggagcggtacgtgctcacgcgcgcgttcaggaaccgcgagc

SEQ ID NO: 75408 - DNA, 433 bp, Zea mays
  Clone ID: LIB3079-019-Q1-K1-H6
gcaccaagaagccgtggtccctgtctttctccttcggccgtgccctccaggcgagcaggctcaaggcctgggctggcaaggtggagaacctggagaaggctagagctgccttcctcgccaggtgcaaggccaactctgaggctaccctcggcacctacaagggtgatgctgccgccgacaccgagagcctccacgtcaaggactacaagtactgagttgcttctctttgcgtgcccgttttggaactcctgcctacgagctaggttgcggagtgtggtttgctcgttagagcttattttcggacatccaaaaaacatgcttcctatgtgggatgatggttatctttatatttgtatgttaattagtctctttgctgttaaatttcgtgtaagttggtcctgccgatggagaatcgagcagctcccttttttgg

SEQ ID NO: 75409 - DNA, 330 bp, Zea mays
  Clone ID: LIB3079-019-Q1-K1-H7
gaaccaacaaccctacgtccgcgttttttttcttcagccgtgccctccatccgatcagcactcattgcctgagctggcgcgggctctcaacctgtacaacgctacagctgcctttctcgccagctgcaaggccaactcttacgcttccctcggcacctacaacgttgatgctgccgcccacacctagagcctccacgtcatggactacaactactgactccctactctatgcgttcccatttcggaactcctgcctacgatctacgatctacgagtgaggcctgctccttatagcttattctccgacatccaaaacacatgcttcatatg

SEQ ID NO: 75410 - DNA, 418 bp, Zea mays
  Clone ID: LIB3079-019-Q1-K1-H8
gtgcaacccctgccatgcatccgtccttcgcgcatccatgggctggcactgtccgggggtggccatatgaccagtccgggcgcccaccaccgccgccagcgttcaacgcccttccacaatacaacagcttcggcagcacacccagtgcctatggaggcttctacggtgctcctccccctccgtatggcatgccctacgggggagctgcaccccctggtttccaggcgcccgcaccagcataccaagcgacgccctggaaccccactcacggtggtgcatggcatcaggacgcccttgcacactccttcaacactatgacgctcaatccaccgaacgctacttccgagtggtatgccgactccggtgcaggatcacacatgacctcggacgctggatttgcaaaccatgaacgtgatcg

SEQ ID NO: 75411 - DNA, 424 bp, Zea mays
  Clone ID: LIB3079-019-Q1-K1-G1
cccacgcgtccgcccacgcgtccgcccacgcgtccgcccacgcgtccgctcagttggcgtgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttcttctctctctctagattctgacgagtggtggtctgcactcgtcgtaatgtcg

SEQ ID NO: 75412 - DNA, 359 bp, Zea mays
  Clone ID: LIB3079-020-Q1-K1-A1
gtgaagcgtacatgatcgcatgggcctaggcaaactgaagaacccagacgcggacaagagcgccgagtccgacgggctcggacgattcgacgtcgatgagcacaacaggcgcgagaacgcgctgctggagttcgtgcgcgtggtggaggccaaggagcaggtggtggccggcacgctgcaccacctcacgctcgaggccgtcgaggccgggaggaagaagctctacgaggccaaggtctgggtcaagccatggctcgacttcaaggagctccaggaattcagccacaagggggacgccaccgacttcaccaacgccgacctcggcgccaagcaaggtggacatgaacctggttggcgtg

SEQ ID NO: 75413 - DNA, 228 bp, Zea mays
  Clone ID: LIB3079-020-Q1-K1-A10
gtcgggttcatggtgtcggccgccatcatggcgtccgtcacgctcgtgaactgcgcggcggcgtcgttctacgtgaaggtgaagccgcagaagagcatgtgggttggcttactgaaggtggtggttgttgctgtcaagaaccgtgaccttgtgctgccagaggcagatcatggcgctcagttccattggttaccgggttcgacacagacggttccatcaaacaaaatc

SEQ ID NO: 75414 - DNA, 262 bp, Zea mays
  Clone ID: LIB3079-020-Q1-K1-A11
aacacgcgcacggcctcgcacgccattatctcaaccgtcacgctccatgaactgacgggggcttatcgctcgtacttgaagcgcatgctgcaccactagcatgtgagaccacttacatgtgctagaggttctgtctggaaagaaaccggaccttctactggcacacgcacatcatagaactcagttgctttagctacctctgacgtacaacacgctgccatccgacatgatcgcagctctgaacacttcatgcatgacaccg

SEQ ID NO: 75415 - DNA, 398 bp, Zea mays
  Clone ID: LIB3079-019-Q1-K1-E5
gcataagctgggtgctatgcctacagaagaagctatgcaagggtacatcacaattggtgaggacctattccctaactgggatgcaggtgcaagtgcgaaaaggaaagatgaagatagcattgcttccgcatcagcttcaaaggggcccatgggacctgtgtttagcagtttaatgtatgaggaagacgaaggaaatgaatcagaacttggtgacatccatgtttcagcaagggaaggggcgactgatgacatagtgaagcttctggcagctggtgttgaggtcaacgtgagagataccgaaggtagaagtccgttgcactgggctgttgatcgtggccatcttagtgctgtcgaggttcttgcaaatgcaaatgcagatctgaatgctaaggacaatg

SEQ ID NO: 75416 - DNA, 417 bp, Zea mays
  Clone ID: LIB3079-019-Q1-K1-E6
tcgcgacgtgtcctcgacgactaggcaatgtcctatatggctgggtcgtgccaccggttgggtggggccctgcaaccaagaccagtgggttgctcttcctgtcaatctgctggccacgttgagtgcaagtggtgtgcaggaacaggcttctttatccttggtgacaacatattgtgtgaagtaccctcaagaaattcaaaatgtgtgatatgctctggaaagggcttcacaagttgtgctgattgccaagggacaggttttcgtgccaagtggctggaagaacctcctattgacaaatgaggaagtcaatcatactgtaaaatttaccatgtcacagtaaactagctacttttatgcttttctgtccatatccttcaatgtaactctgataatatgattttccttttcctgtaaaaa

SEQ ID NO: 75417 - DNA, 206 bp, Zea mays
  Clone ID: LIB3079-019-Q1-K1-E7
caaaatctcaaaaaccattcctatttatacaaccatacttcaccccaccctacctgacgcctataaactcactcatgtcataacaaaatacagtctccaaatatacccttctcattcatacaattctaatcttataatcttttacacatacaaccaataattcccatatatataaacttcatataattttccaaatacccaaaacc

SEQ ID NO: 75418 - DNA, 428 bp, Zea mays
  Clone ID: LIB3079-019-Q1-K1-E8
gagagcttaaaggatactacaaggcaataagggattcaagaaaagaaagcggggttgggtggaatgacaccctatgcatggtactagctgaaccagaagtttggccaaggctgattcgcgtatcaaagtttcgcaataggccattccctcttttttacagtttagaagggctatatgaaggtagtgtggctaccggagagttgaatttcacatcaaccgctgttgatcttcctccaccttcagctccatccaggagtgtgtctggacaaagtctcagtcctttgagtactaattcacttgatttggatggacaagaaaccacaagtgtgttcaatctatcttgtgatgctcaatctgtccgagtcaatactaatgaacccactgaagctcaatttgtcccatctaatcaagaatcaagccagagagaa

SEQ ID NO: 75419 - DNA, 418 bp, Zea mays
  unsure at all n locations
  Clone ID: LIB3079-019-Q1-K1-E9
gtggctccaacaatccaccggcaccaacccagcgcggcgccaccggcgacgcgtacggcctcccccggagagcgatggcgacggagctgacggcggcgcagctgcgcgcgtacgacggcaccgacccgtccaagcccatctacgtctccgtccggggcaaggtctacgacgtcacctccggccgcggcttctacggccccggcggcgcctacgccgtcttcgcgggccgcgaggccagccgcgccctcggcaagatgtccaaggacgaggccgacgtctccggggacctctccgggctcaccgacaaggagctcggcgtcctcgccgactgggagatcaagttccaggccaagtaccccgtcgtcgcccgactcgncgncgacgcctgaactcgtcagtcttcgtctaaatttactct

SEQ ID NO: 75420 - DNA, 410 bp, Zea mays
  Clone ID: LIB3079-019-Q1-K1-F1
gttacagcctaaaagaaggaattcctagtttccttacgaatgttgccgcaacgattctgacaacagggaagtatcttaatgttatgagagaatgtgggcacaatgttcaggtttccttgtcagacaattctaagcttatgagctttggctcaaaccaccaatatcttgaatgtataaaatctgcatatgattttgcaagtggtgaattgttgactctgatgaaagataagtatgatctcatcgggaaactccgatccctgaagcgctatctactccttgaccaaggtgactttttggtccattttatggatattgctcgagaggagcttacaaagaaaccagaagaaatatccgctgaaaaacttcagtctctgcttgacattgctttacggagtactgcagctgcttca

SEQ ID NO: 75421 - DNA, 222 bp, Zea mays
  Clone ID: LIB3079-019-Q1-K1-F10
agaaaggtggttgttattgtgggtgatgatcctgatggtctacttattgatgcaaagtctggaaagacagttcattccataaaaggacatcgggactactcatttgcatcggcttggagccctgatgggcgaacatttgctaccggcaaccaagacaagacatgccgaatctgggacgtgaggaacctttcaaaatccgtccatgtgttgaggggtaacctt

SEQ ID NO: 75422 - DNA, 322 bp, Zea mays
  Clone ID: LIB3079-019-Q1-K1-F11
agacaatatggaatccaccttggaacttagatgtgcaagaaaattcttgctgactgggttaatactttgcacctttacacactaaacatggacaagtctgctataggaattttgatgaatcttggattaattgaggagtccaaggtttcaaggccattaccttggaggccagcgactaatgttttccgtgttaaagaggatgttcgacctatattctgggccaacagaccaaagagctatcttaaaaggacattaggttgggatcagtatccccatggacggtggggtgattttcggaacccatcatatggagcacttactg

SEQ ID NO: 75423 - DNA, 414 bp, Zea mays
  unsure at all n locations
  Clone ID: LIB3079-019-Q1-K1-F2
gggacactggagaccgaactgaagcaaccaatagcacctgtcatggtgattctctttgccggaacgagccactaacccctgattccaactgccagaacggttctcctgtcgctagtccaaaccatgaaagggcagccaagaggcagcgaggcagtggtactgaattcttagattctgaggctgagttttcccttccgcgccacatcttcgagtcgagttcaggctcagagttccaacaatactcaatgtcctactcaggacagtagcttctgatgttcacatcatctctgcaccgttgctagcttgttcagcacgatgcgcatggtccgtaggtctgggtaggttgatgtctcaaggagcgtgttgttggtaaacaaagctgtangtgttcagtgattgtctacatggtatacg

SEQ ID NO: 75424 - DNA, 405 bp, Zea mays
  Clone ID: LIB3079-019-Q1-K1-F3
cggacgcgtgggggcggcatctaacaagattgcagcggcacatgtcgtcttcgtccttgccttgctccttgtggcctatcgtgcggaggcaactgtctgcatgaggcataacaatttctatcacggcccatgcatgagcaacaaggactgtgccaactcgtgcgttcaacataacctcggtgtcggcgggtattgcaggggcaagatcccattcaacaaagaatgcatgtgtacatttgaatgcccatgagtcaaaagccactatatctgacgggcgcaacttgttatatatctagggatgggatgtcgtttggcatgtcctccattttgaaagtgtccaagtgagactttatacatatatgcagttgagagatggaattaataataagagcaaacaattatgtt

SEQ ID NO: 75425 - DNA, 410 bp, Zea mays
  unsure at all n locations
  Clone ID: LIB3079-019-Q1-K1-F4
gttgaagctgaagggtaaagcgctggacgtgaaagatggtggagtaaagaaaaagaaggggtaccagcatgagaagtcgtctcagactgaatctgataagaatagagatgaagagaacccacatcttgactatgaccatctcacaccagcagagcgccgatacatgaaacagaagcagaagatcgacatgcagaagatagccaaagtcgccaacaagtcacacaaggaccgcatgcaggacttcaaccagtacctagctaagctcagcgaccactacgacgtccctaaagttggtcctggctaacatggccaatctagctgtgttacgcacgaacaattgtatgctgagtgggtctatctagttntctattagcattttatatatcgttttacagttgttgtaaaacgac

SEQ ID NO: 75426 - DNA, 433 bp, Zea mays
  Clone ID: LIB3079-019-Q1-K1-F5
cacactttgagcattcttgatcattctcactccgactttgcgcactcgtttgacagtcttagtgatttgagctccgttctagtggtgaactttgtgatactcatttgagctcaattcttggctgtgtgtgtgcgtatttgctgtggatttgagtgtgttgcttccctcccttactctagtgctttcactttgattcttattgtaagggtgagagactccaagttgtggagattcctcacaagcgggaaagagtaaagaaagaagaacaccgtggtattcaagtcgatcattggatcacttgataggggttgagtgcaaccctcgtccgttgggacgccacaacgtgtagtatgcaagttttgtacttggccgaaccacgggataaatcctcgtgtctcttgtgctagatctcactatgtctattgtatttcac

SEQ ID NO: 75427 - DNA, 388 bp, Zea mays
  Clone ID: LIB3079-019-Q1-K1-F6
agaggtttacgcactagtgccatctctcaaggctaataggtcagctatcgaaggttcagtcaccgaggttcttaccgccctcgcaaacataaaagctgctaagtgaatctccaatggaactagaccgacaataaatcggaagcagctgtcttgttgatcgaggagcgcggaatctgcaaactggcccttcagtgttttggatgtgctgcggaaacgtgttatgatgtgtatataaaaaacgtagcatgtgctgcatgaactcctgtaggatgtctaactactgaagtgcagattcagcctcaactagtctactcgaactgacgaatactgtctgaacatgtggctactgcttgaacatgacatgttgccatctgttggattgtgcttc

SEQ ID NO: 75428 - DNA, 393 bp, Zea mays
  Clone ID: LIB3079-019-Q1-K1-F7
aataaatctcaagtcttgtatttaagattactaatacggttgcatacaaaacggggctgaaagctcacagcgctgttgtgttaaaggctgagagcatggcctacaaggttgagtgggtaaataagatcaaagctgttattcacagcaaagggggttctttcaagggtccaagtactgagggtagttcaatgagcgcaaagcaattttgatggcgctttagatactatggcacgtacacctgctgatcctgaagaagaacttacatggatgtctcaagaagttcgtggttatgtcgaggctgttctgaatagtctggcagcaaatgctccaaatgctattgtgctttgtcaagtggagaaagcaaatgaagacatgcttaaccagctatacagc

SEQ ID NO: 75429 - DNA, 366 bp, Zea mays
  Clone ID: LIB3079-019-Q1-K1-F8
aacaagtttactcactattgccatttctttacgctaataagtccactctcaaagcgtcgttcacctaactacttaccgtcctctaatacataaaacctactcaattaatctgcaatactactttacctacaatacaatcttaaccagctaacttattgatcaaatatcaccaattactcaaactcatccattaaaattcccaattttctactgaaacatactatgatctgtatataaaccacataacattcactactataatctcctgtatgatttctaactactgaattacatataaatcactaactaatctactctatcttaccaatactctcttaacatttctcttctgatttaacattacat

SEQ ID NO: 75430 - DNA, 313 bp, Zea mays
  Clone ID: LIB3079-019-Q1-K1-F9
cccacgcgtccggtcgtcgccggaaggaaaggcgcggagcaagatgtcgtggcaggggtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacatagtacatggtgatccaaggtgaacctggagttgtcatccgaggaaagaagggcactggg

SEQ ID NO: 75431 - DNA, 423 bp, Zea mays
  unsure at all n locations
  Clone ID: LIB3079-019-Q1-K1-E4
cttgccctggccttcgaaaagatttctgctgggtaaaacaaggagataaggactatgaagcgatgcagaaattgaaaaaccttgcaaagaggcaggaatctgagaacatggccctcatacagaaaatcttgaaagatgagaaggaactggcgactcggcagcaggaggtgcttgatggaaactgcaagaagtacgacatgctggaagctctagtgcagaagggagacatcactaaccttgctcaacaatacggagtgaacttgaacgactgatgagtcattcgtgtctttttcccccttccccttggagcgatggcgcaactggtgtgatgatgatggaataggatagcatgccatagttttggtcccgtatctggaccctccctctggtgtaaagactatcccaacttangcttgggctttt

SEQ ID NO: 75432 - DNA, 286 bp, Zea mays
  Clone ID: LIB3079-032-Q1-K1-F12
cccacgcgtccgcccacgcgtccgcccacgcgtccgctccgccaccaccacagccgttgccggggccgcgagcgaccgtagcgaggtgattgcaatggtggcctccactgcttcccgcctctcgcccccgcgcttcagcaccccttccccgtctcttcatcctccaaaccgccgctcgcgcttctcccctgttcgcgcagccaagttggaagctgtgctgtctattggtgctcatctaatcccacacccaagaaaggctgcaagtggcggagaagatgctttcttt

SEQ ID NO: 75433 - DNA, 410 bp, Zea mays
  unsure at all n locations
  Clone ID: LIB3079-032-Q1-K1-F2
acgcttgagaccaagtagcaacatacaaagcacaatactcgtccaacaatggcagccaaaatatttggcctacttatgctccttggtctttctgcatgcgctgattcagcgaccatcttcccgcaatgctcgcaagctactatagctttcattatttccccgaacctatcaccagccgcgtctaccgtatgtgaaaacccaattcttcaacactacaagatccaacaggcaatcgcagctggcatctcacctttatcacccttgctccttcaacaatcatcagccctattacaacaattaccttttgagcatttattggcacaaaacatcatggcacatcaactacaacaacgtgtgctagcaaacctagctgnctactctgagcatcagcaggttcattcattcaacca

SEQ ID NO: 75434 - DNA, 334 bp, Zea mays
  unsure at all n locations
  Clone ID: LIB3079-032-Q1-K1-F3
acgcgctgtcaccgtcactgtcacagctgccactgaatccatcgggcgtgttgatgctacatctgccgccactgtttctgaatctttacaagaaagctccaatactttccacgtcgaaacgacagcaacggaagccgcttaatttgccggtcatcacctcgggtctgtcgcccatggtggaaacatgcacgaaaacacggtggtagtagtagtagaatgctttctcttgtacatcgatttgtttttgtgaatattgcaaaatcggtttgtagaatccaatgtcatgttgaggcggccgttgatgcgccagagccctgctttggagctccgacng

SEQ ID NO: 75435 - DNA, 264 bp, Zea mays
  Clone ID: LIB3079-032-Q1-K1-F5
acgcgctggcaccgttactgtcacagctgccactgtatctatcgggcgtggcgatgctgcatatgggggcagcgtgttatgaatctttgcaagaaagctacaatactttccacgctgaagctgacagatgcgcgtggcaggtgaattggccggacatcacctcgggtctgtagtccatggtggaaacatgcactacaacacagaggtagcacaagcagaaagcggtctcttgtacatcgagatgacaatgtgaatattgcaaaa

SEQ ID NO: 75436 - DNA, 350 bp, Zea mays
  Clone ID: LIB3079-032-Q1-K1-F6
acgcccacgcgtccgcccacgcgtccgcccacgcgtacgaccacgcgtccgcgaaatccgaagaacaatcaccaaacttaagaatctcttatacattgacttatcaagcaacaatttcaatggtagcatacctgatggcctacctgatgatctggtcgaatttaatgtttcctacaactacctgtctggctctgttccaagtaatttactgaaattcccagattcatctttccatccagggaacgaattgctcgttcttgctcgctctgaatcattaaatggttctgacaaatcagatgaggcaagacacggctcgaagcgtgggattctatatgcattcgatatctgtg

SEQ ID NO: 75437 - DNA, 448 bp, Zea mays
  Clone ID: LIB3079-032-Q1-K1-F8
ctcgaaccacccagccctaatgggtcagcacttcttgaagcaggtcgctgcattggggattggcggcggagccagccagtccatctatgatggcggcttccagggcatcaatactgtcaccggcacaacttccgcccagcagcagcagcagctcatgtactactagagtactactactccatgaggcacccagctacctatcccttcaagaggaaggcgaggatgaatggatgatgccccttactatacccctatacatatagtagatgatgaagtcattactaggaccttttttccctaatctttttaagacccatctaagtaacatgtcctctctatgctagctatataattgtgtatttctggatacataaagccaaggttcttagtagtataatctttctgtgttgaccatcttttattgtgatgtatggattttcgttggcac

SEQ ID NO: 75438 - DNA, 318 bp, Zea mays
  Clone ID: LIB3079-032-Q1-K1-F9
ctgaatgaagcagccattctggctggaagacggggaaggacagcaatttcttcaaaagagatggatgattctattgacagaattgtagctggtatggaagggaccgtgatgacagacgggaagagcaaaagtcttgttgcttaccatgaagttgggcatgcaatttgcggaactttgacgcctggccatgatcctgtccaaaaggttaccttagttccaaggggtcaagctcgtggtcttacatggtttatcccgatggatgacccaacactcatctgcaggcagcaactttttgccagaattgttggcggccttggt

SEQ ID NO: 75439 - DNA, 275 bp, Zea mays
  Clone ID: LIB3079-032-Q1-K1-G1
gacgtacgcgtccggtctcgaacgccgacattgaagcctgttggccgtgctcaccccggctagcaggctacgcgccaggtctccaactttggttcactcatctggcactatactgacgctcgccatcgccagcgactaactaatcaccctcagtgaacatctcacgctggtcagatgatcgagggaatgacagtcccagaagcaccgatcaagtaggctatcgaacatatacagacacatttgcacgggaatgactatgaaggcatacacctatt

SEQ ID NO: 75440 - DNA, 209 bp, Zea mays
  Clone ID: LIB3079-032-Q1-K1-G10
gccaccttcgactaatcacacttcacgtacgccgcacgccccagccgggatccaaattaaagaacttcttcttctattaattacagtatattgtaatttggctgctggtacggtggtggcatgatttgagatgtgcatgatgatccttgtgtaattttattaccaagtctcttcttatatttacatgttcatttgcttgcttcttgcat

SEQ ID NO: 75441 - DNA, 107 bp, Zea mays
  Clone ID: LIB3079-032-Q1-K1-G12
gctttttggaaagatggaacttattttaaattgggattttctcaaaactagaccaaaagggaagggattaatgccatattaatcccctattggacacttgcccaatg

SEQ ID NO: 75442 - DNA, 410 bp, Zea mays
  Clone ID: LIB3079-032-Q1-K1-G4
acggtgatttgtctgaggatggtgattcagatattgatggctgccaaaatgtgaggaaagaagcgcgctctgctctaagtggacttcttaaggatgatgggattctggtgattccaactgctttggggtgccccccgaagcttaacgctaaggaactctcgtctgaaagctacaattctcagacactacgccttttgtctttagctagcatgtcagggtgttgccaggtttccattcctttgggtacacatgataagtgccccatttcagtttcgttgattgctaagcatggtggtgatcggtttttgttggacaccacacaaaccatgtatacaaccatgcaagagcaagtggagatactagcgaaatctagtgtttcaagtaaacaggcgatgaatgaagaagcagct

SEQ ID NO: 75443 - DNA, 371 bp, Zea mays
  Clone ID: LIB3079-032-Q1-K1-G5
gtctccaacgccgccattgaagcctgttgtccctgctcaccccggcgagcaggctacacgccaggtcgccgcctctggcgcactccgttggctctatcctgacgctcgccatcgccgttgagtaactcgtcaccctcaatgttcgcctcacgctcgccaggtgtttgagggaatggtggtaccaggagcagtgatcgtcttgcctattgtatttatacggaaacatttgcacggttttgtctatgtttgcatacacctattgtatgtatacttctaactgttggtatggaggtgacctgcaacttctcaaccaaggcgagcacagtcacccttgtgccacagcatgccctggactctaccaacaccgtgaa

SEQ ID NO: 75444 - DNA, 442 bp, Zea mays
  unsure at all n locations
  Clone ID: LIB3079-032-Q1-K1-G6
gtgatttgtctgaggatggtgattcagatattgatggctgccaaaatgtgaggaaagaagcgcgctctgctctaagtggacttcttaaggatgatgggattctggtgattccaactgctttggggtgccccccgaagcttaacgctaaggaactctcgtctgaaagctacaattctcagacactacgccttttgtctttagctagcatgtcagggtgttgccaggtttccattcctttgggtacacatgataagtgccccatttcagtttcgttgattgctaagcatggtggtgatcggtttttgttggacaccacacanaccatgtatacaaccatccaggagccagtggagatactagcgaaatctagtgtttcaagtaaacaggcgatgaatgaagaggcagctgaagctgctaaagagaaaggtaatgctgcatttaa

SEQ ID NO: 75445 - DNA, 442 bp, Zea mays
  Clone ID: LIB3079-032-Q1-K1-G8
gattcgtcactccaccctcgtcgcgccgccgtctgccgcgtccccggccagcctcgcagccccgtggtctgctagcggctagccacagcggagagaccaggagccatggtgatccctccaccagcaagggcagctagagtcacccgtttcctcaagccctacctgttgaggatgcatttctcaaacaagtatgtatctgctcaggtcgtccacaccccaacagcaactgttgcatgttctgcaagctcgcaggagaagctgttgagaccaaacatggagtcgacccgcgacgtcgcagcagctgcaaagattggaaagttgctcggcgagcgcctgctcctcaagggaatacctgcagtgtccatccacatgaagagagaacaaaagtaccatgggaaagtgaaaggccgtatagattcagtcagagaagctggagtcaaac

SEQ ID NO: 75446 - DNA, 256 bp, Zea mays
  unsure at all n locations
  Clone ID: LIB3079-032-Q1-K1-G9
gcgactctatgattcacggcggagattatgacaagggcaatggtaccggtgggaagagcatatgtggacgcaccttcaaagatgagaacttcaaattggttcacactgtgacctggagtgctcagcatggctaatgctgggccgaacaccaatggcagacagttctttatttgcactgtcaagacaccttggttggacggaaggcatgtcatgtntggtcaggtcctgtaagggatggatgtcgtaagtctgatcg

SEQ ID NO: 75447 - DNA, 218 bp, Zea mays
  Clone ID: LIB3079-032-Q1-K1-H1
ctacattctatggccaagttgtaatgctatccactcatccatatggttgtcgagttattcagagggttctagagcattgtgatgatcctaaaacacagcagataatgatggatgagattctgcagtctgtttgcttgctggctcaggaccagtatggcaactatgttgttcagcatgttctggaacatggcaaaccccatgagagatcagctattatt

SEQ ID NO: 75448 - DNA, 304 bp, Zea mays
  Clone ID: LIB3079-032-Q1-K1-F11
tggaaaacatggtactgttggatagttatgaaaatgaaatagtgttaaatggttaggttgcctgggttgttaatggaaatggggttgacttggtcagaaaatgcctaagttgctatgaacttatttctgttgcatgccatgctttctttcatggcactaagaaagctgatgagtataaccagatttttcagcacaacaaatgataggagaagctatatatcaagcgtccaacaattttttgagggcttggaaaatatcaatctctggacatttaatggaccaggttaattgggattatccaacc

SEQ ID NO: 75449 - DNA, 342 bp, Zea mays
  Clone ID: LIB3079-032-Q1-K1-H10
tcgggctttcctgtggttgacgataactgggacttgggttggggttgtatcaaaatatgatctcctggctttggattcaatgtcaggaaatgaattggccgatccaagtacaaacatgtttcctgatgtggatagcacatggaagacattccacgagctacagaggatattaagcaaaactaatgggaaggtaattggtgatgtaatgacctcttcacctttagcggtgcgtataaatactaatccttgatgctgctacaagggtgctacttgaaactaaataccggagactaccttgtagtgatagcatggggaaactagttgggatgattacaaggggaa

SEQ ID NO: 75450 - DNA, 258 bp, Zea mays
  Clone ID: LIB3079-032-Q1-K1-H11
gtcagttcagcggcggttgaactggccctgatgaagcttccgaagtctgaagcactgtcagctaggatgcttctgattggtgctggtaaaatgggaaagctagtgatcaaacatctggttgccaaaggatgcaagaaggttgttgaggtgaaccgctccgtggaaagggtggatgctattcgtgaggagatgaaagatatagagatcgtgtacaggcctgtctcagacatgtatcaagctgctgcttaagctgatgtc

SEQ ID NO: 75451 - DNA, 333 bp, Zea mays
  Clone ID: LIB3079-032-Q1-K1-H12
cccacgcgtccgcgcacttcgacgccggcgacgagcgcgccaaggagttctcgggcctgctcaagtccaacgaccccgtgggcttcaacctcgtcgacgtcctcgcctggggctcgctcggccacatcgtcgcctactacatcctcgccacctccagcaacggatacgaccccaacttcttctgagcggccggctgcgggcatgttcttgagcctgcctgtattctactccgtgtgtgttgagccatatatctgatgctcaaggattggttaatttgaacaagtggtgcaactgcgcgtgtacatggatttgctcttcctctatgtctctgtc

SEQ ID NO: 75452 - DNA, 316 bp, Zea mays
  unsure at all n locations
  Clone ID: LIB3079-032-Q1-K1-D4
acggccgggactcgtcgggacgcgccgacagcttcacctcttacgaggccgacggcaacgtcgtgaccgccaacttcacctgctacgccggcggcgccacgggtggttcgggctccttcgccgcctacgccgacgagaccaacgtcccggactccaccttcaccaactacgacgccgncgccaacggccgcggccggagcttcgcgtcctactcccaggaggcgaaccatggggagaacggcttctccggctacggcaagaacggcaacggcgtgcgcgagacgttcaagtcctacggcaatgagtccaacgtgct

SEQ ID NO: 75453 - DNA, 458 bp, Zea mays
  Clone ID: LIB3079-032-Q1-K1-D5
acggcagattggttgcctgtgcagttcccttgtttgataaatactagtcatgctgttggaccaagggaaatgacttcacacttttttattgattctgatctgatgcatccttagtgtagcactttagaaggttcattaggctgtaatatttttgcatgcctcaagaaaatcacttttctatctagagaattaggtttaggtaaagacatttttttatcttcgaccatcatgtcaagaatagtggtattttagaaagcatgtcgtcaatatgttgataccatttttttttataaaaagtgatgtagcatgtcgtatatttgtaaaaaaaagaacatttgcataatactccctccattttttttatttgacgttttgcagttcatttgtacattagttggcgtcaaataaaaaaggatggaggtagtacaatatactacaattgaaactaatatcttgaa

SEQ ID NO: 75454 - DNA, 320 bp, Zea mays
  unsure at all n locations
  Clone ID: LIB3079-032-Q1-K1-D6
caattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgacggcgccgctcttcgagcccggggagctcaagtcctggtccttctaccgcgccggcatcgccgagttcgtcgccaccttcctcttcctctacatctccatcctcaccgtcatgggcgtctccaagtccacctncaagtgcgcca

SEQ ID NO: 75455 - DNA, 425 bp, Zea mays
  unsure at all n locations
  Clone ID: LIB3079-032-Q1-K1-D7
acgcccacgcgtacgggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgncaacatggaccgaaacgtctatgagc

SEQ ID NO: 75456 - DNA, 464 bp, Zea mays
  Clone ID: LIB3079-032-Q1-K1-D9
cccacgcgtccgattttgatgtggagctcacttacaattatggtgtggagagctataacatggggactggttttggccactttggaattgctgttgaggatgttgcaaaaacagtggaacttattaaagcataaggaggaacagtcacaatggagccaggccctgtcaaaggtgggaaatcagtaattgcctttattgaagatcctgatggttacaagtttgagcttatagaaagagggcctactaccgagccttagtgccacgtaatgcttcgagtgggagatcttgatcgtgctataaatctctatgagaaggcatttggcatggaacttcttcgcaagcgagacaattctgagtacaagtatacgattgctatgatgggatatggtacaaaagacaaaaatggctgattggagttgacctacaactaatgggtgaaggaatatgataagggaaatgcttat

SEQ ID NO: 75457 - DNA, 292 bp, Zea mays
  Clone ID: LIB3079-032-Q1-K1-E10
cccacgcgtccgcccacgcgtccgctatctaccagtggaatagaaacgatgatgggaatcctggtccagcagacaccgtgatgttccataaccagtattggacgagcagcacgcgccgcaggaggctgaagaagaaccatctccatctcgaggaccttgaggatttgatctccctattatagaaaaccgggttcgcaggacgcatgaactgtgtgtgggggaataatcgcaggttagcactgttgctagtgtgcccgcctctcttggaatggaagcagcagagccagctatc

SEQ ID NO: 75458 - DNA, 244 bp, Zea mays
  Clone ID: LIB3079-032-Q1-K1-E11
tggcaaagccgttgccttgctagacactgaagctcatcttatcatggtgaacgaggattggctcgtagttacatggatctccatatcagtcctgtttatggacggcgatggctgtacgaaacttggcggcggtgccatggttcagaaaggtacattgtttggatccgacactagcatggtgctagagacacagaccgtcggagcaggtagcgtggcatccaatctagcacaatgtggcacttgc

SEQ ID NO: 75459 - DNA, 374 bp, Zea mays
  unsure at all n locations
  Clone ID: LIB3079-032-Q1-K1-E12
gacccacgcgtccgcccacgcgtccgcccacgcgtccgcgctcacgcaggacgacgatggacggacaactgtgaatgtccgtatcactggacttacccctggacttcatggcttccacctccacgagtttggtgatactaccaatgggtgcatatcgacaggaccacattttaatccaaacaatctgacacacggtgcaccagaagacgaagtccgtcatgcgggtgacctgngaaacattgttgcaaatgctgagggcatagccgaggcaaccattgttgatacccagattcctttgactggccccaaatcagttgttgngagagcgtttgtgggtcatgagcttgaagnatgatttgggaaagggggccatg

SEQ ID NO: 75460 - DNA, 296 bp, Zea mays
  Clone ID: LIB3079-032-Q1-K1-E2
acgggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccc

SEQ ID NO: 75461 - DNA, 386 bp, Zea mays
  unsure at all n locations
  Clone ID: LIB3079-032-Q1-K1-E3
acgcccggtccagctccgcagcaccggccgcctcagcttctgctgcttccccagcagcgcatcggggacagcccccagtcggcggcgattcgggcggtgacggtgagggcgtccgcggagacgatggcgacggagaagctgggtatcaaggtggagcgcaacccgccagagtcccgcctctccgagctcggcgtccgccagtggcccacgtaagcgagctacccgccctcctccctcctcccgggcgtctcggtctctgttctcgcccgcggtcctacgctgctacactgcgcccgtgccctgacggcgaatccgcgctggtgaatgaatggatgggtccgtccatcaggtggnggtgcgagaagagcaagttcccgtggacctac

SEQ ID NO: 75462 - DNA, 402 bp, Zea mays
  unsure at all n locations
  Clone ID: LIB3079-032-Q1-K1-E5
gcgttagttttttagcaccggtcgtctcatcttttgctgcttttcagcatcgcatttgggacagtgtttattctgtggcgattctggcggtgactgtgagggcgttcgctgagacgatggcgacggataagctgggtatcaaggtggagcgcaacccgccagagtcccgcctctccgagctcggcgtccgccagtggcccacgtaagcgagctacccgtcctccttcctcctcccgggcgtctcggtctctgttctcgcccgcggtcctacgctgctacactgcgcccgtgccctgacggcgaatccgcgctggtgaatgaatggatgggtccgttcatcangtggnggtgcgagaagagcaagttcccgtggacctactccgcaaggagacctgctacctg

SEQ ID NO: 75463 - DNA, 361 bp, Zea mays
  Clone ID: LIB3079-032-Q1-K1-E6
cgacaagatctagggggggttccctacggttgggtatcaggaagattgtaaaccgcggtaacgtgcgtcatgcggaactgctgccttgccccccgcgcctttctcttccatgtttgctgctacaatcttgttgttgggcattgcagtgcacggtgcacacttgtgtagcccgcctcgagaattcctgcctctgcatctggtcagttctaaaatgatttgcatgttggctatgttgtgtaagctctatttatggtggtctcgctgagacgggtatttggcttcgcagttatctagctatgtgatgtactgttgtcttgtccctgggtattatatggtacactgcagccagtaatagtaaaaa

SEQ ID NO: 75464 - DNA, 395 bp, Zea mays
  Clone ID: LIB3079-032-Q1-K1-E7
gtcacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgactctacgtcgacgccgccgaccccgccggccgcaccgtgccctacgtcgccgtcgtgtacgagcaggtctggaccc

SEQ ID NO: 75465 - DNA, 395 bp, Zea mays
  unsure at all n locations
  Clone ID: LIB3079-032-Q1-K1-E8
gccacgcgtccgggcatcaagaagctgcaaatcatgatgaccattgtcgatgaccttgtctcggttgacactctcatcgaggaccatctctgcgctgagccagtgagcgaatacgtccagagctgcgacattgtcgccttcaacaagatctaaatttccttgtgatggtggcaatggtggttggtgggcactgtaccagcctaatttataatgttccatgagcatcttcaagagttactctaaattatcatttggagtcatttacataaaaagcactttctatatctttttaatctcaacaacttttctatatcttgcttgcaccctggagagctatttacgttttctatctctagctagcgagaaacctgnatggctggaatagaagatcacta

SEQ ID NO: 75466 - DNA, 448 bp, Zea mays
  unsure at all n locations
  Clone ID: LIB3079-032-Q1-K1-E9
cggcaacctaccgttcagcgtcgacagcgcgcagctcgcagggctcttcgagcaggccggctgcgtcgagatggtcgaggttgtatatgacagaatgactggacggagccgaggatttggattcgtgacaatgtcttcggccgaagaagccgaagctgctgtcgagcagttcaacggttatgcatttcaaggaagacaactgagggtgaactgcgggccaccgccacctagagatgaatccacaccaagagcaccaaggngtggtggtggcggcggcggcggcggctatgtcgattcagctaacaaggtctacgtggggaaccttgcgtggggcgttgacaactcgactctggagaacctgttcagtgagcaagggcaagtgcttgatgctaaggtcatctacgacagggatagcggcaggtcaagggggtttggtttcgtcacctat

SEQ ID NO: 75467 - DNA, 241 bp, Zea mays
  Clone ID: LIB3079-032-Q1-K1-F1
aaaaagagcagcgcggacagtccggccctgatgccggttaggccggacgatccgcggtccggacagtccgcggtgatggctcggacggtctgcgcgtgcgcagagtcagttaggatttctagtttctcgcgggatttgttacctaaaaccgcgggattaactcggaaatctgttggaagcggatccagacctcccctttatatcgatgaagggctacggccgattgtactccctaacaaaa

SEQ ID NO: 75468 - DNA, 355 bp, Zea mays
  Clone ID: LIB3079-032-Q1-K1-D3
acgcccacgcgtccgtccacgcgtgcggatattctttatctgatctatactacaacagctgatggagcaagggaaatgacttcacacttttttattgattctgaatctgatgcatccttagtgtagcactttagaaggttcattaagctgggatattcttgcatgcctcacgaaaatcacttttctatctagagaattaggtttaggtaaagacattaccttatcttcgaccatcatgtcaagaatagcagcattttagatagcatatcctcgatatgtcgataccattttgttttataaaaagtgatgtttcatgtcgtatatttgttaacaaaagaacatttgcataatactc

SEQ ID NO: 75469 - DNA, 286 bp, Zea mays
  unsure at all n locations
  Clone ID: LIB3079-032-Q1-K1-B8
acgcgaggacatgtacaaggaagagaccggagacatcgagcaagactccaactcctcctccgacaacgcgccagcaggaagcaaggccaagacggcgtcttcgcgagacaaggaggaccacctggcgagaagctgctgcacgccgcgggccgtctgcgagagcagcagccagctgagcgagccaccaggaggagccagcatgagggccatgagcgtcgccgtcgncgccgctggagcgcccatggggttattccagaacgagcctggccacgaccacgaccacgac

SEQ ID NO: 75470 - DNA, 440 bp, Zea mays
  unsure at all n locations
  Clone ID: LIB3079-032-Q1-K1-B9
cccacgcgtccgcgctagtggcggcagggatgggtcaccggaggtgcctcgggagtggttgcggaagctgtgggtagacgagctgaagaagcagaaggaagccgcgaggagatggggcgtcggctcatcattagaggttgcaggagcgaccgaggaggcaccgtcaaggagctatcagtacgaatacagcggctctaaccccgtggaggccaaactggctccgcttcttgcaagagctaacctcgtcattgccagggatattgagtgggcaaacatcatgtttgcttttgagcaggagagcaggtatatcataatggacccactctttccacaatctccagtaggttttattcgagagaaaagcancatcatctttagacagttactcagaacaagacggccatttgttgcagaaataactgatgctatgggtaacgaga

SEQ ID NO: 75471 - DNA, 415 bp, Zea mays
  Clone ID: LIB3079-032-Q1-K1-C1
acgcccacgcgtccgcccacgcgtccgcccacgcgttcgatagtgcagcagagctaagagaggaaggcgaaaaagctcgggttgaactagcagaagccgaacaaaagatgcaattggctttaaaggaagcagaagaggctaaagcagctgaagcaagagcccttgatcagatcaagcaactctcggatagagcaagtgctgctagatcctcaacatccgagtctggagcaattatcacaatttctaaagaggagtttgtatctctcagccgaaaggttgaggagtcagagaagttgagtgatatgaaagttgctgctgctatggctcaagtggaagccatcagagccagtgagaatgaggcaatcaagaaactagaaacttgccgcaggaaatggatgacatggaattgcaacag

SEQ ID NO: 75472 - DNA, 262 bp, Zea mays
  unsure at all n locations
  Clone ID: LIB3079-032-Q1-K1-C10
ggtcactatagatgtcgcaagtcctgaggctggtgttattgaaaagctcattgctagtgaaggcgacacagttactccaggcactaaagttgcaatcatatccaagtctgctcaacctgctgaaacacatgttgctccatcagaggaagcaacttcaaaagaatcatctccaccaaaagttgaagataaaccaaaggtagaggaaaaagccccaaaagtagatcctcccaagatgcaagcaccaaagccaactgcanccatc

SEQ ID NO: 75473 - DNA, 353 bp, Zea mays
  Clone ID: LIB3079-032-Q1-K1-C11
aagaccaagtcgtggaagaagctagtgaatgttgctgtgtcaggcgcggccgggatgatatcaggtcacctgctggtcaaactcgcttctggtgaggttttcggacaagaccaaccaatagcacttaagctactcggctcagaaagatcgtttcaggccctcgaaggtgtagctatggaactggaggactcgctcgatccactgctgagggaagtcagcattggcatagatccttacgtagtctttcaagatgtagattgagcccttcttattggcgctaagccccgaagtcccggcatggagcgagctgcgctactggatatcaatggccaaatctttgctgaccaggggaa

SEQ ID NO: 75474 - DNA, 448 bp, Zea mays
  unsure at all n locations
  Clone ID: LIB3079-032-Q1-K1-C12
cgcaaatgccattgtcgcaggttctgcagtttttggggctccagactacgctgaagctatcagaggaataaagaccagccaaagacctctagctgtagccgcataaagagctggacgtgtaatcatttactctgtgcaagtttaccagtgatgcgatctgtatagatgtgtgtcttgtccagctatacgtataccggagatgaaaggagacggaggcagtgaagaaatatcctttattttcttctcatttttcacgaggatgccgtgcactgctcccagaatgctngtgtccaattacaaacgcacaggtggcacatgaactaacaaagtagctcttttttgaaaggaaacggaattgggggtcgatgaaccttctggtgttattcttcagactggtaaacgatgtaacatggttgataatcaataaagtccgtcggatggttttcct

SEQ ID NO: 75475 - DNA, 316 bp, Zea mays
  Clone ID: LIB3079-032-Q1-K1-C2
cccacgcgtccgcccacgcgtccgaataaaacttagaactacaaatactactacaacaacgcaccgagaaagaaacaaggccaagacagcgtattcacgagacaaggaggaccacctggcgagaagctgctgcacgccgcgggccgtctgcgagagcagcagccagctgagcgagccaccaggaggagccagcatgagggccatgagcgtcgccgccgccgtcgctggagcgcccatggggttattccagaacgagcctggccacgaacactaccacgacgacagcttcatgagcctgatgctcaaggagcaacga

SEQ ID NO: 75476 - DNA, 369 bp, Zea mays
  Clone ID: LIB3079-032-Q1-K1-C3
acgcccacgcgtccgaaaaaaaaaaaaaaaaaaattataattttaaaaaaaaataaaaataaaaagagataaaaataaggcaacacacatatcgtgcgcacaagcttaaaaaggcggaccagttcaacgataacgaccttatggagagcgtgactcgtagctccttgttcaacttggttgtacatttaagtatagtgcgcaaaacacctttcgtttccaccatgttctccagctacatgcaatacatcttcggctggatcctcttcttcggaataccctgtatcgtcatcgtcttctcaatcgttctgttcctgctcgggaccatttcataccgcttgtacacgaccgttgcggacagccccttctctt

SEQ ID NO: 75477 - DNA, 294 bp, Zea mays
  Clone ID: LIB3079-032-Q1-K1-C4
tcgaaaatagcgtctgatttactggctaacccagttcaagttaacattggaaacactgatcagctggttgcaaataagtcaattacacagcatgtggaagttatcccacatatggagaaatcaagacgacttgatcagatcttgcgctcacaagatcctggatcaaaaagcataatattttgctccactaagaggatgtgtgatcagttagctcgaaacctatcacggcagtatcgtgcttctgctattcatggtgataaatcacaggctgagagggattctgtgttgaatgac

SEQ ID NO: 75478 - DNA, 326 bp, Zea mays
  Clone ID: LIB3079-032-Q1-K1-C5
acgccggcgctgcgcggcggccacgtggccatcttctacgtggcgctgtacctggtggccgtcggcgagggcgcgcacaagccgtgcgcgcaggcgttcgcggcggaccagttcgacgagaaggaccccagggagagcgtggcgcggagctccttcttcaactggtggtacttcggcatgtgcgccggcaccgccgtcaccaccatggtctccagctacgtgcaggacaacgtcggctggggcctcggcttcggcatcccctgcatcgtcatcgtcgcctcgctcgccctgttcctgctcgggaccaggtcgtaccggttctacac

SEQ ID NO: 75479 - DNA, 171 bp, Zea mays
  Clone ID: LIB3079-032-Q1-K1-C6
catgccctaggaccagggtgtacttcacgctgtctcacaggacctcgaactgggcctacgatccctgcacctgaagacgaaccggtatcaggatgtggtcacaaggaggagcctctatacgaggccgacgtcgctcggaggcgcgcctatgttgtcaactgccgaggcacc

SEQ ID NO: 75480 - DNA, 382 bp, Zea mays
  unsure at all n locations
  Clone ID: LIB3079-032-Q1-K1-C7
acgcccacgcgtccgggacaggtggccctggaaattcttattctcaccggggctatgggagagattgattatagcagaaatgtgcaggcaaccatacttgtgggtgttgtagtcttttaccacatgtatgatgtatcccttactactggtgcagcggtgagaagtcgttttcccactgagccgagccaaaggtttaatgggctctaaattttacactataagatttaaggattggattaggatcggactctatttctattcatttttaactaaaatttatttagggccctaccattctgtgaagaatcatttggatcctaaaaaaaaaaaaanaaaaaaaaaaaaaaataaaaaataaaaaaaaaaaaaaaagggcggccgt

SEQ ID NO: 75481 - DNA, 317 bp, Zea mays
  Clone ID: LIB3079-032-Q1-K1-C8
cccacgcgtccggccaaacacacgcgaaaagaatgagttcgagtacaggttacagagaggcagagagcaaagatgtgtggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgagggggtggtggagagcaagccccgccttcgtcgtccgcgcctcgtccgcggcgacgcagcccagggcgcgccaggagcagcgga

SEQ ID NO: 75482 - DNA, 277 bp, Zea mays
  Clone ID: LIB3079-032-Q1-K1-C9
gcaggaggaagtctgtccgtggttgcatcgtgagccaagacctatctgatatcaacttggtgagggtcaagaagggtgagaatgatctgcctggtctgactgacactgacaagccaaagatgaggggtcccaatagggcctccaagatcagaaagctgttcaaccttaacaaggatgatgatgtacgcaagtacgtgaacacataccgcatgacattcactaccaagaacggtacgactgtcagcacggcacctaagatccaacggcttgtgacacc

SEQ ID NO: 75483 - DNA, 419 bp, Zea mays
  Clone ID: LIB3079-032-Q1-K1-D1
acctacgcgtacggctgattggttgcctgtgcagttcctttgttttataaatactagtcatgctgttggggcaagggaaatgacttcacacttttttattgattctgatctgatgcatccttagtgtagcactttagaaggttcattaggctgtaatatttttgcatgcctcaagaaaatcacttttctatctagagaattaggtttaggtaaagacatttttttatcttcgaccatcatgtcaagaatagtggtattttagaaagcatgtcgtcaatatgttgataccatttttttttataaaaagtgatgtagcatgtcgtatatttgtaaaaaaaagaacatttgcataatactccctccatttttttatttgacgttttgcagttcatttgtccataagctggcgtcaaataaaa

SEQ ID NO: 75484 - DNA, 280 bp, Zea mays
  Clone ID: LIB3079-032-Q1-K1-D10
cggacgcgtgggcggacgcgtgggcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtccaggttggcaaggaaccgc

SEQ ID NO: 75485 - DNA, 223 bp, Zea mays
  Clone ID: LIB3079-032-Q1-K1-D11
cgtaaacgcccaccagtacaaccgcgacgagcccatcatcagcaacgcctcctgcaccaccaagtgcctcgcgccattcgtcaaggtgctcgaccaaaagttcggcatcatcaagggcaccatgaccaccacccactcctacaccggcgaccagaggctgctggacgcgagccaccgcgacctgcgccgcgcccgcgccgtcgcgctcaacatcgtgcccacg

SEQ ID NO: 75486 - DNA, 276 bp, Zea mays
  Clone ID: LIB3079-032-Q1-K1-D12
ctctctttgggctgtcagtgacagatcgtttggtggattaagctttactaccacagatgtgggcaatgtccttgcgatgtcaggtctcttcctttttctatatcaaatgttgatctatccgttccttgccaaaacggtagaccacatcacattagtccgtgcagtggcgttattgactctaccggttcttgctagctacccattctttccttcgttgtccgggttcgggctcatggtggtagtaaattgtgcatcttttctgaagaatacattctc

SEQ ID NO: 75487 - DNA, 385 bp, Zea mays
  Clone ID: LIB3079-032-Q1-K1-B7
gaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggttactccaaaaacattggctgatgttaaaggcggtactctcatctcttacgaaggaagagttccagcttttggagattgcccaagttcctgatgagcatttgaatgagttt

SEQ ID NO: 75488 - DNA, 365 bp, Zea mays
  unsure at all n locations
  Clone ID: LIB3079-032-Q1-K1-D2
caattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctncaagtgcgccaccgtcggcatccagggcatcgnctggtccttcggcggcatgatct

SEQ ID NO: 75489 - DNA, 181 bp, Zea mays
  Clone ID: LIB3079-018-Q1-K1-E9
cccacgcgtccggttctagatcgcgagcggctgcccttttttttttttttggtttttttttttttttttttttttttttttttttttttttttttttttttttttaaaaaaaaaaaaaaaagggagcactttttaaaagataaaagcttaggaacacccaaattaaacagcttggtttttt

SEQ ID NO: 75490 - DNA, 287 bp, Zea mays
  unsure at all n locations
  Clone ID: LIB3079-018-Q1-K1-F1
ggacctttgggctgatttatgtgcttgttgtatgtgttgtggatgtgngggtattnngnntaattaagttngttgtagggtacagggtgggctgaagaatgatgagaacttgnggaagggagggtggaggagaaggaagaagaggggatgagggtgaacttgttggagagaaggggagtganggtgaggtcggtggcggttgtgagggtgcctcttgtcgtggttactggtggtggtgcgcttccggcgtaaggggtgccttggggggactggttcagagcctgcgt

SEQ ID NO: 75491 - DNA, 416 bp, Zea mays
  Clone ID: LIB3079-018-Q1-K1-F10
gccgttccaggttctgatggtgataggcatgctttacctgcttcgacatcgccggtggggcagcaggatgccctccgtgcctttcaacttctacagaagactgcctgccaggtccgatatgctcctttgagatcacagtattcggcgtgagagaatcgggtgcaagtctttacttatttatgtctgttctgctcggatccttctgattagtatcagatcagatgtgaatataccagatgagttcgtatattagacgtcatttagtgtcccatgaataaggcgttggcttaatggttcatatccttctgagtctctgggatagtgaggggaggctcttgggtgcagaaatgtaatgttaactacgggctattagcatagaactaatggcaggaacaatattatccctcgtgtattat

SEQ ID NO: 75492 - DNA, 396 bp, Zea mays
  Clone ID: LIB3079-018-Q1-K1-F11
aggtccccgtcgcctccgctcaactgccgccgcagggcccgctgcaggcttgcatgtggggtagggcccggtgtaccctcagcccggccgaggttgccagggccttcggcttccccaccacctccgccaacgcgggcggcggtggagacggccccgctgtgccgacgctccatcttaaccgtttccggccgtcgtacaatgtgttgcctggggcgtacctgcctgtgggcgccatgcgggcactaccaggttgcgcccacggaggaggaggttcggatggggaggggccggtgatccagtgcatgaagtgggggctggtgcccagcttcaccggcaaggccgagaaacccgactatttcaggatgttcaatgccagatcagagtccgtaaaagaaa

SEQ ID NO: 75493 - DNA, 194 bp, Zea mays
  Clone ID: LIB3079-018-Q1-K1-F12
gaggccacatcttcaagacaccatctaaaaatgtctcatttattccaaagtttcttgatgaccgtgaatttttggaggtggagactccgatgatgaacatgattgcttgtggagcaacttcaaggcctcttgttacacattacaatgaatttaacattcggctttttatgcgcattgctccttaattatatctt

SEQ ID NO: 75494 - DNA, 334 bp, Zea mays
  Clone ID: LIB3079-018-Q1-K1-F2
tggaactttgggctgatttagtgcttgaaatataagcagggccaggaaggtggtggttagtggtgagagtgtgagaggaagagtaggaggaggggctggttacgatggggaaggtgaagttgaagaagtatatggtgaaggagactgttgtgaagactgatgtggtgatgatgaattggggtggtggtaaggttgggtaggtggattggtcggggtaggataagggtgggtacgtgaagtcggtgcgtttgtctcgttgtattttggtgtttgatactaagcttacgtagacttattatgaggtgtgttattttaagtcttttcctgagttgga

SEQ ID NO: 75495 - DNA, 385 bp, Zea mays
  Clone ID: LIB3079-018-Q1-K1-F3
ggacctttgggctgatttatgtgcttgtttatgtgcttgtttatgtgcttgacggtacttactaagaccgcaggggcgttcgcggctcctacttctgttccgtcttccgcccttggccacgcggaggtggaaactcgtgtaaggttcaacttccaccacttcggtgtacgtaggagtaacaaggatcgcgtaggtctgcgtacctagtaaaattctggtattagtgggcatcgtaagggtagcgctttttcccctaaactacgtcaccgcattcccgaacgctttacggaagatgaggtagaggagggacggtatcagctgcgagttgttactcgtacgatcaaacctaaagcactcgagcgcccacgtaaccgattcgcggaac

SEQ ID NO: 75496 - DNA, 282 bp, Zea mays
  unsure at all n locations
  Clone ID: LIB3079-018-Q1-K1-F4
ggaactttgggctgatttatgtgcttggtctgttgnggaacgtattgatgattggntggattggtggttctggacggttgaggcggcggtgaggactgaggctactgcttggagtgtggagtcgaaagtgaaggttgatatggaggacgatgatccttacagtactctctttcaattcgttagtgtggctgcctctcgcggccacccctagactccgggcgtataccgcgtggtgacgcatacgcctgcaataccagctgcctcctaccaccctctcgaaaa

SEQ ID NO: 75497 - DNA, 451 bp, Zea mays
  unsure at all n locations
  Clone ID: LIB3079-018-Q1-K1-F7
cttggcttgngacctttgggctgatttatgtgcttgtggatgtgcgggtggatgtgcgggtggcgtttattctttcttgtaggttgcgcatatgaatgtgctttggctgcatatgcttgcttctgagcttcttactaagaattcgtcgcctgcgatgttggtgattttgatgttagctgttactgcggtggttagtaatgtgctttatgcttaggttgttgcgtgtcgtggtgtttgttatggtgctggtgcgtgtttgtgtagtggtggttatgatcatgagggttcgcttcattgtctttctagtgtgaggtggtttcctgttgctgctgattcggttaggtcttgtgttgctagtgctgatgtgaggaattggatggtgcgggctgggctgggtgttatttccggtgagtctcatcatgttactgtgagttgtaatgtgtgttcgggg

SEQ ID NO: 75498 - DNA, 436 bp, Zea mays
  Clone ID: LIB3079-018-Q1-K1-F8
ggcttggaacctttgggctgatttatgtgcttgtaatttcataggacttaataggtaactgtagtcggtactccattcccactatttccggcttcttaataactactagtttcaccatagtagccattcccggcgtacccaccggtataaaatactagggtataataatcataataatccgcgtcagtaaattccgtcgttcatctctagtaatagtagccctccttacctaattaatcagtcgtaccgaatctcgtcctccacccgtaataataataatcattacctagttagtcactcgtcgttcatttttagtaaccctccttacctaattaatcgatagtaccgaatctcttcgtccacccatagtagtaataatcatcattacctagttagtcagtcggcgcgagtttcgtcattcctccgatataattat

SEQ ID NO: 75499 - DNA, 359 bp, Zea mays
  unsure at all n locations
  Clone ID: LIB3079-018-Q1-K1-G1
ggacctttgggctgatttatgtgcttgtagtacntaaaaatatattaagtgaagtgtatcagtaatgattcaatattaacggtcgttaaggcaccagtttcttccgtgtcctccgtttccccagcgagtgtaataaacgtgcctaccaccttatagagtctatccgtcttcagcgttagcaccttatagccttctttattagccatcctaacgggtcctgaatacttagttgcgtaagttcataggtcataatcagtgtccgtggtgagtgttccataataattaaccgtttaaccgtaataataacttccggtatactcaatttcataaattaccgtaatgtaataataataataata

SEQ ID NO: 75500 - DNA, 428 bp, Zea mays
  unsure at all n locations
  Clone ID: LIB3079-018-Q1-K1-G10
cccacgcgtccgcccacgcgtccgcccacgcgtccgcacaaacccatcgcagggcatgctcnagcatagcttctctgcctctctctcccctcctctcctctcgtccactcctttgtccaaagcttcgagatggctcagcagcagaaggtggtggtcagggttccaaccatgacagatgacaagatcaagcagaaggccatcgaagctgttgcggacatttacggtattgactccatagcagcggatctgaaagagaacaagatgaccatcataggcgagatggatgcagtagcgattgccaagaagttaaagaagattggaaagattgacattgtgtctgttggacctgcaaaagaagaaaagaaggaagaaaagaaagaagagaaaaaagaggaaaagaaagaagagaagaaagaggagaagaaaga

SEQ ID NO: 75501 - DNA, 348 bp, Zea mays
  unsure at all n locations
  Clone ID: LIB3079-018-Q1-K1-G11
cacacaaatacagctcagagcaactcacacacaggctcctctcccccgttgcgcaacgggctttcccccacttcacccgcctcggcgccatggctaagctcgcgctggcgctcctcctcctgctggccgtggcggcgtccgcgtcggccagcagcgggagccacctggatctcgacctgggcttcctctcctctggggaacgccggagggagtgccgcggcacggtggccgagtgcctcgccgaagagtcggatgaggagggccttgacctggctggatcccaccgncgcgcgctctacggcggcgggtacatcagctacggcgcgctgcggcgggacaacgtgccct

SEQ ID NO: 75502 - DNA, 375 bp, Zea mays
  unsure at all n locations
  Clone ID: LIB3079-018-Q1-K1-G12
gggaagggggtctgggttgcgtacaggcgaaaggcacgcgccgccgctgccgcgcgagcctctccgtccccatcgccgcgcagatggatccgtcgtcggagcccctgtacgcgcaggtcgagccgtacgactccgggttcctcaaggtctccgatgtccacaccatctactacgagcagtccgggaacccgcagggccatgcggcggtgtttctccacggcggtcccggagccggcacgtcgcccggcaacaggaggttctttgacccgcagttctacaggatcgttctgtttgaccagaggggtgcangcagaagcactccccatgcttgtttagagcagaacactacttgggacttggtagctgacattgaga

SEQ ID NO: 75503 - DNA, 132 bp, Zea mays
  Clone ID: LIB3079-018-Q1-K1-G3
tggaactttgggctgatttatgtgcttgtttatgtgcgtgtttatgtgcttgaaaaaaaaaaaaaaaaaaaaaaaaaaaaaagaagagaaggggaaaaaaaaaaaaagaagaagaaaaaaaaaaaaagaaaa

SEQ ID NO: 75504 - DNA, 374 bp, Zea mays
  Clone ID: LIB3079-018-Q1-K1-G4
ggacctttgggctgatttatgtgcttggcttgtcctccgaggagcgcggcccgcaccgtaatcaggacgctagcgtactagtcgttttagctcgtacacgtccgaagcacacccctcggcgcccgcttttacacctagcgctcgcagacaagagatacgaaacgctttaagccctccccgacttacggcgaattcatccaacactcgagagacacatcgggggaaaacggaggtcgtggtaacttccgcgtagccgggttgcggaacatagtacacgtaagcgcccgaccgcgtaatacctcccaccatccggctgtaacacagacgggtcgagttgaatagtaaggcaccccgacctcgtatcgtctttgcgc

SEQ ID NO: 75505 - DNA, 432 bp, Zea mays
  Clone ID: LIB3079-018-Q1-K1-G5
tggctttggacctttgggctgatttatgtgcttggctgtctctgtctctagatgatcgggttgttgttgtccggcgtcgaggtccctgccggctctcctggtggtgatgagtatttattagtagcctcgcagaaacggtcgacggcgaggatacttagttctccgctcgtgataacggtattggaacggctaaggtcggccccgtcggggatgacgtattaagggtggcccctttcagtaccgccggttgcttctgttatatcggcgctacggcagggacgggatagaaggacgtacacgccggtgacgaggtatagcttaagagaggcacctctatgtctaagcatttgaccgagtatggcaccgcgagtaatcgggacgatacggagaaaactcggtactacatccctcataatgagtcctgcgccgtat

SEQ ID NO: 75506 - DNA, 127 bp, Zea mays
  Clone ID: LIB3079-018-Q1-K1-E8
tgcttggacctttgggctgatttatgtgcttgagatactgttgacttccaggctacgctaagtcactccccgacgacctaccggccgagcgtccgtgcgacgacaacaacgggaacgccgtccggac

SEQ ID NO: 75507 - DNA, 308 bp, Zea mays
  Clone ID: LIB3079-018-Q1-K1-D11
gtggcagatttgcatgatacgtttgtttgtttccatcggacctgaagtcttcttggggataggctcccccctttgtatgttgtggctccaatccatgtgcgagcacgctgtgtctgtcgtgacacctggttcgtgagatgggttgtcaaacttgattggtttgttgtgcgtggctggaagagctgatagttatatatttggcttggactgtgccgcttgtatgtatctgaattctgaaagcgttgtaatctgagcatccgtgcaaagtatgaatggcccttttatatgggctggattttccggtttct

SEQ ID NO: 75508 - DNA, 424 bp, Zea mays
  Clone ID: LIB3079-018-Q1-K1-D12
ggatgtcatgctgtttagaattgctttggcttttgcctttatggctcgagtgccatgagaccttttatatcatttctttttactaaacaaaatctttgttcacactcaggcaatgtgagttgaacttataaacaaaagttggttttactaatttattaaaattggcaagtttgtgatgctaaaatttcacattgaaggccaaaacattgccactcgttgagtcattgttcaaaagaactacagggaccatcatctgatgtaagcttgtgattttgctgggtaatcccttaaccgttgtcaggtggatatatctttaggacaactttgtggggacccacaggtctatatttggtcgataccttcttaaaacacatcttttgatgatatcgagtttctgttgtgtatgtttcataaagtcctgctg

SEQ ID NO: 75509 - DNA, 362 bp, Zea mays
  unsure at all n locations
  Clone ID: LIB3079-018-Q1-K1-D3
tttgggctgatttatgtgcttgggtgttcttatcgtgnnnnttctatctctcttcctagtctagggcttggtggtgaagggaaggtaagacgcatattgtgaggaagaagacttagaaggagaagggttccgagtttcttgagcctgaggatcttgccgtttaggtccctcccgactcggagaatgggaattaggagtctaacagtgattctaaggattcgcatactaataacgtcacttagacggacgccattgggagtaggaaggtcgccgctacttatgctttacattgntcgtgtaaggttcctaggaagacttacgctagatcctgtaaggaattcggagaagaaacctaatggtaa

SEQ ID NO: 75510 - DNA, 414 bp, Zea mays
  Clone ID: LIB3079-018-Q1-K1-D4
tggacctttgggctgatttatgtgcttgtttatgtgcttggattattcgtcgcgtgatactgaaggttagtattctagtgttgttgttactgctggttatgatggtagtgctcgggtatagcttgagaatccttttgagccaaagttcgaggaggccgtcgggacgacaaaggatcccgacgaattcggaatctccgtattaatcggctcccccgccggaggcatgaagcatacggcgacttaaggcgaattcggagccgctacttgaggaaagaaggcatagcggggaatagacccctcaacagaagaaacgtcccgacgttcccccctgccgtccacgccaacccccatttaaaaataaatctaggctacactcgtagcatcacaccaccaccaaaacacgcaacacggact

SEQ ID NO: 75511 - DNA, 344 bp, Zea mays
  unsure at all n locations
  Clone ID: LIB3079-018-Q1-K1-D5
gttggaattgggtgattatgtgttgttattgttggnttgttttggttttgggagattgtgagagtgagatgagggaagtnataagttttatngagttgattgattattaaaggttattagtcttcgnttgttattgttctgtctgatgttttctcctgcggttctgtcctagattcatgagttctaactcgtagtccggcaaccggctgcacagctttctactactggaacggcggggctatcactccctttatattcaacgcggacttgaaggtagagaacttcaacgagacggccatagttggcgcgtccctaagttcctagaacccttcatgtaagcgttc

SEQ ID NO: 75512 - DNA, 383 bp, Zea mays
  unsure at all n locations
  Clone ID: LIB3079-018-Q1-K1-D6
ggcttgngacctttgggctgatttatgtgcttggatgattcttttttctttttgtacctctctatgttgttcgtgtctcttttgctgtgagacagataatttcagtctttgctcttccgtccatttcttctcttaattttctcttgactctcacaaaagatttgaaccctgaacctttttctgaatttgtgacttgtgtcccttcctttgtttaccctggctctcgacctggtgtggacctgtcgtgtgggagtttttgaggccgtgcgtgcgacctggacggtggagttggngtctgagggtagttagttggcggactcgcttaagtattttctcggtactgcttttatgtcttagaacactgcactaatagccaacccgga

SEQ ID NO: 75513 - DNA, 430 bp, Zea mays
  unsure at all n locations
  Clone ID: LIB3079-018-Q1-K1-D7
tggcttgngacctttgggctgatttatgtgcttgtttatgtgcttgtgtatacactcatcacatcacatctcaggaagtaaggatattattgttacggtagttaagacgtccgtaccgcctgtctcttcagtctcccgcgtaagtgttatcagcgtgatgtacaccttagggtatccgttattagctacgttaccgggcattacgaatttacgtacgtagcatcgtacgacgtaataggggtccgttagtccgacggtgcgcttgctttcgacgtcgtagtaatcgccggttccattgtcctagatgacgttagcgacgacgttatagacgacgatgttcaatacgacgctattaccgacgacgttgaatacgacgctattaacggctccgttgaatacgaagctgtaaaagaagacgttataacgctat

SEQ ID NO: 75514 - DNA, 406 bp, Zea mays
  Clone ID: LIB3079-018-Q1-K1-D9
caaataaccatggcggcatctaacaggattgcagcggcacatgtcgtcttcgtccttgccttgctccttgtggcctatcgtgcggaggcaactgtctgcatgaggcataacaatttctatcacggcccatgcatgagcaacaaggactgtgccaactcgtgcgttcaacataacctcggtgtcagcgggtattgcaggggcaagatcccattcaacaaagaatgcatgtgtacatttgaatgcccatgagtcaaaagccactatatctgacgggcgcaacttgttatatatctaaggatgggatgtcctttggcatgtactacattttgaaagtgtccaagtgagactttatacatatatgcagttgagagatggaattaataataagagcaaacaattatgttgt

SEQ ID NO: 75515 - DNA, 345 bp, Zea mays
  unsure at all n locations
  Clone ID: LIB3079-018-Q1-K1-E10
caccaacccagctcgctcgtcccagctgatcaggtcgagcacctagtagcgacctgctggatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtncggctccgggttccagtcccggcacgagtacctgttcggcaagatcgacatgc

SEQ ID NO: 75516 - DNA, 412 bp, Zea mays
  Clone ID: LIB3079-018-Q1-K1-E11
atcgagttcatagtgaaccagcaaataaaggacgagctgggtgtgtatgcacttgaaagaaaactagaggatgcgaagcgcataaatggtcttcgtgctgtgtttggtgaaatctaccctgatccagtaagagttgtatcagttggtcgcaaagttgaagatctgcttgcagatcctgatagcaaagagtggctatccatatcgactgaactatgtggaggtacacatatcacaaacacaagagatgctaaagcatttgcactcttatctgaagaaggtattgcaaaaagagttaggaagataacagccgtgactgctggatgtgccacccaggctatggagttggcgtcatctatcgattctgatatcaataaagcatctcagttggaaggagctttgttggaaaagaaaa

SEQ ID NO: 75517 - DNA, 402 bp, Zea mays
  unsure at all n locations
  Clone ID: LIB3079-018-Q1-K1-E12
ctcggcgacgcgcgcgctggagctgctggcgctggggctggtccccgacgtgaacatgatcatcacggactactggatgcccgggatgaccgggtacgagctgctcaagcacgtgaaggagtcgtcggcgctgcgggcgatccccgtggtgatcatgtcgtcggagaacgtgcccacccgcatcagccggtgcctggaggagggcgccgaggacttcctcctcaagcccgtccgccccgccgacgtctcccgcctctgcagccggatccggtgaccgcccgcgcaaggatggaggatctggttgcgcgctctgacttaattagaggagttgttaggatccaattntttgtgtgttcgttcgttcgttcgttcttttctttctttcttcttggacatagatct

SEQ ID NO: 75518 - DNA, 100 bp, Zea mays
  Clone ID: LIB3079-018-Q1-K1-E2
tggaactttgggctgatttagtgcttgaaaaaaaaaaaaaaaaaaaaaaaaaaaaaaaaaaaaaaaaaaaaaaaaaggatggttgtgtaaggggaattaa

SEQ ID NO: 75519 - DNA, 363 bp, Zea mays
  unsure at all n locations
  Clone ID: LIB3079-018-Q1-K1-E3
ttgggctgatttatgtgcttgatggtgngggaggataagaagngttttggtgagctgtgtcnnttngtgtaggngtgggnggtaatgtggaagagtcatgatttgtnggaggaggatgttaattgttttaattagtattatgatgatgggtttaagnnttggtctgagtatnatgntattgaggtttatgtttcttctgatactcctgttgataaggatgatgttcgacttttactggactcgctgctgggttatctgaagtctggacgtatgaacgaacgaataaataacaacaatgaacgggacgcgtacgcacactgctacgtgtacgccttatgatgagatgggagcacattatggcgc

SEQ ID NO: 75520 - DNA, 378 bp, Zea mays
  Clone ID: LIB3079-018-Q1-K1-E4
ttggaaccttggctgatttagtgcttgtagatgtaagaaaggacagtcggcctcgtctccgtttagttttttcgtggtaacggtcacagggtcacatagccattagacctattggcgcatgcggctaccgctatgtccagtgaacagtgccggtcgacggtcataggttctgagagagagtgcggcaactcttatagaacccctcgagccacggcccgctggcgctggctgccgtcgtcgaaaaggatcggaccgaaggcggcggcggggtcccggagtgcgcaagtcctggacccgcggccaaccggtcgcgaaacaaggagagaccgagagggatagaaagaggacgaccgcaagcttagtgactcactacacact

SEQ ID NO: 75521 - DNA, 420 bp, Zea mays
  unsure at all n locations
  Clone ID: LIB3079-018-Q1-K1-E5
ggcttgngacctttgggctgatttatgtgcttgtggatgtgcggggctgtagtttttagcactaggcgacgagtttattattaaaggacggcggtgaaggtaacggtctagattgcggtggtagttttagagggagggagaatagtaggagtcgtagttgtagttgtagcttactcggcagcaattgtagtttcgtggttaacggatgcagttggagcttcggaggcgagtggagtttgagcttcggaggcgagtggagtttgagcttcagaggcgagtggagtttgagcttcagggtcgattgcagtttaagttttaacggtaacggcaataacgacgtcgtcgtcgacgctgacgtcgacgtcgtcgtttgtagcggtccttttatcggaagtaagctatttcgagtgtcggtgggtt

SEQ ID NO: 75522 - DNA, 383 bp, Zea mays
  unsure at all n locations
  Clone ID: LIB3079-018-Q1-K1-E6
ggcttgngacctttgggctgatttatgtgcttgtttatgtgcttgggagcaaatcggttaccgttaacctaatgtcggagaattaatcgaggactccaaaaggatccctcgaaaactattacgaagtacacgagcttacggcgaggcttcgcagctgctctatacacgggaagcgggtagaggcggtcatcaattaatactaagaaccaaccacaagactaccgccggtcgtaagggacgtccgttccgagacaaggtcctatacgtgagagacgggtacagtagtcggcgccttaaccgagttagacctataaatatggtcatcagacgttatcacgaacacggagggcgccccatcggtcggagccctgggagtcggcggt

SEQ ID NO: 75523 - DNA, 418 bp, Zea mays
  unsure at all n locations
  Clone ID: LIB3079-018-Q1-K1-D10
cggacgcgtggggcctccggtgccggtggcctctatgccgtcaccggacgtgaacgggtacacgtggttcgcgtactacggccgccgcttcctggaaaccagaggcatcatcgctaacacggcagccgagctggagccaggcgttcttgcgtccatcgccggcggcaggtgcacgcctggcgggcgtgctccaacggtgtacccaatcggcccggtgctctcgccgaagccgcgcgtcgtcgtcgatgctcggtcgtcgtcgtctgcgcaagagtgcatccggtggctcgacgcgcagccgccggcgtccgtcgtgttcctctgcttcgggagcatggggtggatgaacgcggagcaggcgcgcgaggtggccgncggcctcgagcgcagcgggcacaggttcctgtgggtgctgcgc

SEQ ID NO: 75524 - DNA, 417 bp, Zea mays
  unsure at all n locations
  Clone ID: LIB3079-018-Q1-K1-E7
ggcttgngacctttgggcntgtttatgtgcttggcctgcgaataagttgctatatttatctgtcgtcgaattaggagccttacttactggtgtctatctttatgactagtgctgctgtccacttgtaaacactctctccttctcccgtagctggtattacgggccttgatcctaaactgacttttccgactgacactggtttgtccgctgaaaagaccgacgacttaagtacggttaatgacaaggacccatcgtaggccgcttggccatcggacgacgtccgtaaggaggttggacctcctcacgcgaaaggttacggcaccgacgagctatcgacgagggaagctaggaacgcaatttgcgaacctccctagtccttccacgaggaaaaaccaaaaaccaagacgatattctaaa

SEQ ID NO: 75525 - DNA, 61 bp, Zea mays
  Clone ID: LIB3079-018-Q1-K1-B3
ggaactttgggcggatttagtgcttgtttagtgcttgtttatgtgcttgtttatgtgcttg

SEQ ID NO: 75526 - DNA, 399 bp, Zea mays
  unsure at all n locations
  Clone ID: LIB3079-018-Q1-K1-B4
cttggacctttgggctgatttatgtgcttgtttatgtgcttgtggatgtgngggtgggcctatgcgacactggattcgacttcattagtcacggtaagaagcgacccgaactccttacgataccctggagctttaccctatctgatcttatcgtcgcgaaaccgcctgccccggggttactccatcgcgtatgcgttccgacaccgtaaaaaaacaaaacaaacaataacattcaaacaaagggcggccaccgaagtcttcttacctcttccgtctttaaataaaccttttccgtccntaaacaaacttcaacgcaaagccccttaacaccgcacgggaacactcaccccccatagacttacacacggacagccgaaccgcaaaaaaaagaaaaagggt

SEQ ID NO: 75527 - DNA, 64 bp, Zea mays
  Clone ID: LIB3079-018-Q1-K1-B5
tttgggctgatttagtgcttggagtaatttactaccggcggcggaatcccccagacccgccacg

SEQ ID NO: 75528 - DNA, 373 bp, Zea mays
  unsure at all n locations
  Clone ID: LIB3079-018-Q1-K1-B6
tggcttggaantttggggtggtttatgtgcttgtgtcgttctcttcttcttattgatttcttaagttttactcttcttatttcagtgtgggttgtgttcttacttgtaatgttgtacttggtggtggtcttggtgaatttatttttgttgtggaaatggttctaggcattctcttgttagttgtcgttaagttctgtggtgctaaggattgttctaaggtgaggaattaggtttgttgggcttggtcggatcttttgttgttggaggcggcggcggcgttgaagaagaagtttgtttttgatgtgctgatgctcttcgcgttgaagaagaaggcttggtggaaggggcgcgaggagacgagtttgggtgagaa

SEQ ID NO: 75529 - DNA, 398 bp, Zea mays
  Clone ID: LIB3079-018-Q1-K1-B7
ggcttggacctttgggctgatttatgtgcttgtttatgtgcttgtgttgcggtggttttgtcgtcttcgcgtcgtgtgttgggtgttgtggagtcggttaggtcggagtatttgtttaaggatggtggtctgtctagttcgtctgctgctggtgatcggggttgaaagggtatgcctaattagcttagggctgtttactagacgggtagggccggggagtagtctagtactgatcctgctacacttattggtgataatcctcatgagaatggttcgatgggtatggacgatgaggtgcctgagtagctccctattgacactcatatggtgaagagttcgtagaagttgcggcattcggcgtcgggaaattacgatcataggggcgatgtgtctgtgta

SEQ ID NO: 75530 - DNA, 449 bp, Zea mays
  unsure at all n locations
  Clone ID: LIB3079-018-Q1-K1-B8
tggcttgngacctttgggctgatttatgtgcttgtttatgtgcttgagtccgtagatcccggcccagttagggtacccggaaccttcgctggcatacccatctacgaggcagcgataccacggcatagagtcttagaaacctcgtccggagtgtggtagcaccttatattagccgacgcgcggctcgcgggtcgcactcccgtggaaacggcgaattaaaagttatcacctttcggtgacctcgagactgatgaatcccccaagacacctaggacatcaggcatattgaacgagtagagccggttaggagctagccgcccgttcgatcctaagatagtcccttttaggcggtaagtctaggattcggtaatagcagctttaaactccgatttcgtcgngccggattcctctctcaaaacgtcctgacatgagttaaagtaaagaactat

SEQ ID NO: 75531 - DNA, 427 bp, Zea mays
  Clone ID: LIB3079-018-Q1-K1-B9
gccaccttgcaggagcagagaaataaaaggagaccgggcaaagctgaagatgatagacgatcaagagagcacagcaaggatcgcaacggccggtcgtccagggatagagaaccagaaaggagagacagggttgagtctcgagatggtagaagagattatgaaagggatcgtgatagacgtcatgatagggacaggcgccatgaccgtgatcgggataaggattatgaccggttccgtggacatgattcaaggaagagagagcgttcacgctccagggagcgcagcaggcgccacgagagatactaaatgttacaccatgcctgacagatttaggagtactggcggcgtctgttcaagatatggtttgagcttgtgcttcgtatcttctgaagaccggtctacttgacgctaaattcgcatggagtgt

SEQ ID NO: 75532 - DNA, 280 bp, Zea mays
  Clone ID: LIB3079-018-Q1-K1-C1
ttggacctttgggctgatttatgtgcttgaagaaaccgtcgccttcgtggacgaggagtaaatacttcgcgtaccacgctaagagtgacccgaagaccctcatagcgacgagatcgatgagcggacgcatagaggcgtagcccacacgaacgtattagacggcaacactgacggcccggaacggctatagccgggattcaccgcttacgtcaaacgctgactcgggtttggtaacatcctcccaggcgggtacagtcgggacgacccgacaggccccccc

SEQ ID NO: 75533 - DNA, 359 bp, Zea mays
  Clone ID: LIB3079-018-Q1-K1-C10
cccacgcgtccggttctagatcgcgggctgccgccctttttttttttttttgtttttttttttttttttttttttttttttttttcttaccgttttttggtcaactatgcttgaacaggtctattgcaactagcaccccatatgcaaacctatcaaatgaaaatgtcattagtggcataactcctgatatcatggtgaagatgtggcccaaaaatatgtattgtctataaaacaatccttctcaacattttggtagtccccattggaaacattttacaggtccctggaaacttaaaagtcaattaacttttatgttggagcttttcaagaaaaccattttgctaaaatgcattatcaaa

SEQ ID NO: 75534 - DNA, 422 bp, Zea mays
  Clone ID: LIB3079-018-Q1-K1-C11
gcctgctgtagttcatgagcatgcacgctagtcttgtgctctgtggctgtggtgttttggggtccttcttggcctaataggaggagggagcgatggcctcgtgcagcagcagatgcttgctcccggtttagccgccgacgccgaggcccgagttttagggggtgtataattgaaatccctacttattatgtagaacaatgttgcttgtatacgacacgggtttaccggacattttggcagatcgcatatggtacggagacgaatttgcattttttatctcgtaaaaaaaaaaagcaaggggacatggatgtatattcacttgcagttaaagctgaaacaacattgtctgttgatcacccaccagaaggggatgaccaaaagaatgataacttctaactcacagaatcaaccaaggcgttttt

SEQ ID NO: 75535 - DNA, 426 bp, Zea mays
  Clone ID: LIB3079-018-Q1-K1-C12
ctggggtgctacccatcggctgctaccgtatctacctcaccgactacagcagctgcaggagcgccgactacgacgcgctcggctgcctgaagaagttcaacgacctctccaccaaccacaacgcccaatcgcacgcccagatcttcgacctccaagccaagtacaagtcggcgcgcatcatgtacgccgacttctactccgccgtctacgacatggtcaataacccatgcagctacaggttcagctcggtgttacaggcgtgctgcggctcggggggcggcaagtacaactaccagaacagcgcgcggagcggcatgtctggcgcgtacgcgtgctccagcccggcgtcgcacctgagctgggacggcattcacctcaccgaggccgtctacaagcagatcaccgacggctggctcaacgggccct

SEQ ID NO: 75536 - DNA, 313 bp, Zea mays
  Clone ID: LIB3079-018-Q1-K1-C2
ttggaactttgggctgatttatgtgcttgtttactctggtcagggccaggctgctctgttaagctgttacgacgtagtagtttttggtgtagtagttgtagttgggtacggtgttgttcttgttcttgtaggtcgtcggtgggtagttattgtagcggggcgggactttgttgttgacggtgtagtagcatggtgtattgctcttgtagtagttcttggtgacgcggggttagttcttgatgtaggtgtatcatgggtaggtattaattttctagtagcatcatgttgtgttgttggcgttggcgtaagtgtt

SEQ ID NO: 75537 - DNA, 193 bp, Zea mays
  Clone ID: LIB3079-018-Q1-K1-C3
tggacctttgggctgattagtgcttaggatcccggctgacactcaacgcccccacgaggtcatgaaggacctggtcccagagtcatcatttactagaagctcaggaacccgcctagagttatcatccaggaccccggccagagaccaacgacatcgcccggcccctcgcataaccgaccgaaagcacacatcc

SEQ ID NO: 75538 - DNA, 372 bp, Zea mays
  Clone ID: LIB3079-018-Q1-K1-C4
ttggacctttgggctgatttatgtgcttgctaaaagacctaccgttgtagtaagactaagacatcaaaggtagagaggagcccacgcgtgggcgaaaccgacgagaaggcaataacgaaaactggactagaataccccgagttaagtggcttttagaatcggaccgccgtcgtcgagggctaagaccataaaactcgggaagtgctcctacagatccggtgggtcgtgagcgttacacaatcgtctaaagatcaaaaagtcataagaaagtacaacgtcaggagacggtgttctagaacggctagtcggtgggagtcgtcgttgtcgttgttacggagtagtaaaacctaataatacaagtcacggaagtat

SEQ ID NO: 75539 - DNA, 386 bp, Zea mays
  Clone ID: LIB3079-018-Q1-K1-C5
tggctttggacctttgggctgatttatgtgcttggctaccttatccttattaactcgctctttaactccctccgtcgtcttaacgtgtctcgcccatctggttagtggaaggggagaggagggtgagacgatggcggagaaggcggatgtggggtcccttgatcctgatgtttatcctgactgttctcctgtccgtttggatgttgatcttgatggtaaggcgaagtcgtcgtctccttcggttgattgtaagttcggtcttctttctcttcggcgttttgatcgtaatgcggtggagttggcgactcatgagtggtcggaggtatcggaaggtaaggatgtggcgtcttcgtgtgttcatgctggggataagtttatccggtgtg

SEQ ID NO: 75540 - DNA, 395 bp, Zea mays
  unsure at all n locations
  Clone ID: LIB3079-018-Q1-K1-C6
ttggcttgngacctttgggctgatttatgtgcttggactgaataatcatagcatacatatctcactgactctcgcgaaccaacccagccacgaatctgactacggtgtgtttttaaaataattagaattttagggcgccttcggcttctaatactggtggtgcgatggccggttgtgctgctactgagtcgcctgttgataaggcgtttaagatggtggagaatccttggtcgtcgcgtattggagagtgtagtgcggggaagcggcttggtaagtgttcgtatcataagggtgtggtgccttattgtgcggcgtttgggcctacgcgttagggtggtgatactatggtgggtaatggtatgggtggtgagctcgtgactggcgatgtttggcat

SEQ ID NO: 75541 - DNA, 67 bp, Zea mays
  Clone ID: LIB3079-018-Q1-K1-C7
tggcttggacctttggctgatttagtgcttgtcagcctcagctcctctatccgacttccccgcattt

SEQ ID NO: 75542 - DNA, 341 bp, Zea mays
  Clone ID: LIB3079-018-Q1-K1-B2
tttgggctgatttatgtgcttgcgatcatgctttcgtttttatttaggttataatcttcggaacaaaaacgatagaaaggaaatcgcacagcctgacgaacgggtagcccgttgcggccccggaacaaaaaaaaaaaaaaaagcaaaaaaaaaaaaaaaacaaaaaaaaaaaaaaaaaggggtggttgcctccgaggatttaaccccacgattttcgttacgtaatgctaaagcctcctaccagggtaattcaacccaaactaacgcggttgggcccaataatcctggaatcggaaaaattccggggcaattaatccaaactgtctcggagaaaacttttc

SEQ ID NO: 75543 - DNA, 332 bp, Zea mays
  unsure at all n locations
  Clone ID: LIB3079-018-Q1-K1-C8
ggcttgngacctttgggctgatttatgtgcttgtcccccccccccccccccccccccgcccccccccccccccaaaataaagggggacagggaccccaggaggagtagcagggacggatcttacgagggaacctaaggaaccgcgggacgacgatatattcacattcggacacacccagcccctaaattcaacccggcggacccgctcgaaaaccgctcgtcccgctccgagcgtcatcgaaccgacggtctatacagccgacaatttgaagcagtgccgtcggattagcggagtacgattcgatacgtccgaaaccggatccagacgcagg

SEQ ID NO: 75544 - DNA, 424 bp, Zea mays
  unsure at all n locations
  Clone ID: LIB3079-018-Q1-K1-C9
tgctcctccccatccgcctccgccgtcccggtcttccaccccaagaactcctcctcctgccgcctcgtgggctgccgcaacccctcctgccagtgggtccactctgccgcgaacctcgccaccaagtgccgccgcgccccctgctcccccggcgccgccaactgccccgccgccgccagcaacgtctgcccgccctacgccgtggtctacggctccggctccacagccggtctgctcatcgccgacaccctgcgcgcgccgggccgcgccgtccccggcttcgtcctcggatgcagcctcgtgtccgtgcaccagccgccgtcgggcctcgcgggctttggccgcggcgcgccgtccgtgcccgcgcagctcggcctnccgaagttctcctactgcctcctgtcccgccgcttcgacgacaacg

SEQ ID NO: 75545 - DNA, 432 bp, Zea mays
  Clone ID: LIB3079-025-Q1-K1-D6
agcagattgagaaaatgcgtgaagttgttgaacttcctatgcttcacccagaaaagtttgtcaagcttggtattgatcctccaaaaggcgtcctttgctatggcccacctggcactggcaagacacttcttgcaagagctgtagcaaatcggactgatgcttgtttcatccgtgtaattggaagtgagttagttcagaagtatgtcggcgaaggtgctcggatggtcagggaacttttccagatggcccgctcaaagaaagcgtgcattgtattcttcgatgaagttgatgctattggtggtgctcgttttgatgatggggtgggtggcgacaaaatgaggtgcagcgtacaatgttggaaatagtaaaccagcttgatgggtttgatgcaagagggaacatcaaagttctcatggccactaataggcctga

SEQ ID NO: 75546 - DNA, 421 bp, Zea mays
  Clone ID: LIB3079-025-Q1-K1-D7
ggaaagtacggcctctacggagagaaggcgtgcgccgagctcctgagcttttccgattccagtggctctccacaggtgaccatttttgttctgccagactataagccacctcttgcagcgtgtgttgtaaatggggtcttggaactgatttcttctgaagctacctccactgagcgaactctaattgtcccatacatcacaagatcgtcaagctatcatcatggaacggaacatgcaacaaaagcatcgactgtacttcatggtgctgaaataggggcaacaactgactatactcacctgttggttggtgggaccactaaacctccttgacatccttgcaaatacgtagtgaaccaatattatgtttgctggaaatggtgcgtgtgttgaaagtgcctacagttcttcttgtcacttctgg

SEQ ID NO: 75547 - DNA, 308 bp, Zea mays
  Clone ID: LIB3079-025-Q1-K1-D8
atcactctgctgatgttagatggagccaacctactggtgataaatgaagagaaggatgcagcagatcggaagctttggtgttggaattcctcatcatatttgcatggcgcagaagaaataggttgaggcttgattctttttgcttgttgtgtttgccctatagtttggatattgccctaactgcctaaggttgtctccgtcagtttttcaaccacacctcgtgttctatattttatttcaaactctactctgtaaatacggtaaatagtgcactctatattataaaaataaattttgtatgactatat

SEQ ID NO: 75548 - DNA, 348 bp, Zea mays
  Clone ID: LIB3079-025-Q1-K1-D9
tcccaattcccatttcgacccacgcggtaccacgcactaaccctcaaccttcgtcttctgcatcactcacaacaagctctaactccacaatgggcaacttacccccatattctcagaaccctccacactatatatcaacatacaaaaaacctgctctgattatgaaccactcgctcaacaactataaatctcccacttatcattattcccatccacaatgctagacgccctcgtaaaaaataccagacctccaattgacctattatatgttatctagtcaaataaaagcgccattatatttcacaaaaaaacatcaaaataaaaaaacaacggcccctctaaaagatc

SEQ ID NO: 75549 - DNA, 318 bp, Zea mays
  Clone ID: LIB3079-025-Q1-K1-E1
gtcgccgtgccgtcccctccccttctctctctcctcgctccccacgccacgcatcgcgtcgtcggaacggaaggcggcagcgctgcgagcaagggagggagggagcggtgatgaggatgctgtcgaaggcgtgctcgattgtggcctcctccctcccgcgctgctcctcctccgccgccgcccccacgatgagggggcagccgtccttgctgccaagcgtgcggaagcaatggcccgggaagccactgctgtatggaatcggcaccctgttggtcatgccactgatgacactgtatggagtgggtcgtgttttttggc

SEQ ID NO: 75550 - DNA, 421 bp, Zea mays
  Clone ID: LIB3079-025-Q1-K1-E12
acgcccacgcgtacggacttctccatgccagcgaacgcgtccgagaattctccaccgccggcaccgtccaacttcgtcggccccttgaaacggcctctctcttccatggctccgaccgtggttgtcaaggacgggaagctggtggctgcagtcggtgccagtggtggcggcatgatccccgccggaacgatcgaggtgttcatcaaccatttcgtcaagaacatggacccgttggcttcggtcatggcgccaagggtgtatcaccagctgatcccaaacgaggtcaggtacgagaactggacgacggtgaccggcgaccacttcgagctcgacgccgacacgaaggccgacctgcacaggagaggccacgtactgacgccgatagctggagggaccataagccagcttgtggtgcacaacg

SEQ ID NO: 75551 - DNA, 395 bp, Zea mays
  Clone ID: LIB3079-025-Q1-K1-E2
gtcactagctcgtggtaataagggaagcttgatcatctttccttatggcggtgatgagagagcagcacaatcgtcgcgcttctgttggctgttgccattctgtcctcactgtctccatgctacgaagccggcggctgcatcgggaaacccaagaagtcaccgtcgtcaccgagaaggccatacttctcgtcctattccgaggaccaccagaactgccgcttgatctgtagctcgaagggtttcaaggacggtggctggtgtgacgaaagcgtggagcacaaagtgtgctgctgctcccattagaaatataatagcgtatgttatgttgatgcatatatttatatgcatcatccatctacctgtgtggtgcaaaattctgaataaaacctgaataa

SEQ ID NO: 75552 - DNA, 428 bp, Zea mays
  Clone ID: LIB3079-025-Q1-K1-E3
caaactattgcgcatccaaattgaagatgatctacaaaatggagttgctggggctgttgcagttccacctgatgagggtggcaaagaagaggttatcaattcattggttgccaatgttgaatcaatgattaaagcagaccggaagatcacatcattgaaacaacttcagggtcatatttggaggattggatttcaaaagaaagagctacagggagttgtctttgaggatgttcctgtggcgctaaagaactggcatgctagtggcataaaggtctacatatactcaagtggaagtagagaagcacaaaggcttctatttggcaatacaacatttacggtgacctgcgaaagttcctgtgtgggtattttgataccacaactggaaacaaaagagaaacaaggagttattttgagatctctcagtcact

SEQ ID NO: 75553 - DNA, 427 bp, Zea mays
  Clone ID: LIB3079-025-Q1-K1-E4
ggtggagctcttgtcccctattaccttgatgaaaaaactgggtggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtttctccaaaggatactatggagagtgtggtaaaagaggaggttacatggagattactggcttcagtgctccggtaagagagcagatcta

SEQ ID NO: 75554 - DNA, 372 bp, Zea mays
  Clone ID: LIB3079-025-Q1-K1-E6
caactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttccttcaacaatcatcagccctattacatcagttacctttggtgcatttattggcacaaaacatcagggcacaacaactttacaacaacttgtgctagcaaaccttgctgcctactct

SEQ ID NO: 75555 - DNA, 299 bp, Zea mays
  Clone ID: LIB3079-025-Q1-K1-E7
cggacgcgtgggctccatcagtccctcgggccatccctagcttcatcccaattgttgttcgtgcagctgctcgtggcagcctgagaccaggcgcgaggatgctggcggtgttcagcggcgaggtggtggaggtgccggctgagctggtggcggctgtgagccggacgccgtcgtccaagacgaaggcgtccgagctcgtcgtgcgctttctggggaccagctgccccttcgacgtgtccgtgcgcatcgtcgaccttggccacctcgcctactctcactccaaccaggccctccttcga

SEQ ID NO: 75556 - DNA, 85 bp, Zea mays
  Clone ID: LIB3079-025-Q1-K1-E8
aaaaaaaaaaaaaaaaaaaaaaaaaaaaaaaaaaaaaaaaaaaaaaaaaaaaaggaagggaaaaaaaactagttctagatcgcga

SEQ ID NO: 75557 - DNA, 81 bp, Zea mays
  Clone ID: LIB3079-025-Q1-K1-E9
aaaaaaaaaaaaaaaaaaaaaaaaaaaaaaaaataaaaaaaaaaaaaaaaaaaaagaaaggaaagataaataaaaaaagag

SEQ ID NO: 75558 - DNA, 408 bp, Zea mays
  Clone ID: LIB3079-025-Q1-K1-F1
tggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccggcccaggtcgttcgcggccaaggacgaggtgttctgcctgttcgagggggtgctggacaacctgggtcgtctgagccagcagcacgggctgtcaagcaagggcgccaacgaggtgcttccctcgtcatcgaggcctacaagacgctgcgcgaccgcgcgccctacccggtcagcttcatgctcgcccagctcacc

SEQ ID NO: 75559 - DNA, 416 bp, Zea mays
  Clone ID: LIB3079-025-Q1-K1-F10
tctactccaacaagctagactttggtgttgacctggactctaggattgcattggttggtccgaatggcgcaagggagagcactcttctgaagctgatgacaggtgagctggttccattggacggtatggtgagacggcacaatcacctgcgcatcgcacagttccaccagcatctggcagagaagctggacctggacatgtcggccctgcaatacatgatgaaggaataccctgggaacgaagaagagcggatgagagccgcagatggtaagtttgggctgtcagggaaggctcacgtgatgccgatgaggaatctgtctgacgggcagaggagccgtgtcatctttgcgtggctggcatacaggcagccgcagctattgctgctggacgagccgacgaaccatcttgatatcgag

SEQ ID NO: 75560 - DNA, 370 bp, Zea mays
  Clone ID: LIB3079-025-Q1-K1-F11
attccctttcgacccacgcgtaccaaaaaaaataaaaactaacataaacacccaatgattataaaaaaacatggctatacactgctaggtggacccaacaaaggcgccactgcaagcaactctaatggctcctatatgacctaacttaaactcaccaaactctccattcattcgcaaaattgacaccgcatgccccatatttaagacaaagtctcgccacctataaaacatacggcttggtataccccttgttacatccaactgcaacacctatcaacacattcccaataatcaaacactctctatctcaaaaaagacgccccctatctcggtgccatacctaatctcgaacagatcaatactctgatca

SEQ ID NO: 75561 - DNA, 431 bp, Zea mays
  Clone ID: LIB3079-025-Q1-K1-F12
cccacgcgtccggaagaagcttggggcattcatcaagcaccagatcgaaacggattcttccgaggcatacggaggtggttttagagctggctatccggctgttgagcgctatggcttgaaaagaacccttgatcatatgaagttgacagggtctttcccatattaaagcaacagaagtaaaggagggggctttcttccagttgtgaggatacactccacattggaggttttggtttgggttatacataactgatatgcataccaaacgaggggaattgtctgtaaatcaggagaaccctctgctgcgcggaaacttattgcaaactgtctttttataggaaaacgatacatgcaagttttcagacagggaacttgagaggatcatatgtaatttttgggcacttgtttttgactcctttggttatcaaaaa

SEQ ID NO: 75562 - DNA, 424 bp, Zea mays
  Clone ID: LIB3079-025-Q1-K1-D5
cggacgcgtgggcggggatcaacgccatcatgttctacgcgccggtgctgttcaacacgctggggttcaagagcgacgcgtcgctctactcggccgtcatcacgggcgccgtcaacgtcctctccacgctcgtctccgtctactccgtcgaccgcgtcggccgccggatgctgctgctggaggccggcgtgcagatgttcctgtcgcaggtggccatcgccatcgtgctgggcatcaaggtcaccgaccactccgacaacctgggccacggctgggccatcatggtcgtcgtcatggtctgcaccttcgtctcctccttcgcctggttccctgggggcccctgggctggctcatccccagcgagaccttcccgctggagaccaggtcggcggggcagagcgtcaccgtctgcgtcaacctgctc

SEQ ID NO: 75563 - DNA, 421 bp, Zea mays
  Clone ID: LIB3079-025-Q1-K1-B7
gtcaaagtgccccaaggagctggtgcctactgatggagaacatgttgatgtgtctgttattaaaaggatggaagattaccgggaacctgtaaggcctcaatcagctttccagggtgttggaagaacccttggtggtggaccttccccagatgagagtgcaacacctgctcctgcaccagcggcccctgctgcttcgaggtccgctggcatagtcatggatgactcccagccatttacatccatacagctgaagctggctgacggcactcgcatggtcgcccggttcaacatgcaccacaccgtgggagacatcaggtccttcattcggacgcatctcggtctggaaccgcatggccgtatcagctgcagacaggtttcccacccaagcagctggctgacccaacgcagaccgtggtgcaag

SEQ ID NO: 75564 - DNA, 425 bp, Zea mays
  Clone ID: LIB3079-025-Q1-K1-B8
gagcgggaggccatgtgggagcagcagcacgagctcggcgcccagaagatgtattccgtctgctccgagctcggcggtcttttcctcaaggctgctcaaattctggggaaacctgacctggcacctatggcttgggtgaagagacttgttacgctgtgtgacaaggccccagccacgccatttgatgtggttagagatgttgtggagaaacagttcatgaagaatttcgatgacatattcgaattcttcgatgttgagcctgttgggtctgcttctattgcacaggtgcatcgagcaaggcttaaattgtcaaatactgatgttgctgtcaaaaggttcaacatccaggagccgaacatctgatgatggttgatattcggaatatgcaagcaatggccttgtttctgcagaagtatgacataaac

SEQ ID NO: 75565 - DNA, 358 bp, Zea mays
  Clone ID: LIB3079-025-Q1-K1-B9
gtcgaggccgccgcccagaccgcctccccttccccgcctccggtgcccaaggccaggccaacggttttgaggtggtaatggcggaccaggctaaccaacccactgtccttcataagctaggtggccagttccacctgagctccagcttctctgaaggtgtacgggcccgtaacatctgcccttctttctcaccttatgaaaggagatttgccactaggaactacatgacccatagcctttggggcccttcaatgtctgttagcggtggcatcaatgtttcagtgatgccgactccgctttttgccaatgctccagcctagaaaggtggcaaaaacttcatgattgatttcatgatggg

SEQ ID NO: 75566 - DNA, 53 bp, Zea mays
  unsure at all n locations
  Clone ID: LIB3079-025-Q1-K1-C1
nccacgcgtncgaaaaaaaaaaaaatttataaataatatatatatataattat

SEQ ID NO: 75567 - DNA, 413 bp, Zea mays
  Clone ID: LIB3079-025-Q1-K1-C11
gtatttttgcagatgttttgtgcccatatttcttttttcaatttttgtccctctgtagataggaacaaggggagaaggggaaaaaaagtacttgtatttcttttgttccatggtggtggtggtggtgggcggctcagcctcgtgagtgcagtattgggcaaaccggaggctgcggcaaccttgtgcagttcggccacgaatatactagggaagatcgcgaccaatcaatcaatcgatgaccgagttcaattgttcagcattctttattagttttggtgggtggatacttcaatcggtgagccgaacagacagttgttttgagtatgaattgctctgcatctgcaaagttgttgtttgtcatccgtcgtctcaatgaggcgaaggtggaactggaatagatggtgctgtctgga

SEQ ID NO: 75568 - DNA, 431 bp, Zea mays
  Clone ID: LIB3079-025-Q1-K1-C2
cccacacgttcaccgacacccgggcgaacactaccatgacgagtactagactctctagggacgcttcatggtcctacgtgcttgccagtgctttcctgagaggctcccggcgtgtgtcctaacgcgatacgcctatgtcacactatatgtgtcagacgcaacatcgattaccactgccgtattatgactgtatgaacgggtttctgtactagggaatagcgattaactatccgggtgttgatactgccactggagaggcgcgaagttttggtgattcagcgtcagccttatcagttaaatgcccccttcgatttgttagtatgcctaccatcttgtgaattgtcagtcttcctagatatatggtatatcaatcatatattcgggtgtaactcgtactttccagtgatttgcgataggtccgttttttcttt

SEQ ID NO: 75569 - DNA, 108 bp, Zea mays
  Clone ID: LIB3079-025-Q1-K1-C3
tcggatacacgttcacggactcgtgcgtgaaaagtactaagtcgagtactagacactctagggggggttaatggccctacgtgttcaactgtgcaactctgagatcct

SEQ ID NO: 75570 - DNA, 435 bp, Zea mays
  Clone ID: LIB3079-025-Q1-K1-C4
ctctacccttgacgaaggaaaaggcagccttctcaccgtcggacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgattgcggaccatggcagtgctgcctttcggctttacacaagcttgtcatcaattgcggttgcattctctgtgacgtgcattatccggtcagagttgttcttgaaggttatgaagcaaaacac

SEQ ID NO: 75571 - DNA, 161 bp, Zea mays
  Clone ID: LIB3079-025-Q1-K1-C6
tcgaagcttacttacgcttgcgtgccacctcatgcctccgatatgcagatgcagaggtaggatatattgcgcctcgccagacaactcctagactgggaaatccttgtacgcatcgatatccatgacgtggcaccaaatagcgatctcatcaaatgccttac

SEQ ID NO: 75572 - DNA, 408 bp, Zea mays
  Clone ID: LIB3079-025-Q1-K1-C7
gaccaccgatcgggcaagatcgtggtcgaactcaacgggaggctgaacaagtgcggcgtcatcagccctcgctttgatatcggcgtgaaagacattgagggatggactgcaaggctgctcccgtccaggcagttcggatacatcgtcctcacaacttcggcaggcatcatggaccacgaggaggcccgccggaagagcgtaggaggcaaggttctaggtttcttctattgaaaaagctgaaaatctttgttatggcctgcctgcctgtcttactctttagactcgagtacctggtattttactcttaaatggctcttttcagactcatagtcccgcctttttttacttgaatattggggactgcattgggctttcactttaaaatccgtgactgcatttatccaattt

SEQ ID NO: 75573 - DNA, 427 bp, Zea mays
  Clone ID: LIB3079-025-Q1-K1-C8
gcagccgtctccaacggccgatccatgcccgtctggcgtcttcctcagtcgcgggccgtcgttgaggtcgacagcgacggccatggcggcggcctcttctgcggcgccggcgaggcacagctgcgcaaagctctcggtcccagtggaggaccccaaagcagtgacggcgggcggtggcaccgtcttcgtcaaagccacgtggctgccgtcccgcttctccctcgccgtgaccgatggtgccggcgcctgggtcgccgacgcctctgaccacgaggtgcgcctccgcgccgagcagtgggatcagcccgtcgccgattacatcgcccttgccgaaggcgctacctcgctttccaacagcctggttccacgtattccttccatgacgccggcaaaggccaacgcaggctcgcttggacatttgaaagac

SEQ ID NO: 75574 - DNA, 320 bp, Zea mays
  Clone ID: LIB3079-025-Q1-K1-C9
ccgacatcctcaaaaccattctcacaactcgcgtatcgagtgcttgatctcctaccagatctgggagcaactgtagttgcgagcccgaatagcggatcaagcaacgactacgccttcgactatgatctgcagtctgatctacctacagagaaccctagatacaactgggcaaccgcacggacgcccacgtgacgtcgcaggaccagcagaacatcaaccgcttcattcgcctcaacaaccgccttcacaagctccaggacgagatcaagctcgcgaacgagaccaatgagaaccttgatgatactctgaatgaacttatc

SEQ ID NO: 75575 - DNA, 66 bp, Zea mays
  Clone ID: LIB3079-025-Q1-K1-D10
cccacgcgtccgcccacgcgtccgcccacgcgtccgaaaaaaaaaaaaaaaaaaaaagggaagggg

SEQ ID NO: 75576 - DNA, 315 bp, Zea mays
  Clone ID: LIB3079-025-Q1-K1-D11
attcccattcgaccacgggtacgcgacttccaccctcgattcgatcctagctgacttctatgattcttggactcgctccaccatgggccattgcacacgatgccaaccgaacggccttcattgtacatcatctccagatgatcataccacctgaaagatcaatcagttgccaaccctaatgctttctcttaaaagtgtaaacgatgcgctcctaccttactctgcatgaactatgccagatgtcaaattattccatcacctactatactgtcagataaatgtgtaatcatgtgccgaaatcagatctgttcaatg

SEQ ID NO: 75577 - DNA, 410 bp, Zea mays
  Clone ID: LIB3079-025-Q1-K1-D12
ttcatcccagaggttcaaaaactcatcgcggaattgaatgaaattttggcacatgatgttgttgatgaggcaggggcctggaaaagcaagcttcagcctgaatcaagggagctgtttgagtttttgcccaatactattcaggagcaacttatgcttgaaagggatccccatggcaatgttcaggtcgcaaaaattgaaaccgagaaaatgctcattagcatggtggaaactgaactggagaagagaaaggcagaggggagatactctgcacatttcagagggcaagctcatttctttgggtacgaaggaagatgcggccttcctactaattttgattctaactattgctatgcattaggctatggcgctggtgcccttctccaaagtgggaagacaagacttatttcctc

SEQ ID NO: 75578 - DNA, 439 bp, Zea mays
  unsure at all n locations
  Clone ID: LIB3079-025-Q1-K1-D2
attcctcgcgcggcgtccacccgattcgaagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgcccctttccaggaggctgctgaggcataccttgntggcctgtttgaggacaccaacctgtgcgccatccatgctaagcgtgtgaccatcatgccaaaggacattc

SEQ ID NO: 75579 - DNA, 292 bp, Zea mays
  Clone ID: LIB3079-025-Q1-K1-D3
gttgatttttctgacagcgcgtctcttgctgctgctttgaagctcgaccagaaggtggtcaaggaacgcccagtcagaatcagatgtgctgttccaaaaaaggatgaccaaaaagtcaatgacaatgggaactcagatcatctgaaaagtgaaactaggacatgctatgaatgcggaacccctgggcactcttcttcttcttgccctaataagaaggattctgaagcaaggaagagctatgaatgtggcaccccggtgcacctctcttgtgcttgcccaaataataacgatt

SEQ ID NO: 75580 - DNA, 429 bp, Zea mays
  Clone ID: LIB3079-025-Q1-K1-D4
tggacttttgaccgcgccgaggccaacaagctgatcgaggcgctcaggcactgcctggacacgtaccggaactacgaggagagctggaagagtctccaggcgcgcggcatgtcgcaggacctcagctgggaccacgcggctgagctctacgaggacgtccttgtcaaggccaagtaccagtggtgaacccttcgccctccgcatcaatatcttcggtttgatcccattgtacatcgcgcgtttgacggtctcggtgaagaacttcatatgcagtgacgcgccgctggggtcggtagcagtactatgggattgcattgagctgtgtcactatgtgctttttcgacaggacagtagtgaaagtgtatgcaagttattttgttttcattactgaatttggaatgcaacacaataatgaagctctatgtgttt

SEQ ID NO: 75581 - DNA, 430 bp, Zea mays
  Clone ID: LIB3079-025-Q1-K1-B6
cccagcacgaagccgacccaggtgaagcccagcactctcagaaggatgaagagggctaggagggttacaaagatgtccaacagggtggcaaactcaatcctgtctggtgttctgaaagtcactggctttgtcacaagcaccgtgttgaactccaaaccagcacaaaagtttttcaagttaatgcctggcgaagttattcttgcttcacttgatggatttgggaaaatatgggatgctgtggaagtgtctggcaaaaatgtgatgcagacatcctcagttgtgaccacttctgttgtaacacacagatacggtgaacaagcaggtgaagccacccacacaattacctccacgctacaggaaatgttctcggagctgcgtgggctgtattcaagattagaaaagccctcgaccctaagggtaatatgaagaa

SEQ ID NO: 75582 - DNA, 380 bp, Zea mays
  Clone ID: LIB3079-025-Q1-K1-A2
tcgctcaccgtgaacccggggcctcgccgccattattgcgggggatccaagccgtcacggggaaggttgccttctattgccgcccgacccttgaagtgtggctgcagtagttcgtcgtgactcgtggagtcttgtgataagcctcaccgggcgtggaggtaaccgggtgagggggaattcctcatcgtcgtcatacggtaccttgtggccgtcgtacgccatggctagccaatctgccaccaccccatcagcgaggttacgagtcacctgaagagcaagttggtacctggaatctcaagttccaggtaccattcatgaaatggttgatggtgtgacttttggcctaccaccctgccacctggttggacggtcgattggga

SEQ ID NO: 75583 - DNA, 419 bp, Zea mays
  unsure at all n locations
  Clone ID: LIB3079-025-Q1-K1-A3
cccacgcgtccgggaacagcttatacatttgtcacttcagaggacatgccatatttactggacctacatcttttcctttcaaggcctcttagacctgctccaacagaggaggaactcctaaaagacatggacggtataactatgaaaatcgatgaagctattgcaaatggggaatcagtttatggacgatttcctcaaactgtccttgatcttgcctctgatggactaaaagaagttattactggatgtacggagttgatagcattagaaaagccatgtgctaatgctttccggttgtatctcaagactcgtcctatgccttcaaaaganaatctatcaaaagggtaaaagatttgcctcgtgagggtcttaatccaattttcagggatgttctccggtcaaatgaactttcagctctt

SEQ ID NO: 75584 - DNA, 438 bp, Zea mays
  Clone ID: LIB3079-025-Q1-K1-A4
cggacgcgtgggttttttttttttttttcacgagcacaccagtacataatatcagaaaatgttggatacacataatccggaaagcaagcttgggagcaacaacactaggactgactgacgcactccgcaaaagtgacacaatcttgagcgagaacacgagctgtgcttaggccagggcagggaactgagcctggtcttcgatcgctggagcagcagctggtccccgataaccgccgttgtaaccaccacggaaccccccacggcccctaccacggccacggccactagggttatagtacctttcgccttcagctggcttcaagaactcgttgatgcccttcagggacttcttgccccgttcttctctttcagcactttctttctttttcaagtccttgtcagagcccagcttgataaacactttatcgccatcctttt

SEQ ID NO: 75585 - DNA, 373 bp, Zea mays
  Clone ID: LIB3079-025-Q1-K1-A5
gtcccttgggccatccttagcttgatcccaagtcttgctcgtgcagctgctcgtcggggtctgagaccaggcgcgaggatgctggcggtgttcagcggcgaggtggtggaagtgccttcttgagattgtggaaaggtcgagccagactcatgaccacaagacgaaggcgtgcgaaccttgcagagcgcttactgacgaccatctgcacgcgtcaacgcgtccgggcagttaatatagctctggcgaatttgctactcgcacgacagccatgccctactgcgctcaaagtcgatcgttgcgaatgatgcagtgatctgactgttcgaagaaatttgctggacaacctgaggcacatgagccggtagatcatgct

SEQ ID NO: 75586 - DNA, 438 bp, Zea mays
  Clone ID: LIB3079-025-Q1-K1-A6
ggctcttcttgggataactgcagttactatggcaaatactatagctggcgaagaaacagtgcataaacttgcctcgctgttgctgatctatctaggagcaagttatatcctcttgtttgccttaagaaaaggtggtcatagccatgcccataatcatccaatggaaaaaatggcagtcgccgatcttgtacttgtacctgcattatcaccttgtgcaacaactattccagattgtcttgctgaaggcaactcttcctcaacgatgattcttgcaatcattgtgctcctcttcagcaccatcacagtgtatgacattccattggtgagccactttcaaaattctacaggtgctagccaatatcaagttccactgggtggagcgttactacaagatcctcgttggcacggagctatgcctagatggagtcttaacatatg

SEQ ID NO: 75587 - DNA, 357 bp, Zea mays
  Clone ID: LIB3079-025-Q1-K1-A7
aaggaatcacttgccgtctgaacacagctgcttgtcttcggccgtgaatatactggccttgctatttggatgtacaacttactgactcgcagttggtccccatgcactccaatgaatctgccccgctgcctttttgcctcgggaagctcatgtgagattgctattgttgctggtggatgtgataagaatggacaggtgctgaggtctgctgaattgtacacttcagagattgggcactgggagactatcccagacatgatcctgaaaaggctgttctcttcaggtttcttcatggatggcaagttttatgtcatcgggggcatgaatccagtcagagggattcatgaacttgctgag

SEQ ID NO: 75588 - DNA, 428 bp, Zea mays
  unsure at all n locations
  Clone ID: LIB3079-025-Q1-K1-A8
gacagcgctgagacaattcgcaaggctcttgttcttggtgttaacgtcaagatgatcacgggtgatcagcttgctattggtaaggagactggaaggaggcttggcatgggtaccaacatgtatccatcctctgcgctgctcggccaaaacaaggatgctacgcttgaagcgcttcctgtagatgagctcattgagaaggccgatggttttgccggagtcttccctgaacacaagtacgagatcgtgaagagactgcaggagaagaagcacatcgttggtatgactggagatggtgtcaacgatgccccggctcttaagaaggctgacatcgggntattgctgttgcggatgctactgacgctgcgaggagtgcttccgatattgtccttactgagccaggtcttagcgtcattatcagcgccgtcctc

SEQ ID NO: 75589 - DNA, 394 bp, Zea mays
  unsure at all n locations
  Clone ID: LIB3079-025-Q1-K1-A9
cgctatcctaagcgacgctgcccgtctcctgaaccagctgcagggcgaggcccagaagcttgagcaatcgaacgaggcgctccaggagtccatcaagagtcttaaggctgagaagtccgagctgcgagacgagaagacgaggctcaaggctgagaaggagaggttggagcagatgctcaagggcgtcgtcagccacgccgcggtggctgctccggggcccttcgtcccgcaccctgctgcggtcgctccatctttccaccaccacccggcggcgtttgctcatgctggaaagttcgtcccgtaccccagctacccgtcgncagctgcgttctggcagtggataccgacgacgtccctcgacacgaccaatgaccccgcacactggcccgacgtc

SEQ ID NO: 75590 - DNA, 387 bp, Zea mays
  unsure at all n locations
  Clone ID: LIB3079-025-Q1-K1-B1
cccacgcgtccgcccacgcgtccgagccaaagcaatctcaagtgaatcaaaccgccagacttcgcagtcctcctccccactaccagagcatgcgcgttgccgcgacccgagccgccgccgccgctcaccctccgagcgccttcctgctcctcctgttactcctcggttgcgcgtccctcgcgatcggaggagcagccatggccggccacgtcctcggcggcgtgaaggagaacccagccgcggccaacagcgccgagtccgacgggctcggccgcttcgccgtcgatgagcacaacaggcgcgagaacgcgctgctggagttcgtgcgcccntggtggaggccaaggagcaggtggtggccggcacgctgcaccatgttacgcttga

SEQ ID NO: 75591 - DNA, 438 bp, Zea mays
  Clone ID: LIB3079-025-Q1-K1-B10
cccacgcgtcctaaaaaaaaataaaaaaatattttaaaaaaaaaaaaaaaaaaaaaaaaagaaagggtaaaaatataaggtgtgataaaccattcttttctaattcatatttctatttaattctattttttttctattttttccaatttttcttactcttactttctacttcttttttttttttttaattttccttttttctttctattttctgttcttttttttttcaactttcttatttattaaatacctctttttacccttattttttctcttttttattatttcttatctttttctctttctctttttttattataacccttcactaatcgttttttcaatcttttctttatttttatttttttttttttattctccctttatctgttttttaactcttcttttgtttttttctttcttcctttttctttcttt

SEQ ID NO: 75592 - DNA, 405 bp, Zea mays
  Clone ID: LIB3079-025-Q1-K1-B11
ggtacggctccttgctctatctgcatgtgttgctagcgctacaattttgcctcaatgctcacaagctggtatagcttccctgcttactccataccttccatcaatgatagcttcagtatgtgaaaacccacctttatacccctatatgctccaacaagcaatccacagctagcaacatacctttatcaccctattcggttcaacaatcgccgaccctatctttggtgcagtcatacggtcacaccatcatggcacatcaactaccgcaactcatgctacctgtgatccaccaaactgctctagcaaaccttgctacctactctcagcatcaacactcactatcattcaaccaactgtatacacttaaccctgctgattattttcacaaacatctatatccattta

SEQ ID NO: 75593 - DNA, 405 bp, Zea mays
  Clone ID: LIB3079-025-Q1-K1-B12
cggacgcgtccgcccacgcgtccgcccacgcgttcgcgcactcctgccagagaccaaactatgcgtatcgtgcgtaggtgttgcttgctgttgcaacggaccatccatctagtgcttgcattgctgtcgcactcgctcagctatctccaccgctattggttgttgtttggttacccacgccctgctctctgataccagttgatagcagcagcagctagctataggttgtcagcaggatcgaccagatagatagcgcggatcggaattaacagcgctgcaagaggatggtgaagagcacgacgacgatgggggcggcgagctgcggcggcggcgtgctgccgctggcgtcgctgaaccacatcagcatcgtgtgccggtcggtggaggcgtcgctgcgcttctaca

SEQ ID NO: 75594 - DNA, 309 bp, Zea mays
  Clone ID: LIB3079-025-Q1-K1-B2
aaaaaaaaaaaacaaaaaaaaaaaaaataaaaaaaaaaaaaaaaaaaaaaaataaaaaggaagtgaaaaaaaaaaaaaaagtaaaaaaaaaaaaaaaaaaaaaaaaataaaaaaaaaaatccaaaaaaaaaaataaaaaaaaaaaaaaaaaccaaaaattaaaaaaaagggggcgcgttttttagggttccaaggtttaatcccgggggttttcaactttatagcttttttttgggaacccatattccaaataaagggccctattttttaaaccttttcactgggaaaacccttgggtttcccaatttt

SEQ ID NO: 75595 - DNA, 427 bp, Zea mays
  Clone ID: LIB3079-025-Q1-K1-B3
atcttgtgtttggcgatgctggaaccaagactaatcaactttttgagaacacaattggttgtaagtcgtgaaaataaattacgcttgctgatgatttatgcagcacttaacccagagaagtttgaaagcgacaagggtgcaaaattaatgcagttggcaggattatctgctgatgacatgattgctgtaaataatatgcgttgcttatgtgggcctgataccaaaaagtcttcagtagggggttttacactgaaatttgatgttcacaagaagaaacacacaaatcgaaaagagcgaacaggggaagaatcaacatgggcactctctttcgattttaccctattttggagcaattgattgaaaatcttagcaaaggtgagctgccaaaagatgaatataactgtatgaatgaccctagtcctactgg

SEQ ID NO: 75596 - DNA, 434 bp, Zea mays
  Clone ID: LIB3079-025-Q1-K1-B4
ggctctgatgcggctgcaggcctttatttccgaggtcagcgcatttggcaggccgctatggatgacctaatggcccaaggaatgcgttatgctaatcaggcccttctttctggatgctctgccggtggtgtttctaccatacttcactgtgatgaattccatggattgtttccctcgaataccagagtcaaatgcctagctgatgctggaatgtttcttgacactgttgatgtttctggccgtcgggaaatgagatcctttttcaatggcattgtgagattgcagggttctggaagaagcttgcctaggtcttgcacctcacacatggacaaaacccctcgtgctttttcccccagaatgtgttgccaaccatccgaaccccaacttttgttttgaacactgcctatgacgtgtggcagcttcaacaaagtgtg

SEQ ID NO: 75597 - DNA, 425 bp, Zea mays
  unsure at all n locations
  Clone ID: LIB3079-025-Q1-K1-B5
cgcccgtgcgctcctcctacgcctgcccaggaggaaccaggctacggcaggtaccgtcccccggctgcagggggctacgcgccgccgtctccgcctgcccaggtggaaccaggctacggcgggtaccctcctccaccagctgcagggggctacgcgcctgctcctccgcctgcccaggtggaaccaggctacggcgggtaccctcctcacccagctgcagggggctacgcgccgccgcctccgcctgtgcctgtgcaggagcctggctacggcgggtaccgtcctccatctgctgggggctacccggcggggtacgggtacagcnaaacctgcctcgcgctctggcgtctgaacagaccgtccgcgtctactgcaaggccggcgaagggtacagcctcaccgtcaggaacggcaccgtgtgcctg

SEQ ID NO: 75598 - DNA, 66 bp, Zea mays
  Clone ID: LIB3079-025-Q1-K1-A12
gaatgggcagtttgccgtggttttggaataaaaaaaaaaaaaaaaaaaaaaaaaaaaagagaaggg

SEQ ID NO: 75599 - DNA, 405 bp, Zea mays
  unsure at all n locations
  Clone ID: LIB3079-020-Q1-K1-F3
cacctcgtcccgtggctccactaagacccttggcaacttcgtcaaggcaaccttcgagggcctgatgaagacctacggcttcctcactcctgaattctggagccagaccaagttctccatggccccgttccagcagtacaccgacctgctggcaaagcccaccaagggccttgtgctcgaggccccaactgagacagtagaggcttaggatggtttgagtggagagctctactcgtcgggtgcttgtctaaatgcggtatctatattatagctaagaactgccggagtcgattttgggttctgttttgtcctggatgctgntctgtactgtcaagttttggattatgctatggcactttttatcgatgaatgctacantatgatctcatgatagtggttttttcc

SEQ ID NO: 75600 - DNA, 440 bp, Zea mays
  Clone ID: LIB3079-020-Q1-K1-F4
cccacgcgtccgcccacgcgtccgctttaaataaccagtgttgcaaaatatttgttggcttctgtgttactccatctgttccatagagatgacgtgcagtcaaagttgaccactttatccacctatacacacgaaagtgtttacagagccagcattatgtatctagaaatttgagaaatatttctagttttcagaacaaaaggcttatattggactatttatcctcttcttaatataataatacacacctgcgtgttcgagaaaaaaaggctttgctgttgtatttcatgtttctcaaaacaaagaaataaattccgtggtgattttcgatctcatgaatgacaaatgttataaataattacattctgtgttttagaacctattttcctggtcactgagttcatactcatcaattaatatgatgtggtgtcaacactaac

SEQ ID NO: 75601 - DNA, 368 bp, Zea mays
  unsure at all n locations
  Clone ID: LIB3079-020-Q1-K1-F5
gatatcgagcaccaacgacacaccccattgacgtacagctatgatgcggccgcgtggacccttgctatggtcgtgccgtcgctcgctgtagccatcctctgcatcctagtccggtccgcctccgcggagttctggctcgacgagttcaccacggacggcgacgtccgcagagactacgaccgttctggccggcaggtggcgtcgcttgtcctcgaccagcgttctggcgctggcttcaactccacgcgcaagtacctcttcggcgagttcagcgtggagatgaagctcgtcggcggcaactccgctgggactgtcacctncttctacctgacgtccggcgagggcgacgagatcgacatggagttcat

SEQ ID NO: 75602 - DNA, 335 bp, Zea mays
  Clone ID: LIB3079-020-Q1-K1-F6
cccacgcgtccgcccacacgtacggtcacttcgatcgaaaataatacaaacgagaaggaccctaactataaacaaaccaaaaataaaataaaaccatcctatacatcctaatcacaaaacaactacgcacacttctggctagacaagttcaccaccgcacggatacaaccacatagactaccaccgttctgacctacaagtgactatctcttgccctcttaccacaacttctgacactggctaaaactccacgctcaagtacctattcggctagttcaacatccacattaagcctcttcgcggcatactccatagggactgtccacctcttctac

SEQ ID NO: 75603 - DNA, 335 bp, Zea mays
  Clone ID: LIB3079-020-Q1-K1-F7
cacacgcatcaccaaacacacaccgtatctacgaacaactatgatgcaaccgagatgggaccttgctatggacgggccgtcactcagctgaaaccatcctctgcatcctagtccggtccgcctccgcggagttctggctcgacgagttcaccacggacggcaacgtccgcagagactacgaccgttctggccggcaggtggcgtcgcttgtcctcgaccagcgttctggcgctggcttcaactccacgcgcaagtacctcttcggcgagttcagcgtggagatgaagctcgtcggcggcaactccgctgggactgtcacctgcttctacctgacg

SEQ ID NO: 75604 - DNA, 433 bp, Zea mays
  unsure at all n locations
  Clone ID: LIB3079-020-Q1-K1-F8
gcgagcgcagcctcctcgactgcttccgcttctgctcccttgggtgcaaggtgcgtgcgacgagctctgtcgcattgcgcgtttctatacgcgtcgttgtcaacgtccccttctcttcttgttttgttggtacgcgcgcgcgcagatagtgggcacggcccgtggctaccgtcctgggaagaagaagcacggcggcggcggcggtaacaagaagagggcgtcgccggcgccggcgcttaaggacgtgcggtctgactcggaggactcgtgcaccagcaccagcggcgccagcagcgacaagagcagcgtcgtgcagagctccccttcgncgncgacctctgccagccaccgnccccccgggaacaagcgccgaaagggcatcccgcacggtcgcccttgggcagcctcatcgtcgagctctaggactcttcgt

SEQ ID NO: 75605 - DNA, 403 bp, Zea mays
  unsure at all n locations
  Clone ID: LIB3079-020-Q1-K1-F9
cccacgcgtccgctgttgtatcattgtggccataagttattttgggggataacttgggttgcggatgattcgttcagcatgtcctcgtgctcttcacagggatcatgtccagactcacactgggctcgttgctcggccttgttgagctagagatcctccaacacagcggcaccgacaccaaggctcagaagtgtttgaaaaggaaagagaacaaacaaaaatgggtatagtcaggaataaggaaaagcattgtggatgggattcattcttttctatggttcacctcgttctggtgatatatgaaatggtacatcagataagtgggaagaggaagtataatgcaatggataatcataaaaagtgatcactctggagtatcctgtatctaccatttntatttact

SEQ ID NO: 75606 - DNA, 350 bp, Zea mays
  Clone ID: LIB3079-020-Q1-K1-G1
agctcctgcaaagcaagccgatctggtttcaagtataccaaacactgatgtttgcacggctggttacaaagtctgcgcgtctggcatgaaagctactatgttcgccgcacattcaattcatctgcgtatcaatgatattgctctggcatgtggcatcgaaagcatgtgcaatgccccaaagcacattgctgaagctaggaaagggtctcgttttggacatgacacactttttgatgccatgcttaaagatggactttgcgatgtttacaatgactgtgccatgcgaatgtgtgccgaactttgtgctgacaatcatgccctcacaagagaagaccatgatgcttttgcta

SEQ ID NO: 75607 - DNA, 409 bp, Zea mays
  Clone ID: LIB3079-020-Q1-K1-G10
cggacgcgtgggctccatgggctccagccgccagaggcatccatcttcgagaacaagacgacattcaatgagctgaaccagctcgcggaagaggcccgcaggagagccgagatggcgaggttgcgagaagtgagcaccctgaaggggaggatggagtcagtggtgaagcagaagggtctggacatcgagaccatccagcagtcctacaccgtgtgactggctgaccgacgacgacggggtttatagaggtttcttcttcttatactatacaatctgtactaggtagcaataaggatcaaggaaggaacccctatatattggctgtggttcgcgggaaatgaatgatggtcatatttatgatgtcggtgtggtgcttctgtcgccaactctcgaccatactaccctcaac

SEQ ID NO: 75608 - DNA, 411 bp, Zea mays
  Clone ID: LIB3079-020-Q1-K1-G11
cttatctgacggcactaatgataagatccaagctgtaattgaagctggtgtttgcccgcggcttgtggagctccttctccatccatcaccgtcggtgcttatacctgctctacgaactgttgggaacattgtaactggagatgatcagcaaactcagtgtatcattgatcatcaagctcttccccgcctcctgaatttattgacacagaaccacaagaaaagcattaagaaagaggcatgctggacgatttcaaatattactgctggaaacaaagatcagatacaggctgtcataagtgctggtattatcgctcctttgttgcaactgcttcaaggagcagagtttgatatcaagaaagaggctgcttgggccatctcaaacgctacctctggtggttcccatgaacaaat

SEQ ID NO: 75609 - DNA, 377 bp, Zea mays
  Clone ID: LIB3079-020-Q1-K1-G2
ggaacctgtactgatgttgagcaacagttcataaacaatacagtgcactttcagaaggtgtggagcattaaaccagagattcatagccgatgcaaactagcagccaagcagattgcggatgacggaagggagttcaacatatggaggcctctctgccctaatgagtatgcctcaaatggtgatattgcgcatgttggcatccatccaccgtattgtgctgctgtatacaagaatatcaatgggaactttgcactgcctcttggctatgacctggtttggagaaattgtgctgaggattacaagagccctgtatcaatatggcttccaaggccaccggggggatacgtagctcttgggtgtgttgcttgcccttcatt

SEQ ID NO: 75610 - DNA, 369 bp, Zea mays
  Clone ID: LIB3079-020-Q1-K1-G3
gttgaccctgataaagtacacggactatcgtggaattccccttccgatggttaaggagatatgccgccatgtgctcattggccttgattacctccaccgtacactttctattattcacactgaccttaaaccagagaacatattgcttgtgtctaccattgatcccacaaaggaccctcggaaatcaggcgtacccctagttccgccttcaatgaggacagacgagccacctcctaaggtgcctgcacaatcaggaaatggtggcctcaccaagaaccagaagaagaagatccggaagaaagctaaacgtgcagttgctgcaacttcagaaggaagtagtgctgtggcatctgcggacacagatgggtc

SEQ ID NO: 75611 - DNA, 432 bp, Zea mays
  Clone ID: LIB3079-020-Q1-K1-G4
gcgcctctacatttcttctctctctgctcctccgactccgcctgatccatccaagagaggggtcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgctccttcatcacacaactgtgacattccgcatgtgaaccgtactgagtatcagctgattgatatttctgaggatggatttgtgagccttcttacttcagatggcaacactaaggatgatcttagactcccaactgatga

SEQ ID NO: 75612 - DNA, 318 bp, Zea mays
  Clone ID: LIB3079-020-Q1-K1-G5
aaaaaaaaaaaaaaaaaaaaaaataaattaaaaaaaaaaaaaaaaaaaaaaaaaagaaagaaaaaaaaaaaaaaaaaaaattataaaaaataaaaaaaaataaaaaaaattaaaacaacataaaaaattattttatataacctaataaaaataatttactccctttcttattacaaccttacttctaaaacaatccctttctccccctttttattcttctagcaaatcatatttttttcacctcctttaataacatctaagccttcaaaacccttcttttttcccaatttttccccctccttaattattacttttacc

SEQ ID NO: 75613 - DNA, 407 bp, Zea mays
  unsure at all n locations
  Clone ID: LIB3079-020-Q1-K1-G6
cccacgcgtccgcccacgcgtccggttatattcctgttgttgaaggaaggcctgttggaatccgtcctcttccatgttgtggccttggcatggggtggtttctgtttataattgggttcttctttgctgccattccatggtatcttggagcttttgtgctgatttgtgtccgagtacgtgattacagggagaaaccaggatatgttgcttgcactattgctgcctcgcttgctgcaattgctgtgctgcttggcgccacaaaaggagcggaggtgtggtgagcattatgccttcaattaccagcagtccggttaatgtaaatgtccgttgctcggctactttgttacctgtgttgtacatgtgttgtgcgtacaaaggatagggtgtaacgaanatgatgtatgctc

SEQ ID NO: 75614 - DNA, 388 bp, Zea mays
  Clone ID: LIB3079-020-Q1-K1-G7
gtcgcaacccgcgggcggagggtcaggcacaggaccgttgcgttgctgccgccgccggcacgagatcgaggagggatcccccgctctcacgccgctccaggtcgagggccgagcgagatggtgaacaccttcttcctcttctgcgggtgcgtggaccaggccagcgtggcggtggtggagaagtggggccgcttcctccgcctcgccgacccgggcctccacttcttcaaccccctcgccggggagtgcgtcgcgggctccctcaccacacgcgtccagtccctcgacgtccgcgtcgagaccaagaccaaggataatgtcttcgtccaactgatctgcacaatccagtaccgtgttgtcaaggaaaatgcatatgatgctttctatg

SEQ ID NO: 75615 - DNA, 323 bp, Zea mays
  Clone ID: LIB3079-020-Q1-K1-F11
gtttctttaataaaaaaaacagcatcatataacgaaacattcacgtcgataccaggcgcatcttactatacatgtgcactcataatcataatcttgaacaatgtcctcttcacactcacacttacttgcaaattaactctttctgaactctacatccatctatagacccacacatacaccaagtctcacaactcttagccctgctattagaacatacaatacttcttatacccattaataacgtttaacattaccatgggattcaaatttcctacaatttaactctttctagaaatatacgatattgatcattccatcatttg

SEQ ID NO: 75616 - DNA, 385 bp, Zea mays
  Clone ID: LIB3079-020-Q1-K1-D5
tgttaagagaatctctgatctacaggcttcaaaggaaagtccagcaagggctggggcgagcgataagggtacccctgtaccctcaagttctagccaggagaaggatccagtggctaagactatactgaacaaggtgaaggaaaaaagtgatgacgaaggtaaaccattgcccgctgaatttgatggaaaagaaaacccggtggcaaactcaaaaaatgacaagtctgattctggtgtcgaccggagtcgagaaagagagagatcaagagggcgggaacgtgatgccaggggtagggattctgatcgtgatagcaggggtcgcgagtctgatcgtgagagggaccggagacgctgctctagggaaagaagttcaggacactcagac

SEQ ID NO: 75617 - DNA, 374 bp, Zea mays
  Clone ID: LIB3079-020-Q1-K1-D6
cccacgcgtccggaacaacttcactggttcctgtgcagagtcaggcttcttgggactgctgctcgatgacgcgcgtgtacttagaagtgcgcggatagaagacaacaacaaactggacaaagaatccctcaaacgcctcctgaagatgagaagagcatccaaggacgcagaaataatcctcctttgaggcgtggtcccctggctccagtagatgcccactgttctttcctggtgaagcgatttggtctgctgtgttataggttctattcaactaggcgtttgggcacaacttcgtctgaacaaaagttgtgtcttcgcgtatacctgtgtttcagtgtgtcaccttcagcaaagctaaatgttgcacccgagtc

SEQ ID NO: 75618 - DNA, 383 bp, Zea mays
  Clone ID: LIB3079-020-Q1-K1-D7
ccaagactatagccacgacaagattgtttccaggggaccaaaaaagtacgcagaggagattgaaagtggttcttctgatgttgaagcaaagtacaagaaaatgtatgaggatgacataaacccgtttgctgctttttcaaagaaggaaaaggatcagcgttataaggaacttggtttaagagacaaaatcacacttagtagtggccgttttgtccttggtaacaaatacgcacggacgtttatattcttctacagcatcggattgcatctccttgtatttacattactgtacagaatgtcagctttgagctatctcaacacaacaactcagcaggatgaaatcattctggatgctggtaatcagaggctaacgcacatgcttt

SEQ ID NO: 75619 - DNA, 434 bp, Zea mays
  Clone ID: LIB3079-020-Q1-K1-D8
ctggaccgcccttgcgctgatgtggaagacaactccgattacgatatttttcgggtggacattgatgcctttgctggacccccctggcctcttgttgttcaattggaacttcagaaacagctgcgctgttatcatctctgcattgttcggtttccttcttcagtggtctggtgctttggcactcggcgcgacgtcagctttgtctcatgttgtgctgggccaattcaaaacgatcgtcatcatgctctccggctacctgatcttcggctccgaccctgggatcaccagcgtctgcggtgccgtgctcgcactcggcggcatgtccttctacacctacctgggtctgaagaaagaccccgcgaccagcggcaaaaaagcaccatcgagacagaactccttcatggcgagacctaaggtcgctgctgacgacagtg

SEQ ID NO: 75620 - DNA, 335 bp, Zea mays
  Clone ID: LIB3079-020-Q1-K1-E1
aagaaaaaaacataaaaaaaaaaaagaatacaaaaccaaaaaaagaaaaaaaaaaaagagaatgcactaacaaaacgggcagaaggcatggcgccccgcgcccgcgatagccacatacaacgtgtgctgtgtcggcgggtgcttcagctccgacatactcaaggccatggaggtcgacgtgacggacggcgtcaacgtgctctcgctctcccttgtcggcggctcggaggagtactaccgtgacagtatcgcagtgggcgctatcagcgccatggagaacgggatcttcatgtcctgctccgcgggcaatgccggcccgggcgccgcgacgctgt

SEQ ID NO: 75621 - DNA, 419 bp, Zea mays
  Clone ID: LIB3079-020-Q1-K1-E10
gtgttggcaggaggatcccttacgccgtggcgctgaagcgcaaccacgaggcgtgcggggcgctgctgaacccgtcggcggcggagcccatggtgtggccgtccccgttcaagttcatcagcgagctggagccggaggccaaggcgctccttgaagcggcgctgacggaagccaacagggagagggaggagaagatcctcaggggcaccaagcactctccgcatcctcccacctgggaccacgcgagcgacgccgccgacgccgacgccatcgacgacgcgtcctcagatgtatgctttgtgaccgctgacaaatgtgggacctgatgcatcatcgcccattttgcgctcacttgactgttcactcacaggccagcgccagcgacgcggagctgtgctgcatctgcttcgaccaggcgg

SEQ ID NO: 75622 - DNA, 403 bp, Zea mays
  Clone ID: LIB3079-020-Q1-K1-E12
gaggacttctccggctgcacgacacctactggcgggactgacggcacgttccggtcggatctacaccagctcctcctatgaatactgactacctccagcatcaccaactatcttctcctacgccaaaagctgcaggaacagcaacaggccattgagctccagagccgacacctcatgggtcttcagcttctcgaccttaatgctcagcgctgatgctgcagcagcatcgccactgccgacaccaattgtctataccttccaatccagcctacctgtgagcaccaccgcagtctagtcgccatcgacgtcagagtcctggcagcagctgctaaagctgaggagcggatttgctctggatgtgaaggtcaactgtggtgataaagatgaatctgctcgcgaggcg

SEQ ID NO: 75623 - DNA, 387 bp, Zea mays
  Clone ID: LIB3079-020-Q1-K1-E2
cgaccatcatcacagatcatccacagaggagaccatcttccgtgtagagactagactggagagagagggggatatatggcagacatcgtccaaggtgtggagctcgtgggtggagtccgccgccgcgtccggggtgaggttcagcgtcgcgctgcacctggagcccaagaccgcgctcgccctggccgccgccgatggcctcttctccgcctagctagctagctagcctagctgcttccaggcccttctcctgagtgagcagagcactgagcagcagtagtcgagttcttctggaccatataatacaatgcgcggttcacctgtacattcattcttcgcttctcctgcgctcattgatatgcgcatctgcttgattggtttctccct

SEQ ID NO: 75624 - DNA, 342 bp, Zea mays
  Clone ID: LIB3079-020-Q1-K1-E3
ggtagatcgcgagcggctggactgcttcgctcgcggtcgcgggcggtttgagtcgcagcccggatcccaatgcgccccgccgcgccgttctaggccgcggaacggaagctaggtgcgtcacacgccggggccggtcgcggtcaccggaccggacgcacaggggcgccgtacgtgcagtcatcggccatgaaggtcctcgtcgtcgccgtgctggcgctcgtcgccgccgacgccgtcgccgccgccgccgccggtcagggcgaggaggggggcgggccgccgctgccgttcgcggtgggcgcggcgccggcgggctgcgacgtcgcgcagggcgagtgggtg

SEQ ID NO: 75625 - DNA, 415 bp, Zea mays
  Clone ID: LIB3079-020-Q1-K1-E4
gtggaatccagtagcaacaatagagcaacaatggcgaccaagatattttccctccttgggctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttctccctactctcagcaacaacaatttcttccattcaaccaactgtctacac

SEQ ID NO: 75626 - DNA, 426 bp, Zea mays
  Clone ID: LIB3079-020-Q1-K1-E5
atcataaatcctccccagtcagcaattttggccattggttctgctgagaagaggggggtacctggttccgctgatggccagtttgaatttggttcattcatgtcagctacactgagctgtgaccacagggttatagatggcgcaatcggtgcggaatttctgaaagcattcaagggatacatcgagaacccaacttcaatgctgctgtgaagttaggatggatgacctaacacaattttttgtcatgttaaataaccaggccaccaaagagtggcgtctccaaaccaagagcacagagccgtcttctccgttttgatattgccattgctaagtaggatcaacgtatacatgcattattggggtcatttttgggttttggcctcacggataattgatggaaataaatatggaagaagccaattctgg

SEQ ID NO: 75627 - DNA, 392 bp, Zea mays
  unsure at all n locations
  Clone ID: LIB3079-020-Q1-K1-E7
cagcttcactgttgggatggtcaacggaagacatacctatatacctttctacagggtgacatccacaaggaacaaggttaaagtcactgacaggatgtgggcaaggcttctgtcgtccaccaaccagccaagtttcctgagtcagaaggatatcgacgaagcgagtgaggcggataggctggcaaacaggccaccactgccaacgggtgccagctctcgcgtggtgaggtctttcgatcaatcttcgtcgtgttcttccaatggagagatctaagtgattgctggtgcaccgcaattgtgtacagaacctacttactatcgttctgagctctggtgcttgggcagcttcgccacgcaacgagttttgctcttggtgntagtcggtatgcata

SEQ ID NO: 75628 - DNA, 359 bp, Zea mays
  unsure at all n locations
  Clone ID: LIB3079-020-Q1-K1-E8
agcccgtccattccccaatccccgtgtcgcctgtgcccctctgccacctcgccgggggcatgacaacagggtcgaccccgggttcggccccctctcagagaaaacgaaattctaccaaggattccgttgccctgtacgcggtgcaatgctataagtgctacaaatggagtacggttccaaaagaagaatttgagacgcttcgtgaaaacttcactaaggatccatggttctgcagcagacgaccagacagctcttgtgaagacgatgctgacattgagtacgacagcagccgcatttgggttttggacaagcccaacataccaaagcctncaccagagacggagaggctagtggttatg

SEQ ID NO: 75629 - DNA, 418 bp, Zea mays
  Clone ID: LIB3079-020-Q1-K1-E9
cacagatccaaaggctttggtttcaaagaattaccaggggacatgttttgctgggccgtgtgttgaaaatggcaagagggtttcttggtggatggtagacatcggacaggagcaccagttgatgtgcaactactacacggtgaggcaggatggctccacagcattcatgaggtcttgggctttccagggatccatggacggccggaactggacaagcctccgtgtccacgacagcgaccctaccgtctgctatccaggccagttcgcctcttggcccatcgttggcccggcggcccttctgcccttccgattcttcagggtcgccctgacaggccctgccgtcggctgtacgtggaacctctgcatttgcttcctcgagctctacggctacttccattagatcttcttcttccttttc

SEQ ID NO: 75630 - DNA, 388 bp, Zea mays
  Clone ID: LIB3079-020-Q1-K1-F1
ctaaacgctcccgttctgctccgcctgcccccaccggctccccttgtacacgagcgggggagacgccatggcggcggcgcagccgaagccggccaagaagctgggcggcatggcagaagcactcgccatcgacgccgacctaggattccccgcctataccacgcaggaagatcagactagctccgacaaaagcgatgattcggtgaaggttttgagggaactgactgtacagcagaggaacattgccaacttgcaagtggagctacagggaagaaaggatgatgaaaacattgctcatttgactcatgtgagtgagattgaaaagaagtgcgagtctttggccagaatgactgcaatattgaaagatgtcattcataacacggatcgt

SEQ ID NO: 75631 - DNA, 419 bp, Zea mays
  Clone ID: LIB3079-020-Q1-K1-F10
ctgttggaggcacctgccacagccatgcgaccaaggatctatatgattccatcgcaggtgggaattaccctgaatggaagctctacatccagactattgatcttgaccatgaggataagttagactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttatcctatgctgatacccagaggcaccgccttggtccaaactatctgatgcttactgtgaatgcaccaaaatgtgcccaccacaataaccaccatgatgggttcatg

SEQ ID NO: 75632 - DNA, 421 bp, Zea mays
  Clone ID: LIB3079-020-Q1-K1-D4
attttactgcataggcttatacaatggagttagaagccgaagttcagaaactcagagggcagaatcaggaactggagaggaaacaggcagaaattatggaaatgcagaacaacgaggtatcagaaatgttgaaggatccattcggacggaagaaacggctgtgcttgcgaagaacgttgacggccccctggtgacgattgcctagaacagcacatgacttgcacttgctacgtacctgcaggggcgtttgggatctgtagataatttctctcctatagtgtagcgatgaacccatgaacatgaacataatctaaatgattgtactgttagctcccttctgccgcttacgtagtactggagtaccgtattggtggagtcgaaaactgacatgtaaattatgtacgtagtagagaacaaaatg

SEQ ID NO: 75633 - DNA, 411 bp, Zea mays
  Clone ID: LIB3079-020-Q1-K1-B8
cccacgcgtccgcacacagcagcctttttgttctccccgcgagcgctctctttgtctggcgactggcgacgactccgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccagagaggccgcgagggagggccccagggaagacagatgaggattgcggagtgcttggttggtgatgaaaccggcatcattgtcttcactgcaagaaacgatcaagtggatgtaattaggcctggaacaac

SEQ ID NO: 75634 - DNA, 400 bp, Zea mays
  Clone ID: LIB3079-020-Q1-K1-B9
cttcgatcgtttgattcatgtatatcattttacaaaagacactcaaaaccaaacgcagagttcagaactttggagaacctttttttatggttattcgtgaggatgagaccctatcttctatcaaagaacgtatacagaaaaagcttaaggttccagatgaggatttctcaaagtggaagtttgcatacatttcactcggtcgtcctgactattttgaagattcagatactgtagccctaaaattccagagaaacatgtatggagcttgggagcagtatcttggactggaacatccggacacggctcctaggaaggcacacacggctaatcagaaccggcattcattcgagagacctgtaaaaatttataactaggcatgttagaaattgagcgatgagct

SEQ ID NO: 75635 - DNA, 348 bp, Zea mays
  Clone ID: LIB3079-020-Q1-K1-C1
aggctgtcgaaaaggtgcacgccatgatagacagggaagtagccgatggcatccaccgtgagaacatatttgtttgtggattcagtcaaggaggtgctctgacattagctagcgttttgctttatccgaagaagttaggtggaggagcagtgttcagtgggtgggtgcctttcagttcatcagtcactgagaggatttcacctgaagcgaggaagaccccgtttctttggtcacatggaatggctgacaaagtagtattgtttgaagctggccaggctggtccaccgtttttgcaaagcgctggtgttaactgtgagttcaaggcatatccagatctgggtcattcgc

SEQ ID NO: 75636 - DNA, 300 bp, Zea mays
  Clone ID: LIB3079-020-Q1-K1-C10
gtggaccacatccttgatcgcgctactatctaccatgacttcacaaacatccttccgaagaattactgacgattcgcgatctatcatatctactctgttactgcaaatgatgtccaaacaaccactatcttctatatcctatggtccccatcctccaccaaggtgaacagcaacatgctttatgcaagctcaaaccataaattcaatattgtcctcaatggcattcaccttgaactccaatccacatatgctagtgaaatcagcctcgatgagatcaaagatcttgcacactatgcacac

SEQ ID NO: 75637 - DNA, 420 bp, Zea mays
  Clone ID: LIB3079-020-Q1-K1-C11
gcgtagcacagtccattattgccgtcttccttttgcgtgagcaaagaaagagagcgagaagagcagtcgccatgtctggcatcatccacaagatcgaggagaagctccacatggggggcgaccacaagaataaggaagaagagcaccacaagaaggccgaagagcaccacaagaaagaagaaggggagcaccacaagaaggaccgccgggagcacaaggaaagcatcgtggagaagatcaaggaccagatcaccggcgagcaccgcgacaagttcggcgaccaccaggaaaagaaagacaagaaaaagaagaagcacggcgagggccacgaccacgacggcggccacagtagcagcagcagcgacagcgactgagatctggtgtcgcagcacaagtgcaacacatgtattcttgctggat

SEQ ID NO: 75638 - DNA, 415 bp, Zea mays
  Clone ID: LIB3079-020-Q1-K1-C12
agcacaaggtggaggttattgccgtcttccttttgcgtgagcaaagaaagagagcggggagagcactcgccatgtctggcatcatccacaagatcgaggagaagctccacatggggggcgaccacaagaataaggaggaggagcaccacaagaaggccgaggagcaccacaagaaggaggagggggagcaccacaagaaggacggcggagagcacaaggaaggcatcgtggagaagatcaaggacaagatcaccggcgagcacggcgacaagtccggcgaccacaaggaaaagaaggacaagaaaaagaagaagcacggcgagggccacgaccacgacggcggccacagtagcagcagcagcgacagcgactgagatctggtgtcgcaacacatgtgcaacacatgtatgcttgc

SEQ ID NO: 75639 - DNA, 375 bp, Zea mays
  Clone ID: LIB3079-020-Q1-K1-C2
aggctgtcgaaaaggtgcacgccatgatagacagggaagtagccgatggcatccaccgtgaggacatatttgtttgtggattcagtcaaggaagcgctctgacattaactagcgttttgctttatccgaagaacttaggtggacgagcagtgttcactgggtgggtgcctttcagttcatcagtcactgacaggatttcacctgaagcgaagaacaccccctatctttcgtcacatcgaatggctgaccaagtagtattgtttgaagctcgccatactggtccaccaattttgcaaagcgctggtgttaactgtaacttcaaggcatatccagatctgggtcattcgctttcccaaaaagagctactttatcttg

SEQ ID NO: 75640 - DNA, 366 bp, Zea mays
  Clone ID: LIB3079-020-Q1-K1-C3
gcagttccaaggatcacttctgaacgaaagcagaagatcaaaagttggagtgcatacgggtggacctggtatggtcctcacagaccttctgttaagtggttcatcgctcagaaataaacagatgttcaatttaatatgtgaacttccagaaacagtagccagaactttggttccaaggatgagagttgtaaaaggaagtggaaaggcaatcaactacttaacaccaccaaggatcttgcttgctctggttactgcatgggttcgacggggtcgatggtttgacgacgagggaagagcggtgtatgcagctgaagctgatagaattcgcaactgggctgaaagtcgagcacgcttctcgttcaccga

SEQ ID NO: 75641 - DNA, 388 bp, Zea mays
  Clone ID: LIB3079-020-Q1-K1-C4
gtgagcagacggattaccggcgatccctgcgtcggtcgccctcatacttgctcgtacggtgcgttcctttctctgtccaacaatcaatattagccatggcggcagcgctcgtaggtgtcaaagttctctgggttacctctttggaagcggagagccctccaaacacatcagtggcaccagctgatagtgctccacctgctgctgcaggtgctccacttgctgagaaaccacctgctgcaaagcctgatggcaccagtcagattgctgctggggctaccagctcaaccaattactaccacagggcctacagttagaacaccggaaactttcttacggaccgtacttcgaccaaggtccacgctgatcctggccgtggctatttcctggg

SEQ ID NO: 75642 - DNA, 246 bp, Zea mays
  Clone ID: LIB3079-020-Q1-K1-C7
cccacgcgtccgatctcctataagggttctcgcataccccgaccaatgcggaagtggagtgaaagcaagcttggcaccgagttgcttcgtgctattgacaaggctggatatgaaaaaccatcaccaatccagatggctgccattccgtaggtctacaacaacctgaaggtaatgggattggttaaaccaggttttgaaaaaactgcagccttggaactcccaaggtggcctaacattacccaattg

SEQ ID NO: 75643 - DNA, 333 bp, Zea mays
  Clone ID: LIB3079-020-Q1-K1-C8
ccgatgactaagatcctcggtggggattctagaagacagagaactctgctactgtgggagtgagctcaagggatcaatggattctttacgcacattggcctaggttgagactgaccatggatcaacagttgcttgagacttcagtaactttgctacactgaggcagcttgctattgacaaggttcaaccggtggtgatatctttgaaacttggtactctcatccagtatctcagtggttcttcactgcgcatgctttcagtcggtgaagaatcatgtgaatacttcaggacgatggagtctatgtgcgcgtccgatctaactgatctgatagc

SEQ ID NO: 75644 - DNA, 385 bp, Zea mays
  unsure at all n locations
  Clone ID: LIB3079-020-Q1-K1-D1
nccacgcgtccgaaactttttcttggcaatggatggcagaaagccgttgcatgggatgtgctgaaaatctataatgacttcattgacagtcaagaaagacgcaggatcgaacggttagaactgtttgatgagtttgaagagtggtatatgatgcaggaacactactgtgtggcctatggaatcaacgacgccgagggcatatttgacagttttggatttggggagacatagcagcactggtgccttttcttctgtgggtaccagctgcacttgttgtaaaccgacaccattaattcaagtattactcgaagtaaactttgcttgattaaagaaggaacgattgcttgataaaagaaggaacggacaggggtaggatacctaaaca

SEQ ID NO: 75645 - DNA, 394 bp, Zea mays
  Clone ID: LIB3079-020-Q1-K1-D10
aaggggccctgctacaggaagaaggtcacctgccccaagaagtgcttctcctcgtacgagcggcgccggcaaggggtacggcggcggcggcggcggcggcagctgcaccgtcgactgcaaggtcaagtgcacggcctactgttgattcgactcgtccgctgctggcgcgtagcggtttggcagtgggcggtgctagtggctggcggtggcggcctgctagctgctgttggtgtgatggcgcgtgtgcgtgtcggtgagctgagtaccgggtggttaacttgtgttatcatccccaatagtatactagcgtacttctcgttctggggactatttatacgtagaccacgatatgcgtaggggcggtttatttctaagataagaatataagatgctc

SEQ ID NO: 75646 - DNA, 398 bp, Zea mays
  Clone ID: LIB3079-020-Q1-K1-D12
gcagagataaaagctgcccgaactgctcttttgcaatccaaagtcaatcagaaggtggtgcaaatggtgccaaaaagtacattgttgttcctgggcaaaggccagataaggagacgaataaaaatccaactgaaacccccataccacttagagtcaagaagcgtggttccaggaagaaatggaacaagaggaaattcaggaggatggctgaccgaattgttgatgctggaaaggatgcagaggggcttggaacgcttctacatgatgactatgaggaagctagaagaataggatatgagttacctacagatactgctatggttcaatttaacaaggaagttgtaatgacacaacctggtgaaggagataggatagtacaattggagccacccagagat

SEQ ID NO: 75647 - DNA, 403 bp, Zea mays
  unsure at all n locations
  Clone ID: LIB3079-020-Q1-K1-D2
ggcgctggtgatgtgactgaagatcgtccagaaaaagaagcccaagctgttgggaccggcgacactggtttcgtgtttgaacctggttctgtgcttgtggagtttttgcgggaggaggctgcttgcatggccgcacattccttacatgggcgtcgcttcgggaacagaactgtgcatgctggatatgctccgtatgatctctacttgcagaaataccccaggtgattctgcgtttgcgactgcatgagttgcgatacgagctttgcctatgtgccagtatttcacagaaacttcagacttgtagttttggcttttgagcctttggatggttcttccggtccagatagtggtaccattagttgaacgaaatatttggaaatgttgntccacagtagatatcgga

SEQ ID NO: 75648 - DNA, 376 bp, Zea mays
  Clone ID: LIB3079-020-Q1-K1-D3
gggatctgacggcaattccccaattcgattccatcccatgggttggcgttggcacgaggacgacggtgacagcggccggggcctcggcggtgtccctgacctcgctggtggcgggggcgatggggcgcagtgcgccacgcgacgggtggtgcagtcccgctgccacacggaggaagtcgagcccggccgatttgtccgcaagtgcgagaagacggagcagctcctccgcgactgcgtcggcaggccctctgaactggtggaatccaaaactgaaaacactgaagaagatgtcacagaagaaatgaagagcggttcactttctcttgggtttccaagaaacgagcccttcgcattccctggactccgcagtgacatg

SEQ ID NO: 75649 - DNA, 367 bp, Zea mays
  Clone ID: LIB3079-020-Q1-K1-B7
aaagggaacgcgcccttcaagatatccaacagcagatagctgaagtacatgaggtgggcaaagatcttgctaccctagcgcattcccaaggaatcataatcgaggaaatcgacatgaacattgacaattgtgcagcagtgaccaacgaggcaaagacagaggtcgacaaagcacacaagactcatacatcgaattcgtccctgacatgcttgcttatggtcatattcggcgtcttgctgctcgctgtgattatagatctggcagcttgagacatgcaacctcctctcttacagagctattccgcggaattcacaattggagattgctcgcagttcttatctaaccatcacatccagtgccacaatag

SEQ ID NO: 75650 - DNA, 343 bp, Zea mays
  Clone ID: LIB3079-023-Q1-K1-H8
ggctaagggccgaatcgcaccgtactgtacggagaagcttgtgcaaggttctggagcggtcgatggacgcagcgagcatccgtgggcttctctaccacgaggagcaagaagggaagctctgctccgtgcactgcgtcaacaccgccctgcaaggccccttattatccgagttcgacctggacgcgctcgccgtctacctggaccaacctgagctcctggtgatgctcaagggctacctaagctctggtgcgggctacgctgctgcaggggacttctttgtccagcgcgagggctctcacaacgtctcccttggccaagattacagcattccagttcagcacat

SEQ ID NO: 75651 - DNA, 422 bp, Zea mays
  Clone ID: LIB3079-023-Q1-K1-H9
cgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccggtacctccacggacaacaacaagaacaaggcaggtggcaagaagtaggaggcagtggcgcgccgtcacctctgtacgattaatcgatgccttgagcttgtaacttgttcgcatccttgtaggtgcgatgcttgttgggtcataaactctgatgatatcgagatttggtgatcagaaatatgcgt

SEQ ID NO: 75652 - DNA, 151 bp, Zea mays
  Clone ID: LIB3079-024-Q1-K1-A1
caaccaagccttccaaccgttggaagttaaattaaccggttaaggtgtggatctgtgaaccccatggcgcctctgctgtgagtcgtgtttcacctgttatgttctgagattcatgataatgctatgagaactgaaattcccgtttcatgct

SEQ ID NO: 75653 - DNA, 313 bp, Zea mays
  Clone ID: LIB3079-024-Q1-K1-A3
tgcaaatctagccatggccaacaagttccagttgtaatagtggagttttctcactgagtatcgggagccttcatgtatgcgttggtgtcattggagccaagaggttgtgagccatcgaggacattttgacacaaccatttcagtttagaaaatttgatgcggagctgacttcagtggaagagtgttagcttgccatttcagtgtatccaattgttgtccactgtagtctatatcggtgtttcatacctttgaccctgtactagaacgacacggaggatcactgttaacaccagagcgtcatgcatgctttgat

SEQ ID NO: 75654 - DNA, 327 bp, Zea mays
  Clone ID: LIB3079-024-Q1-K1-A4
catcgtaatcaccttggacattttaccaaaacctctggctcctcataatacttgctggtatcattacaatctcgtagttttacttgttgggcttgacttcctactatttataaacacaatacccagaagtctttatgtggtgtcaaacatagttttcactaaaatttcataatcgcctttccactagctacctcatatttttgaaacgcaacttgtgactttacccaaatgaaattaatcatatctccattgcatactccccccataaatattcccaaaatttctttaaagattgattttatcatcaataagcctcataatatccac

SEQ ID NO: 75655 - DNA, 477 bp, Zea mays
  unsure at all n locations
  Clone ID: LIB3079-024-Q1-K1-A5
ccggctgctgccgggcggcggcgacgccgctgcggcgcccaagtggcgcatgtcgctgctggagaacacgttcagcgggttcctgcagggcgccggcgccgacaccgcggcgagggccgtgttcgcggaggggtccctgttctgcccgttcctgttcggcaacttcttcgacccggccgacccgttcccgctgtgggagttcgagtccgacgtgctgctcgccgcgctccgccgcggcaacgccaggaccaccgtcgactgggccgagaccgactgcgagtactacctcagagccgacgtgccaggtggaaggagatgcgacgtggaggtgagcggngacgcgatgaaggtgatcgacatctgcgggctgtggcgggcgccggcggcggacggccgggactggcgctgcggccggtggtgggagcacggcttcgtccggcgggtggagctgccggaggacgcggagtggaggaaagt

SEQ ID NO: 75656 - DNA, 484 bp, Zea mays
  unsure at all n locations
  Clone ID: LIB3079-024-Q1-K1-A6
cggacgcgtgggcggacgcgtgggcggacgcgtgggccggcgtcgccatcgtaatcgccttgggcagcggcaccagaacctctgcctccgcagggtgcttgctggtatcattacaatctggtagttttagtggttgggcttgacttcctactattcagaaacacagtaccgagaagtctttaggtggggtcaaagatggtgtcgctgaagttgcaaaagcgccttgccgcgagctacctcaagtgtgggaaaggcaaggtgtggcttgacccaaatgaagttagtgagatctccatggcaaactcccgccagaatatccggaagttggttaaggatgggtttatcatcaagaagcctcataagatccactctagatcccgtgcaagaagggcacatgacgccaagcaaaagggacgccactcangatatggtaagcgtaggggtaccagngaggctaggctacccaccaaggttctgtggatga

SEQ ID NO: 75657 - DNA, 482 bp, Zea mays
  Clone ID: LIB3079-024-Q1-K1-A7
ccaccacgcagcagatgggtatgcagaatagaagacctacaactacatcagcagctcctaccgatcccaataggatgtaccctagcccccgaccgtacacccagtatgggaattcagtaaaaactggtcttccctacgggagtaacggttatgattccaggatatatggtcgatgtggtcttggtaatggtatggataacaggtacaggcccagggcatgtagtggatactatggttatggcaatgagagtcaggatggaacaattgagttaaacagaggtcctagatctggccggttcaagaaccagaaattgtacggtcatactgtcactattgctgtgaaagggcagtctctcccttctagtgaaagcaagaatgatagtgctgtgcctgatagagcaaagtacaatagagatgacttccctgttcagtacgatgctgcaaagttctttgtcattaaatcgtacagcgaggatgacatc

SEQ ID NO: 75658 - DNA, 469 bp, Zea mays
  unsure at all n locations
  Clone ID: LIB3079-024-Q1-K1-B1
cgcgtcgtctccaaaatccccaacctgacgagctgtaggccgatccgcggtccccgacgctgaccgagcagtctactcggcccagccggggatccaagcgggatggggtacttgagctccgtgatcggccaccccaccgatggatcctccgtcagcggcggcggcctcagccagaatggtagatttagctatggctatgcaagctcccctggtaaaagggcatccatggaagacttctatgagacaaaaattgattgtgctgatggtcagatagttggtctttttggagtatttgatggtcatggtggtgctaaggtagcagagtatgttaaagaaaacctgttcaacaatcttgttagtcatccaaagttcatcagtgatactaaagtcgctatagatgatgcttataaaagcaccgacagtgaattcttagaatctgacagtagtcaaaatcaatgcnggtcaactg

SEQ ID NO: 75659 - DNA, 489 bp, Zea mays
  unsure at all n locations
  Clone ID: LIB3079-024-Q1-K1-B2
atctgctcggagctgtgtggcacaactctgaaccagagacgctactccacttcgagggtggatgggaagcagctgcggccaatgatccttaagaggattaagaaccggacaaaggaatacccaatcaagagcatgatcccagtcgcggaggaggtggtcagggctagggagattgccaatgagggcgtctccagactgctcaaggttgttcctgttcagtcatgcaagttttgtcatgaagttcacattggaaccacgggtcatcagatgaaaacatgctatggtttcaagcgtatgatcaaggacagaccacatgaatgggaaccgggcaacttgaatgacatccttgttcctgttcaggctttccaccagaaaaatatgtttgagcatgagataaaacatgaccagcggttcgacttcactcgcgtcccagctgtacttgagctgtgccatcacgcangtgcagacatacctgatgagattctatac

SEQ ID NO: 75660 - DNA, 469 bp, Zea mays
  Clone ID: LIB3079-024-Q1-K1-B4
cactatccgacactaggccaccaccagcgggcgggctccagtcgcaactcgcaacacagacgcggtcgccgcccaaagaaagacgtcaactccaggagacaagatagtgagaactgaagagaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctgtggaattcaaccaaactcagtgcttgtgttcgagattgaagtcctcagtgcccagtaattcgc

SEQ ID NO: 75661 - DNA, 475 bp, Zea mays
  Clone ID: LIB3079-024-Q1-K1-B5
ggctccaggtgcttcttgcctctgtgtctccctgactggcaagtgtgtaaggagggacctccgctgccctagctccaaacagaattagggaatacggtcaacctcccatggctactgccgtgtaggcgatctgacagtccacaaaaacctaagattcggcaccaagtcactaaccgaaggaaggtcgagatgaggaaggatgtgatttgatctcgaatatcaactacatctgtctagcgtcgagacacatgtgcggtagtgctaagttggttctgtctttcagtttctttctatatcctatttctgtgaaaatattttatgtgagtgatgtaaactgattgccagaattaatggatgttttgcagctacgccagaagctgatggttgtgggtaaaacatttttgttctgtaatccccaggctagcaagtttcacttaaacaaaggttcaggctttcgttgtttgcaaggtactat

SEQ ID NO: 75662 - DNA, 375 bp, Zea mays
  Clone ID: LIB3079-024-Q1-K1-B6
aaataaaaaaacataaaaaaaaaaaaaaaaacttaactaaaaaaaaaaataaaaaaaaacatgagaatacaatatctccaaacatatttatggaacacgcttaacctcccatgcatactagcctataacgcctcctatactgtcccccaaaacctattatttggcaccaaggtttataaccaacggaactgtcaaaaccctgaatgcatcccatttcatctccaatatcaactaattccctattagccctgatacccatatacccaaaagctcagcaccatttgcctttcacatcatttgtatatcctatatctcccataatactcgccctgtgtcatctcatctgactcccataattcatggattactcgcacc

SEQ ID NO: 75663 - DNA, 442 bp, Zea mays
  Clone ID: LIB3079-024-Q1-K1-B7
cccacgcgtccgcccacgcgtccgcccacgcgtccgcccacgcgtccgcggacgcgtgggcgcgcgatgtgctactgtatattacacgaggacaacgtcttgggagctatattcagcctgtggaaggagatgagggctgcaacgtcctgggaggacgttgagaacctggtctggggagagctgaaccggtaccaggactctgcagttcgctcagcataactaaacaccagcaaaaaaaaaaaaaaaaactttctgaacatacgtgtatgttgttgttcctccgacgaatgtaacttccaaatataaaaaaaaagtgtagggaaaataacgaaggctcgacacggcatgcccgtattttcctatggctggtgataatattgagatccctgaaatggttctatgaaatgaaccgcagaccgttgaaatcgtttcagatcggcaa

SEQ ID NO: 75664 - DNA, 344 bp, Zea mays
  Clone ID: LIB3079-023-Q1-K1-H7
gcctttcacctatcacctcggctagccaacctcgcgcgatgtcaccaccactcgcggtgagctcgtcaccttctgtgcgtgacatgtgcctcatgcgctcgatggagatcggggccgactccctatacaaagccaagcttatacgtgggttctgccaactctactacggtcaggaggactgcagtcgtctgcatggaggccgacatcacccggtctgatttcattatcaccgtctaccgagaccactggacctacctcgcccgcggaggggacctagtctgcgacttctacgagctgatgtgccgctacgctggatgctaccgcaggaacggcagttccatgca

SEQ ID NO: 75665 - DNA, 403 bp, Zea mays
  Clone ID: LIB3079-023-Q1-K1-G12
gtgacaagcaattgttttagatgctcatgtgttatttgccttcagtttcttgatgtagttgatgcctaaattctggtaccttgttaatcgtactggagatgctacttcatgtggagttggtgatgtacgatgattatcacgagtacttcaagcgctcatttgaggaaaacatcgctgcgcacgtgcctcagggagtggaatggggttacaactatcgattgggggaaatcaggcataggagggcctgttgacggaccaagtgacgaggcaagattgtctaatgattttgaagttcattatattggcagttgctgatgatccattatgtgatggaccgagtaaaccaagcaattcgtgatattcaactacactttgatgactgtgacgtaccagcatgagatgt

SEQ ID NO: 75666 - DNA, 371 bp, Zea mays
  Clone ID: LIB3079-023-Q1-K1-G2
cttatgactgcgctttgcttcactgactaaggagcatagaatgtggagaattttaccttgggccaatcaaaagggcactcataagagactctactgaactaactcaatagaatcaaaggatagaatagaggaaaatgcaaatagaggatgaacggtatgttctcttggaaaactgctgctagaacgtttatgaatcaaacacggtatactagatgtgctcggactaaatgatgacaacatgttataagatctttcatgttaagtctactccttgcatactgaactgtggaacaaattcgttatacagaacattacagggcttatgctagagagcgatggagacatatataacctgtgacacatgtatggtg

SEQ ID NO: 75667 - DNA, 105 bp, Zea mays
  Clone ID: LIB3079-023-Q1-K1-G3
gtagccgatgatccatggcgccagcggcgccggcagggcgcgcgccgccgacaggtacgccagcgagcggacaatcgccaccggcagtgacagcggattggccat

SEQ ID NO: 75668 - DNA, 311 bp, Zea mays
  Clone ID: LIB3079-023-Q1-K1-G4
gtcagttcttgaagccagtgaccagttggttccggaggaagaactgtctgaggttgggcgggggaaacctgatgatatggaacttgcattaaggaacactatgccgtcagcacatctccatgctcatcgctatgataagttcaaccaggactactgtagccatgtgctgtgttcacagctagcatgatcttattatcgcggtgatgtttcgcatcaatcatggaaccagatcacagctaatatatgtcctgattcggcgcatcaattcgttggcatgttgattggggtcgcagtttgtcaaaacggatgct

SEQ ID NO: 75669 - DNA, 415 bp, Zea mays
  Clone ID: LIB3079-023-Q1-K1-G5
gcttcaggtcaatataccctagcgcctctcttcccccacagggctctttcccgtatgaacggggcccatatcgccgccgcctcgccggaggccggcgggtcgtcctcgtcggcctcgtcttccggcgtctcggcgtccgggcgctcctggctgctcaagggggtgcacctgcggcggcggcgccggtggcggcggcaggtggccgttaggggaggggtgagagccgatggcggcgatgtgcaggatcttgcgctgcctctcgggatgtccttcgcggcggtgcttgcccaggttgtaaatagatgcgctggttctgaagggggattacgacctgatgtcctctcaaagatgtgtacctcggcagtgaaggagtccttaaccaatatttatggtgacagatttcatagcttcatga

SEQ ID NO: 75670 - DNA, 403 bp, Zea mays
  Clone ID: LIB3079-023-Q1-K1-G6
ggaggatgcagccaacaactttgcccgtggtcactacaccattggcaaggagattggggacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaatccaagcttgggttcactgtgtacccttccccccaagtttctacttcggtagttgagccatacaacagtgtactgtccacccactccctcctcgagcacactgatgtggctatactgctggacaatgaggccatctacgacatctgccgccgatcccttgacattgagcgcccaacctacaccaacctcaacaggctt

SEQ ID NO: 75671 - DNA, 272 bp, Zea mays
  Clone ID: LIB3079-023-Q1-K1-G7
gccagccgcatgtcgagtcggtacacgcgcccgccacacttatcgcagcgagcgggagatctcatacgacagtgaatagtggatggactcatgggccgctctcgatgctacaggctcatctacccctgcctctgaaccaatctttctgctattgctgctgctgctgctactgctgtggctgcgaatggggaacaggaaggctacatcaacgctgacatagctaacgttaatctcctggcagctgatataccatatgacagataccacatgat

SEQ ID NO: 75672 - DNA, 406 bp, Zea mays
  unsure at all n locations
  Clone ID: LIB3079-023-Q1-K1-G8
cggcggccagcggaggagggcacaggcagcagctaacatccctcactctcggtacctgacctgaccatgagagcaacatgggcggaggacacgacatgcacgggcagcactacggccacaacggcggcgtgaagggcttcgtgtccaacctcgtccacggcggcggcggccatggccatggaagcggctacggccatggccatggaaacggctacggccatgggaatggcggctacggcggcggccacgggtaccctcctcccgccgccgccggcgcgtaccctcatccgcacggcgcgtaccctcacccgcacggcggccacgggtaccctnctcccgccacctaccccgcgcactcggcgcactacgggcacacggggtcgtaccacaccagccacaacagcta

SEQ ID NO: 75673 - DNA, 340 bp, Zea mays
  unsure at all n locations
  Clone ID: LIB3079-023-Q1-K1-H1
ncccacgcagcggcagtccacctttacagcgcaggacggcctcttcaagaaagctggggagctctccgttctgtgcgacgtggacctgctgctgctcctcttctccaccttcggcaagctctaccactacctctcgcccaccgtcccctccgtcaaggacctggtcgagaggtacgaggccacgacgcacaccaaggtctggaccgacatccgccaggagcggcgcgcggagctggagaaggcggagcagatgtgcgagctgatggagaaggagctgcgggtcatgacggtggacgacggngagcagtacacggtgccgtcgctggagctgctggaacac

SEQ ID NO: 75674 - DNA, 241 bp, Zea mays
  Clone ID: LIB3079-023-Q1-K1-H10
cccacgcgtccgcccacgcgtccgaattttcctgtgccctgaattgggtggtttccatagcatgtgcacggggtttgggtggaatgcctacagaatcgactgtgtcaagctttcttgattccgtagaaacatgttttgtttgacctcatcatagaggatctccgcttttatcgtacaaagattgtgatatgttcttagcttctttctacctgaataagaggatttctgcagacccttttcc

SEQ ID NO: 75675 - DNA, 257 bp, Zea mays
  Clone ID: LIB3079-023-Q1-K1-H11
cccacgcgtccgcccacgcgtccgaattttcctgtgccctgaattgggtggttgggagatcatgtgcacggggtttgtgtggaatgcctacagaatcgactgcgtcaagctttgttgattccgtagacacatgtcttgtttgacctcatcatataggatctgcgtttctatcgtacaaagattgtgatatgatcttagcttgtctctacctcgaataaaggatttctgaatacccttttacatagcaaaaaaacaac

SEQ ID NO: 75676 - DNA, 366 bp, Zea mays
  Clone ID: LIB3079-023-Q1-K1-H12
gtatattcaaggcaagctgcaaaagaacttggaaagaaagtgatgtttttgggtgttccatttattgccgaatggtttagggacaaaggacattttatcaaatcccaagtaacagctgccacaggtgcaatagctcttatgcagttgcaagataacttgacgaagtatatgagtgctgagggccagtacacagaggaggaacttgaaatgtacatggaaaaccataagaaagtcatggttgattctctgtggaagcttaacgttgctgacatagaagccacattatcccatgtctgtcaaatggtacttcaagacagtaatgccagaaaggaggaattgcgccttcgtgctaaaggcttaaaaact

SEQ ID NO: 75677 - DNA, 364 bp, Zea mays
  Clone ID: LIB3079-023-Q1-K1-H2
gccgacgctacggcggtccacctattacaagcgccgggaccgtctgtgccataagggtagggagctctacggtctgtgcgacgcggacctggtgctgcatcctattctccagctcctggaaggtctaccactaccgtcttggcaccgtactctgcgtaacggacctgtgcgagagggacgactgcacgacgcacaccacggtctggaccgacatgctgcaggagcggagcgcggagctacagaaagctgagccgatgtgccagctggtgtagaatgagctgcaggacatgacagtggacgaccgctagcagtacacagggcctgctgtctagctgctggaacacagtctgcaggccgtcgtgca

SEQ ID NO: 75678 - DNA, 406 bp, Zea mays
  Clone ID: LIB3079-023-Q1-K1-H3
gcggatgcgtcggcggcgactccggtgcgctcatcgcgccgtccgcgtcctcactccggccgccgttccgtcttggcgctagtcccaagggccattgttgtacttttcctcatggagcatgtagcaataacagccggctatgagttcaacatcaaaggtgttctcgcagctccacccagaactatgctctttctaggaaggatttatctactataactcaaaatgtggaacgcttccttcacaatgttgttaacatgggtatccttgaccgtctgaaattagcgtggaagataatgactactgcaccaaccacacaggatacctgcaatgcatacatcgcaaaacagaggcttaagatgatcctgatctgcgacaggtgtgaaatcagtgattaagcaaagaaaaa

SEQ ID NO: 75679 - DNA, 151 bp, Zea mays
  Clone ID: LIB3079-023-Q1-K1-H4
tcgagagctttgctaccgtcgacgaggacgagctccgggacgccgtcaggaagtacgccgccgctggcactacgacggctcctgcctcggcgtccgcctaattcaggagatgtgatgtgtagcaaatagcgcgcgcgcaccagtcgtcaat

SEQ ID NO: 75680 - DNA, 371 bp, Zea mays
  Clone ID: LIB3079-023-Q1-K1-H5
acgcatcgtgaggccaccttctacaagcgcagggactgtctcttcaagaaaggtggggagctctccggtctgtgcgacgtcaacctgctgctggtcctgtcttccacctgcggcaagctctaccactacctctcggccaccgttccctacgtcgaggacctggtcgagaggtacgagggcacgacgcacaccaagggctgtaccgacatccgtcaagagcggcgcgcgcagctggcgaaggcggagctgacgtgcgagctgatggagaaagagctgcgggtcatgacaggggacgacggatagcagtacactgtgcccactgttgagctgcttgaacacaaactggatgcagccgtgcacaaggtgcgctc

SEQ ID NO: 75681 - DNA, 408 bp, Zea mays
  Clone ID: LIB3079-023-Q1-K1-H6
gtttcttgttcattctgaatgcttggagactaattacattgcaagcaggcctttcagagtcaatgcggggcctgtacatgcatatgtcaccgttcctggtggcaagacaagctacctctcagagttggggtcaggaaaggaagtcatcgtgatcaatcagagtgggctatggcgtactgcaattgtcggtcgtgtgaagatcgaatcaaggcctctgatccttgtagaagcgaaggataactctggagacgagacgtatagcatttttctacaaaacgcagaaacagttgcacttattacccctaacacaggatcaagtggaaggaccggcattcccgtgacttcgctgaaagtcggtgatgaagttctggtgaggaaacagggcgccgtccgtcacactgggataga

SEQ ID NO: 75682 - DNA, 411 bp, Zea mays
  unsure at all n locations
  Clone ID: LIB3079-023-Q1-K1-G11
gcgcgagcgagagaggtacggcggccgatctggcggcgcaggcggagggctcggccggggccggcaagtcggcgccgaacatggggaggggccgggtcgagctcaagcggatcgagaacaagatcaaccgccaggtcaccttcgccaagcgccgcaacggcctgctcaagaaggcgtacgagctctcggtgctctgcgacgccgaggtcgcgctcatcatcttctccaaccgcggcaagctctacgagttctccagcacgcagagcatgccaaaaacacttgaaaagtaccaaaaatgcagttttgcagggcctgaaacagcactccagaatagagagaatgagcaactgaaaagtagccgcaatgagtacctcanactgaaggcacgtgttgataatttacagcggactc

SEQ ID NO: 75683 - DNA, 409 bp, Zea mays
  Clone ID: LIB3079-023-Q1-K1-E7
cgggcatcccggcgctgccagtgtcggccagggacggggagacaatcctcaaggcgaggggcggcgatgtcgcgccacccaagtggcagggcggcgacggcgcgcccgtgtaccggctcggccccggcccggccgtgttgaacctcacctacattggaaacgagactttagcaacaatcgaaaatgtgtttgcggtgatagaaggaaaagaggagcctgacagatatgtgatcataggcaaccatcgtgatgcttggacatttggagcagttgatcctaacagtggaacagcagccatgcttgagatcgcggagaggctgtccaagctacaagcgaaagggtggaggcctagaagaacaataatcctatgcagttgggacgcagaagagtttgccctgattgggtctac

SEQ ID NO: 75684 - DNA, 360 bp, Zea mays
  Clone ID: LIB3079-023-Q1-K1-E8
gaagagggacgagggtaatcacagaggtctgcgacacggagacctgggtcccggtgatcggaggaactgagctgaccatgatcctgacgacaggactgctctgaacgctgacgagccttggccacaggacagactatatgatcatgcacaacatgggcctggccattctaatacaagccgtcctctacttagcgctgataaccagcttcctcatggccatcgggcttcacatctacgcgagctagtagacggccggaacatgatgacatatacagactaacaggatgctccgacggaggcatccacttcaagatctgcggttccagctacggtcgtataggctgtctctaattctatgga

SEQ ID NO: 75685 - DNA, 340 bp, Zea mays
  Clone ID: LIB3079-023-Q1-K1-E9
aaaaaaaaaacaaacaaacaaatcaaaaaaaaaaaaaaccaacaattaaaaaaagagggggaaaaaaaaaaagaaaaaaacaacaaccaaaaaacatactactaaaaataaacaaaccacatactaaacatctacgccctcctttatgactcctttcttacaaagtctgacatctatcttaacaatgctattctaactgattagaaacacttgcctatgtatgactaatcgcctagcatgatcaaagttgaatatattgccagacgagccacccagaactctatcacggttgcccaatggatgcttcaaactcctggtgcaacaagctacatgagatgca

SEQ ID NO: 75686 - DNA, 385 bp, Zea mays
  Clone ID: LIB3079-023-Q1-K1-F1
tactcggttctcgtgaattcccgggtgcgacgccacgtcgtctcggtgcccactcattgtgcgtctactcatgacatcgcatcatcagactcgagaggacatatgatcaaagcggggccagattaatgctgacctatcaacaagctataccaatgactacccacactgatacacgacatcattcatcgcaactcaaacgtcagcgaaccttacactctttcaacaacatacttctgcagcagcaagaactgtgcttgatgtactaacaggacatgcagaggctgacccatacttactcatctgtatcacttgaaaatattgctcattctgatcaacttgtcccaacaagggatcctgaaacacacttactatccatgatcgaata

SEQ ID NO: 75687 - DNA, 412 bp, Zea mays
  Clone ID: LIB3079-023-Q1-K1-F10
gctgtaccccacaccactaggcactagtccactacctaacgctacctgccttttcacgcgcgtagtgcgccaccgacacgttgagctcgcgtccgtcccagatccgacgtgctcctccatcgctcgcgcaagatgaagatcacggtgcgggggtcggagatggtgtacccggcggcggagacgccgcgccgccggctctggaactcgaggcccgacctggtggtgccgcggttccacacgcccagcgtctacttcttccgccgcgaggacgcggacgggaacgacctggcgggcgcggacgggagcttcttcgacggggcgcggatgcggcgcgcgctggccgaggcgctcgtgcccttctacccgatggccggccggatggcgcgcgacgaggacggccgcgtcgagatcg

SEQ ID NO: 75688 - DNA, 383 bp, Zea mays
  Clone ID: LIB3079-023-Q1-K1-F11
ttggaagcctactctggtatcctgcaaggatttaagagttcacctaagacacaactgctgatgccattcgctccgcatattattcagttccttgatgctctgtacaatgggaaggatatggatgatactgtgatgaagactgcaataggtgtcttgggagatctggctgacacattaagtgtccatgctggccctttgatcaatcaatccacctcaagccaggcatttttagaggaatgcttggcatcagacgatcctttggtgaaagaatctgccgattgggcgaggatagcagtcagccgtgcagtttcgggttgatgccacagtgagtctcgagtctgcacttgcatcccatccacatgtcatcatgcctggggctttaa

SEQ ID NO: 75689 - DNA, 388 bp, Zea mays
  Clone ID: LIB3079-023-Q1-K1-F12
atcaaacctcagtatgttgaccacattccaaatgctgatcaagggaatgtaggacaagtacttgaacagaaggacgagagggatatgaaatctgaactgtgtgttgatcttgaattaaaccaagttattgaccgaaatgtaggagatctttctggtggagagcttaagagatttgcaataccagttgctgctgtgtataatgctcaaatctatatgtgcgatgagccatcaagctaccttgatgtgaagcataggctaaaagctggaccagtcactaggtccttgcttaggcctaacacctatgtcatcgatagggaacatgatttcagtgtcttgtattacttgtgcgacttcatttgctgcctatatggcaagccatgtgcttata

SEQ ID NO: 75690 - DNA, 232 bp, Zea mays
  Clone ID: LIB3079-023-Q1-K1-F2
gtcttcttgttataattaccactgtgtctatgaattgtgggtctagctgggtctatgaagggtgagtctgatgacaattttacaaacttgtttcttgctgatggtaaatatcagaatctctcgctgcattgtgagtgtgttaaaaaaagatacaaaatgctatagaaaaaaataaaacaaaacactcaacaatgcatgctaataaaaaatgatacaaaaggacaatagcata

SEQ ID NO: 75691 - DNA, 409 bp, Zea mays
  Clone ID: LIB3079-023-Q1-K1-F3
gccccaccatctcctaagtatacatccatatcacctcaaaggagtatgagaaatgaggcccagatttatgctgagctatctacaagctataacaatggtagcaaaactgatttagagacattcatccaatcaaattcagcaccatttcaatctgacaacaaccttgagctggtgaaacaagtgctctcctagatgtacaaacagaacatacaaaggctgacccagacttacttgactctttcacttgaagatattgctaggtctgttcaacttgaaacaccaagggatgctgaaatgcatgtacttcgcatgatcgaacactgagagagccatgcatccataaaccaaaaggatggaatggtcagctttcatgaatatcctgaacaatataaaagtgttgaaatggtgg

SEQ ID NO: 75692 - DNA, 373 bp, Zea mays
  Clone ID: LIB3079-023-Q1-K1-F4
tcgagttagcttcttagagggactatggccgtttaggccacggaagtttgaggcaggacgtggaaactcggaggaggcaaagaaataccaggaagagattgccactctgaacaaggagatgaagaaactgaagctacaagtccaagaaaagacagaagaggtccatgtatcagaggacaaggcacttgctatccaaaaacaattcgaaggcttgctgactgaatatgaccgactgctggaggataatgagcatcttcagacacagctgctgtcaattgaccgcatgctttccaactcttcttgaacgaagagtctatttacgggatgctgaagaatttctgaggaagatcatgttaccacccaaagtgtatgg

SEQ ID NO: 75693 - DNA, 417 bp, Zea mays
  Clone ID: LIB3079-023-Q1-K1-F5
gtcccaccatttcctaagtatacatccatatcagctcaaaggagtatgagaaatcatgcccagatttatgctgagctatctacaagctatagcaatggtagcaaaactgatttagagacattcatccaatcaaattcagcagcatttcaatctgacaacaaccttgggctggtgaagcaagtgctctcctcgatgtacaaacggaacatccaaaggctgacccagacttacttgactctttcacttgaagatattgctaggtctgttcaacttgaaacaccaagggatgctgaaatgcatgtacttcgcatgatcgaagacggagagatccatgcatccataaaccaaaaggatggaatggtcagctttcatgaagatcctgaacaatataaaagtgttgagatggtggagcatatt

SEQ ID NO: 75694 - DNA, 421 bp, Zea mays
  unsure at all n locations
  Clone ID: LIB3079-023-Q1-K1-F6
cccacgcgtccgcgcctcccgcctccgctccaccatcgcgggcgacgacgcgccgcggaggaccaagggccgcggcttccgcgaggaccctaactcctccgcgacccgcgactcgcgctttggcgcggggggacgcgccgacctcgactcgcttggcggccctggacccatccagtcaattgaaggatggattgtgttggtcacaggagttcacgaagaagctcaagaagatgaccttcaaaatgctttccaagaatttgggcaggtcaaaaacctgcatttgaatttggaccgccgtaccggatttgtcaaggggtacgctttgattgaatacgagaagtttgaagaagctcaggctgcaataaaagaactggatggagctgagctntataaacaaagaatgagtgttgattgggcattt

SEQ ID NO: 75695 - DNA, 394 bp, Zea mays
  Clone ID: LIB3079-023-Q1-K1-F8
ccacaagaacgtgttcgccttagttgtttgcgtgttctgcatcagcttgcgtctaggacaacttgtgcagaagctatggcagcaacaagtgcaggaactcctcaggttgtaccactgcttatgaaagcaattggatggcaaggtggaagtatactggcattggagacattaaagcgtgtagttggtgctggtaatcgggctcgtgatgctcttgttgcacaggggcttaaggttggtcttgttgaagtactccttggtattcttgattggcgtgttggtggaagacaggggctctgtaatcaaatgaagtggaatgaatcagaggcttcaattggacgtgttttggctgtggaggtgcttcatgcttttgcaaccgaaggtgcacattgtgcta

SEQ ID NO: 75696 - DNA, 350 bp, Zea mays
  Clone ID: LIB3079-023-Q1-K1-F9
cccactcgtccgcccactcgtccgaaaaaaaaaaaaaaaaaaaaaaaaaaaaaaaaaaggaaaaaaaaaaaaaaaaaaaaaaaaaaaaaattataaaaaaatacaaattaaaataaaaaaaaataaaaaataatgtttctttttttgtgtcacctattttaatttctctgcctttcattttaaaactttttttttgtgtaacactatttttattccctttttattctttttaaaacatatccctttttaaacctttggttttaccacttttatgccctttcctttcaattttcttttcagattctcattttttatggaaaatgtcacgccctttgtcttttcccattaat

SEQ ID NO: 75697 - DNA, 425 bp, Zea mays
  Clone ID: LIB3079-023-Q1-K1-G1
gcgtccacgcgtccggctggctttactgaacgaggcctagagggcaacaaattcgtggtcgctgaacgaccacaggggcactcgaggggactttactgtacagactcggttgaagcagtggttgaagagcggaaaatgcgaaaagaaaatgcctgcgatgtactcgaggaaaatgggtgcagccaccttcaggaatcaaacggtctagacttgatgtttgcagactagagtatgacaacatgttattccatctctgatgttaaatctactccctgcatcctcattgatggcacaaagttgcaatacagaacatgacagggcttatgagagagagagagagagagaaatttatcctgacacacatgtatggatcacatttggttgtcttcttaaaacaagacacgacaagatattctttttacata

SEQ ID NO: 75698 - DNA, 370 bp, Zea mays
  unsure at all n locations
  Clone ID: LIB3079-023-Q1-K1-G10
ccgacgcgcaagccagtgccgcacccagaccagatctccgcgacatatcagtcgttcgtccagctaactgcactgcactgcactgcacgcaatggccaccacggcgaccgaggcggccaaggctgcaccggcgcaggagcagcaggccaacggcaacggcaacggcgagcagaagacgcgccactccgaggtcggccacaagagcctgctcaagagcgacgacctgtaccagtacatcctggacacgagcgtgtacccgcgggagccggagagcatgaaggagctgcgcgagatcaccgncaagcacccatggaacctgatgaccaccttcgncgacgagggccagttcctcaacatgctcatcaagctc

SEQ ID NO: 75699 - DNA, 373 bp, Zea mays
  Clone ID: LIB3079-023-Q1-K1-E6
acaaaaaaaacacacatacaaccaaacatacaaaaaacacaaaattaataaataggacggaaaaataataacatatgaccatgacacaaatacacaagaatactacaatatctatactatccctttatatatctaactatatattatgaactacttacttctcttggcaagctctataccttaactcgactatgcttttgaaatccttcgcttactatgttccatactcctacagagtgaaagattgatggtaatacgtgcactatcaagacttatctgatattaatatgaatctatctatgacacatctacttggctaacaatctctccgaactcatcaacatattctaccattaatacaactgctcgtata

SEQ ID NO: 75700 - DNA, 400 bp, Zea mays
  Clone ID: LIB3079-014-Q1-K1-G6
ttggcttggacctttgggctgatttagtgcttgtttatgtgcttgagtagtcctcgtccgtctcggggggaaggagagagagagagtgagagagagactcagcagagaggtcagtcaggcggcttctgaatgaagacgccggtggcgcctagtgggtaggcggcggaggcgttggtggagtcggcggtggtgggtagttggatgttgctgtttaagatgaaggtgctgtagtcggcggggtgtccttcggttgttcttgagttggttgcgcttgcgtagtctggtgattatggttattctgttcatctttatattaattaggtgtcttcttgttttaggctgcctgtggttaaagatgaagcgcctcgttcgcctgagggggcgtcggataattcgggct

SEQ ID NO: 75701 - DNA, 366 bp, Zea mays
  Clone ID: LIB3079-014-Q1-K1-G7
ggaacctttggtctgatttatgtgcttgttgatgtgcttgtggatgtgcgggtcgcgcatatggctctttctccttcgctagcaggagagcgagagcgaggtagtgagcaggagataaggggaaacggggaagggagtgtaagggagtgacgtggtggtggtgggtggtgaggcggaggagaatacggtggtgcggtcggccgttaagaatatttctaagactacgtttcctaagtctttgtttgctggtttccacgacgcttgtgcgtgtacgaaggtagcggggacccgtggtagtgacgcgtatcattctagggagacgtgtactgtgtatcctgcggcgaaagaattgacggcgactgggta

SEQ ID NO: 75702 - DNA, 371 bp, Zea mays
  Clone ID: LIB3079-014-Q1-K1-G8
ggctggaaatttggtctgatttatgtgcttagaaaaaaaaaaaaaaaaaaaaaaaaaaaaaaaaaaaaaaaaaaaaaaaaaaaagggaaggaaaaaaaaaaaaaaaaaaaaaaaaaaaaaaaaaaaaaaaaaaaaaaaaaaaagggaggttataacaaaggatttaagtaaatgaatgtgcgtaagtaatggaaagatagcaaaacggggtgattaaaaccaaaccaatcggttatgaatcaaaaatgacattgagcgggaaaattagggatggatttaatcaaaaaggtcggaaaaaaaatttttaacggtatatagatcgaatagtaaaaaggtttgtattgactgtttccataaaaagcagtgtaatt

SEQ ID NO: 75703 - DNA, 334 bp, Zea mays
  Clone ID: LIB3079-014-Q1-K1-G9
cccacgcgtccgcccacgcgttcgcttcagacaccatcgacaacgtcaaggcgaagatgcaggacaaggagggcattcccccagaccagcagcggctcatctttgctggaaagcagcttgaggacgggcgcacgcttgccgactacaacatccagaaggagagcaccctccacttggtgctgcgcctcaagggaggcatgcagatcttcgtgaagaccctgaccggcaagactatcaccctcgaggtggagtcttcagacaccatcgacaatgtcaaggccaagatccaagacaaggaaggcatcccaccggaccagcagcgtttgatcttcgc

SEQ ID NO: 75704 - DNA, 369 bp, Zea mays
  Clone ID: LIB3079-014-Q1-K1-H1
ggacctttgggctgatttatgtgcttgacgtcatctcactcgcatacactcgtcactaagaatcggagatcgtatgtaccgacgggtcgtccgggaatacggacgtagatatcggcgacttctaagccggtcgggatatggactagtctacgatagataccgtataagtcatcgcggccacgctaatcgcggccaagaacggcggatcagtattcgatgcgtcctaatcccgatgttgaacagttgagggaaagtatcgacgccgaggatctgacatccgtctacactcttggaacggatatttcggtttgcggttcttgtaatgttgatgagtcgactgaggaccggcttgcagacgtctctacatgt

SEQ ID NO: 75705 - DNA, 385 bp, Zea mays
  Clone ID: LIB3079-014-Q1-K1-H10
tcgccacgcgtccggtcctcagcgacggtccgggcccaagttctctggaaagggacgcctgggagggtgagagccccgtccggcccggccctgtcgcaccacgaggcgccgtcaacgagtcgggttgtttgggaatgcacccaaatcgggcggtaaactccgtccaaggctaaatacagacgaggagacactctaaactcaaacaaatacatatattgtcggcattagctcttacccttttcacccatgatgacgaagtgccagaagcgcgcgagcatccaaggactttggctcctttccatggttcttctagcgtcgtcctctcttgtctgtgcaagcatggcggtagatgggcaaaccaaagaagacatcaacgcaacgagtg

SEQ ID NO: 75706 - DNA, 375 bp, Zea mays
  Clone ID: LIB3079-014-Q1-K1-H11
gtgacttgctgtgagttcaagtattggttcgaggagaagatgagagaacgctgcagcgatgctccaaacggatctgctcaacatgcctggtcgaccgccctagtttgtgtggtctaccctagacagaattatctgctgtgttggcttgtgtactttgattgtaccccaagtattttgaagttctgaacttatttctgctaattggtgtctgaagtggatatgttgaatgtattttgttttgttggatagagttcctcagcattgccaccgtatgaaagatgaatctattgatcaaccaatttgtgcaaaaaaaaaaaaaacaatatgaaaaattaatactaaaaaattattaatatctttcaatattaaactttt

SEQ ID NO: 75707 - DNA, 407 bp, Zea mays
  Clone ID: LIB3079-014-Q1-K1-H3
ggccctggacctttgggctgctttatgtgcgtggctgattagtcgtgaggtgagactgtgctgtctcctaagtagtcgatggatgttaagtggtagcctatgattgtggctatggataataggacttctaagctggatgcggaggtttctagagctaaggcgaagtcggtggaggatacggcggtgtgtggtgtgtcgctacgtgggtcgggtagatcggggtcgctgttggtgtcgaatttgtggtaggtgcgttgtggttttgatgcgtcgcttgcgcttggttcggatccttttggtgttgatgatgttcgtcctatggggtcgcatttggtggagtagtcgtagtcctagagtctttattcgtagagtactggtggtagctctgagagttcggataattggac

SEQ ID NO: 75708 - DNA, 296 bp, Zea mays
  Clone ID: LIB3079-014-Q1-K1-H4
ttggacctttgggctgatttagtgcttggcttctctagcatttcgacgccaattacgttatagcgaagatccttatcggggagaagttcgcctgcgagtccgctctcgacgatgagcggtccaacggcgaacctactataatcgcttaatagtgcggcgtcgtaactaccaaagtgagaaagcctcttagcgtctctctggtcgtcagtctcgtccgcgattatacctgcgaccgggcctccggaatattcgagggcatacccgcccttacgggcgcgcatctcgacggcctacat

SEQ ID NO: 75709 - DNA, 407 bp, Zea mays
  Clone ID: LIB3079-014-Q1-K1-H5
ttggcctggaacctttgggctgatttagtgcttggagaatcgggataaggccaagatcaccccttccttcatcgagaagttaacgatgctcgacctacgcgtcttcccgaccgtaatttccttaccggaggtatgtggaaaaaccggcgatcctaccaaaggagcgcccgttgctccttcagatccggaccctctaccctccgagacgaacttgcctattacggctaacggggagttacacttctcggatacgagaggagaatcagacgatatagtagtccctaagaatcctaagaagcggggaggcacagaacccttctcattccccggaagagcatctagtttcatagaaagccctacttacgaatcagacgagaagataagcgttctctccaagcctatggccc

SEQ ID NO: 75710 - DNA, 246 bp, Zea mays
  Clone ID: LIB3079-014-Q1-K1-H8
tggccctggacctttgggctgtttagtgctggcgattaggttgtgccggattggacggatgagggcatcgtggctagtgtcggatcttcggagtcgtagttggattcgtggttcggcttgtgggtgtatatgccttgggttttaattgggtctattatcggggtgttcgttacttatgatgtggatcctgggggggtggttgcgcctacgggttttgggtactgtcatgagggtctgtgcctggtc

SEQ ID NO: 75711 - DNA, 386 bp, Zea mays
  Clone ID: LIB3079-014-Q1-K1-H9
cgcggagttcaaggaggccttcagcctcttcgataaggatggcgacggctgcatcactgaccaaggagcttggaactgtgatgcgctcccttggccagaaccccactgaagcagagctgcaggacatgatcaacgaggttgatgctgatggcaatgggaccattgacttcccagagttcctgaacctgatggcaaggaagatgaaggacaccgactccgaggaggagcttaaggaggcctttcgcgtcttcgacaaggaccagaatggtttcatctcggctgctgagctccgccatgtcatgaccaacctcggcgagaagctgactgacgaggaggtcgacgagatgatccgtgaggccgatgttgactgcgacggccagatcaac

SEQ ID NO: 75712 - DNA, 403 bp, Zea mays
  unsure at all n locations
  Clone ID: LIB3079-015-Q1-K1-A1
gagataccatcttgtccttcgcttccagatcctagtttttcaagagcgacacacttggatgttgttgctgttaagcttccctgtactcgtgtggcgggttggtcaagagatgttgcaaggctgcatctgcagttgtcagcagcaaaattagcagcagccacagcaagaggcaatagaggaatccatgtgctgtttgtgactgattgcttcccaattccaaacctcttctcttgcaaggacctagtgaaacgtgaaggcaatgcttggatgtacaaacctgacgtgaaggctctaaaggagaagctcangctgcctgttggttcctgtgagcttgctgttccactcaacgcanaagcacgactctacacggtagacagacgcagagaagcatatgctacaatac

SEQ ID NO: 75713 - DNA, 423 bp, Zea mays
  Clone ID: LIB3079-015-Q1-K1-A10
ggcggcggtgctgctgctgcagcacggtggagccgcgagcgccggcggcaacttctagcagacgtggacatcacctggcaccaccgcctcatcctgatagtcgacaacctgctcttcctgatcccggctatcaacaccagctccgggacctgctgcgtgcccgagtgggccatcccgcacagccgcttcgacatgcagctcaagctcgtgaccagggactccgccggcaccgtcgccaccttctatctttcgtcgcagggttcgcagcacgacgagatcgacttcgagttcctggggaacgcgagcggggagccgtacacggtgcacacgaacgtgtacagccaggggaaaggcgggcgggagcagcagttccggatgtggttcgaccccacggcggccttccacgcctactccgtgctgtgg

SEQ ID NO: 75714 - DNA, 428 bp, Zea mays
  Clone ID: LIB3079-015-Q1-K1-A12
tgctctttctgcatgtgttgctaacgcgacaattttccctcaatgctcacaagctcctgtagcttgccttcttcccccataccttccatcaatgatagcttcagtatgtgaaaacccagctcttcagccctataggctccaacaagcaatcgcagcaagcaacatacctttatcacccttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcagcaacaacaac

SEQ ID NO: 75715 - DNA, 394 bp, Zea mays
  Clone ID: LIB3079-015-Q1-K1-A2
cccacgcgtccggctcctcctcgtcgttacagatctggggacgaccaaggtggctgagactaggcactgcctgtcgcagagccacctgttcaagggcctgtgcatgagcagcaacaactgcgccaacgtgtgccagaccgagaactttcccggcggcgagtgtaaggcggaaggcgccacgcgcaagtgcttcttctagaatatatgctagtagtagcctcagctttgctggcacaagcacgtctttagcacgcaacgcaattcaagcatcatatcggtcctcctgccgcgttgctgtctactttgaccccgtattttttttctatcgatttctttgtttttctgttgctctcttattttcccccgaataatatgcttcatgggatctcactgt

SEQ ID NO: 75716 - DNA, 428 bp, Zea mays
  unsure at all n locations
  Clone ID: LIB3079-014-Q1-K1-G5
ggacctttgggctgatttatgtgcttgtcgggaactttggtaggtaaagtgaaagtacttgtgtgagaggtgctgtgcgccttcggtcctgcttctatgcgttgcggtttccttgtcctttttgcacttgtttgcttcgcctttgttttgagtgaattggtggtggtggaggtgacgtagtatgagttgcggtggttcggtgtcgagtttgttgttggggtcggggtgggtttcgtctttattattgctgatgaggtacttacggagtggagtacgagtcctgctaaggtgtcctaggagtctaagaattcgtgtttgtagtctcatctggttcttgagcatcgtgagaagcttcattcntgtagtgaatagaaattagcggcgtcggataatacgaaagaccatgtcgctagggtttcggctaatgt

SEQ ID NO: 75717 - DNA, 421 bp, Zea mays
  Clone ID: LIB3079-014-Q1-K1-E9
cttggatacaagaggtccaagtcgaaccagtacgagaccacgtctctcgtgcagatcgagggggtgaacaccaaggaggatgtcgcgtggtacgctggcaagcgcatggcgtacatctacaaggccaagaccaagagcaatgagacccgctacaggtgcatctggggcaaggtcacccgtccgcacggaaactcgggcgtcgtccgtgccaagttcatgtccaacctcccgcctgagtccatggggcgcaaggtcagagtgttcatgtacccgagcagcatctaaggttttgttggagtaaagatggactagaaatggccatgtgtttatttctcacttttctctgaacttaaaatgccttgtgttggtaacttaaattgttcaagtgctgaacctgtggaagttgtgccaaaatttggtg

SEQ ID NO: 75718 - DNA, 294 bp, Zea mays
  Clone ID: LIB3079-014-Q1-K1-F1
ttggcttggaactttgtctgattagtgcttggatagatcggaatatgggtttaccatccctatcgtacggccttagtggctagtcttgttgcgcgttggtaaggccagccagcaagggcatatcatatttatactttactttactttacgtgcgttatgatgaacgaaaacatcagttcgctagatctctctctcgttgttaacactctctcgtcagttctcgccattctatcgatgattactaattaccagctctattcggatgtaaatcgtaacagtcaatcggttaatctg

SEQ ID NO: 75719 - DNA, 333 bp, Zea mays
  Clone ID: LIB3079-014-Q1-K1-F11
gtgtactccctggactacgctagaacaaggttggctaatgacgcggaggctgccaagggaggaggtgaaaggcagttcaatgggcttgtcgatgtctaccgcaagacactcaagtctgatggtattgctgctgggattacaaaaaaaaaaaaaaaaaaaaaaaaaaacaaaaaaaaaaaaaaaaaaaaaaaaaaaaaataccaaaagcaaaatacaatacaaaaaaccactgtactgtaacatcaactacgcaactcaccaagcacaaatttgcgtgctcaactactccagtttgaaaaatcccaacaagaatgatatcggcgccttatatga

SEQ ID NO: 75720 - DNA, 343 bp, Zea mays
  Clone ID: LIB3079-014-Q1-K1-F12
ccaagagcagcagcagcagcagaccaagatcgagggagggaggaagacagacggacggacagagagatggagcggatgagctcgtcggtgcagtcctgggtggaggaacacaagctctcgtccatcggagccgtgtgggcgacggcggtgggcgcgtccgtggcgtacagccggcggagggcgccggcgcgggccacgagcctgcgcctcatccacgccaggatgcacgcccaggcgctcacgctcgccgtgctcgggggagccgcgctcgcgcaccgctattacggcagcagcgagaggaggcagaggcaggaggacctggactacggcttcaaatcccagc

SEQ ID NO: 75721 - DNA, 348 bp, Zea mays
  Clone ID: LIB3079-014-Q1-K1-F2
tttggtctgatttatgtgcttgaaaaaaaaaaaaaacaaaaaaaaaaccccaacaaacaaaaacaaaaaaaacaaaaagggaacgggccaaccaaaaaaagcgaacacgaaaaaaaacagcacaaacaaacgaaaaaacaaaaaaaaaaaagggttttttttcccaaggggtttaattcctttcttttccttactttattccaaatttttttcaacgggttttttaaacttaaattttggttttttcccctatttttcccattttggaaaattttggggtccttttaactcaatttttccgtaattacctttttccccttttgccgtttaaaactttaaaggtttttt

SEQ ID NO: 75722 - DNA, 359 bp, Zea mays
  Clone ID: LIB3079-014-Q1-K1-F3
tggcctggacctttgggctgatttatgtgcttgtttatgtgcttgaccctgtctctgtacgctgtaagttattgacccgcccataggtgtgggagtctttgatgatgatcgagttacgcgtggtggtgtgacttccgttgagtcttgtgagttggtgttgtgttggtctatggagtgggatactcggtagtagaagaagaagtttaagaggggtggtgttggtgggaggtgtctgcctgtggtggaagatgacgaggatcctgaggttgatcctgaggatcccgaagttgatcttggcgacctggacccggagtctggggaaagggtcgatgatgatgctactgagactaagtttcctg

SEQ ID NO: 75723 - DNA, 432 bp, Zea mays
  Clone ID: LIB3079-014-Q1-K1-F4
gcttggaacctttgggctgatttatgtgcttgcttatacttagccgcgggggtcaacttgacctttatcgtttaaaatttcattcttacgttcgtctgtatgttcgtggtccttctctagtagaatggcgttataatttagatacccttagcctggtgtagcggtaattgcggaaacggcagtaacggcggtgctagggtcgttaacagcagtggaggcgatgggagtagtggtagcggcggcgacggcaatcggaacgacggaagttccggcatcgatagtggccgtaatagtagtaacggtgacggctttactaacccggacgacaacgctttcggtatctgccgcgtttgcgggaacgataacgatagtagtagaaacttcctcggtaacggttatcggaattataatacatgagggggcggcggcggc

SEQ ID NO: 75724 - DNA, 346 bp, Zea mays
  unsure at all n locations
  Clone ID: LIB3079-014-Q1-K1-F5
tggacctttgggctgatttatgtgcttggaaggacatcaggcatattgaacgagtagagccggttaggagctagccgcccgttcgatcctaagatagtcccttttaggcggtaagtctaggcaaggtaatagtacaagtaccctgtcgggtatacgcggtaagcgtaccgcgcacttctacttacagtccataactcgcgcccgctacacacacttgacgttcntaccataggattcggtaatagcagctttaaactccgatttcgtcgggccggattcctctctcaaaacgtcctgacatgagttaagtaaaagaactatagtgaggntagtatccgagtacgag

SEQ ID NO: 75725 - DNA, 390 bp, Zea mays
  unsure at all n locations
  Clone ID: LIB3079-014-Q1-K1-F7
gcttggaacctttgggctgatttagtgcttggactcgcataacacgaagcatctgagtcatccaaatgatgaattaacgttggacgtcgtactggaaaaggagtagggaaacgagcaccctaaatagaagaagcctatcgacgtcaccgaacgtcatcttagaagcaccgggtcgctcttcatagtagctatacccgtaaacagagtcacggtacactccaaatcaagaagacctaaggaggtagaggatgaccgtatcgaagtctcgaactcggacgactgtcacaccaaagtacatctatgttgaaccatcgtatgaaaagaatccgggaagtcnaaggaggtaacggacgacgtcgaaaccgtcactagctccgacttaaataacct

SEQ ID NO: 75726 - DNA, 393 bp, Zea mays
  Clone ID: LIB3079-014-Q1-K1-F8
tggcctggacctttgggctagtttatgtgcttgtatagacgacgatgttcaatacgacgctattaccgacgacgttgagtacgacgctattaacggctccgttgagtacgacgctgtaaacgacgacgttataacgctatcgtgatgttgctctgtagaccacgtcgtaatagtagccattacctacgcctaatttaacggttacgatgaccttatttacgcctccatagtaatttcccgccggcgtcgtacctcagacagaaacacccgcgccgcattaaacaacgagccgatacgttactgtgcgcgatctaccaccaccaataacaaaataagcccttccccactaaaaaaaaaaaaaaccaaacaaaaaaaaacaaaaaaagaaacaaa

SEQ ID NO: 75727 - DNA, 352 bp, Zea mays
  Clone ID: LIB3079-014-Q1-K1-F9
aaactggcgaattgcgacgttggcggaattgtaatggcaataattccttcctccttcgttccccatttctcctctttctaggtttctacccctcatcggtcctcgctccacggccatggtgaggatgaagcaggtaaagatctcggtaaagaaggacgtggattcgtacacaatccgcggcactaacaaggtcgtccatgtgggcgactgcgtgctgatgcgggcgtcggactcggacaagcagccgtatgtggcgcgggtggagaagatggaggccgacggacgcggcagcgtgcgggtgcaggtgcgctggtactactcgcctgaggaatccaaaggcggtcgccggcag

SEQ ID NO: 75728 - DNA, 314 bp, Zea mays
  Clone ID: LIB3079-014-Q1-K1-G1
ggcttggacctttgggctgatttagtgcttggcgggggaagagacgacgtgggagatgcatacggatgcgtcgttgctggcggagtatacagttgatctatggagtggtggtcggcctttgggtgtggtgtgctctcggatggtggtggagaataagtagcctgagtgggtgtcggttgggtctgattctcgttgtttggatcgggagaaggcggtgtgggttactttgggttggatggcgtgtgaggcttctagttatcccaagagttcatacgctgatgcctagtagactgagagtggctaggagtttacgt

SEQ ID NO: 75729 - DNA, 412 bp, Zea mays
  unsure at all n locations
  Clone ID: LIB3079-014-Q1-K1-G10
ctttccccgtgcttctccgccgtcgagtgccgcgtcccagtgcgaagagactgcgacgcagatggccagccgctgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactactngctactggggattntacactttgctggcaactcaatatgttggggacattcatg

SEQ ID NO: 75730 - DNA, 283 bp, Zea mays
  Clone ID: LIB3079-014-Q1-K1-G11
ccagctacacccacgcatcctacaaaaaaaaaaatacaaacattataccttaaacaataaacaacaacacaacaaagacaaattaaaaacaaatcaacacctacatcactaacaaacccaccaaaatctaaactcaaaaacctctaatacattaccctaaaaacaaagacttcccagatcaataaccttaccttcacttataaaaccatcatcatccccatcaacatcaactacaccattaaccccctattacactacctctgcatactctgcaaccacaaca

SEQ ID NO: 75731 - DNA, 391 bp, Zea mays
  Clone ID: LIB3079-014-Q1-K1-G12
ttgttttttcttttttttcttttttttttttttttttttttttttttttttgttttgttttttttttttttggcaaaaccaaaaagctaaaatttttttacccttgggaaaagcgtttcaaaactggtgacggtaaaaatggccatgataatttttttgcaaaaaaaacccccccctttttacaagaaacgggggtttttcaaaatggcttttttaaaggtttcaaaccccgtgactgcttttttggcaccctatcccaattcctttggcttcgggaaatatgcccattgtacagcccccgcttgggaaaggccttttcccaatgaaaagcatttgccttttgggcctacccatatttgttccggaccaaggggaaaaaaggccccccccg

SEQ ID NO: 75732 - DNA, 171 bp, Zea mays
  Clone ID: LIB3079-014-Q1-K1-G3
ggccctggacctttgggctgctttatgtgcttgatgcgataccgacggcggcggcggcggcggaggaggaggaggagtatccgactgcgcgacggcggacgggggcggaggcggcggtggcggagtgaccgtaccgccacccaattccggaagcagaggcggaggcggagg

SEQ ID NO: 75733 - DNA, 338 bp, Zea mays
  Clone ID: LIB3079-014-Q1-K1-E8
ctttgggctgctttatgtgcttggaggacgtagttaataatcctgtctgcggctatcatattaccggtaaggagaccgccgattcgcgttccgattgtactaggaagtccgtagacaaccgtatcggctcttagggtccttctgctcctaatgtcgccggcggaggaatgggtctcgggtccggcctctcttcttcggagtgttcgctcgccgatcacggtaagaagcttaagtctggccctattgcgcatttacttttttaggcgcttatacttgcggccgagttacataatagcgcttcgcttatttatctctcttctgagtatatcgacgccgtc

SEQ ID NO: 75734 - DNA, 334 bp, Zea mays
  Clone ID: LIB3079-014-Q1-K1-G4
tttgggctgatttagtgcttgtattagagaggacgccacgggactataccacccacaaattaacatgggtaacgtccggaggatgctcaagacccgcctcccgcggcggcgtattctcgctaagcgatatataaagacccacgaacacacgctcaggcgctttagcgggctaaggtcacggaccgatcgaaatccgcgtcggagtagtccctatcgaacgggacgacataagcgcgggctgcgccggcttaatatccttccgccgtcacgcgaagtccgctctacgggaagaaggcggccataagaccctcgacctcttaacgttgagaggaga

SEQ ID NO: 75735 - DNA, 404 bp, Zea mays
  Clone ID: LIB3079-014-Q1-K1-C11
ctgcgccgccgcctccgacatcgtcccttcgtccccacgagcaaccgataatgcgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaatcatttgtgtcttacatcaaaaaatacatcaagaatctcactgctgtgttggagccagagaaagcggatgagttcaaaaagggtgt

SEQ ID NO: 75736 - DNA, 382 bp, Zea mays
  unsure at all n locations
  Clone ID: LIB3079-014-Q1-K1-C12
caccatcgtcctgccgatcgatcgcattcagccagtcttgctgagagacgagctgaagcctgaagtgaaccgatcgatcgatcgatcgagcgagcgagctcccatgaaggcgttgattctggcggcggtgctgctgctgcagcacgggggagccgcgagcgccggcggcaacttctaccaggacgtggacatcacctggggcgacggccgcggcaagatcctcgacaacggccagctcctgacgctgtccatggacaggtcctccggctcgggcttccagtccaaggcccagtacctctacggccgcttcgacatgcagctcaagctcgtcccgggggactccgncggcaccgtcgncaccttctatctttcgtcgcagggt

SEQ ID NO: 75737 - DNA, 70 bp, Zea mays
  Clone ID: LIB3079-014-Q1-K1-C2
ctttgctgatttactccttgaacaaaaaaaaaacaaaaaaaaaaaacccaacccaaaaaaaaaccaacaa

SEQ ID NO: 75738 - DNA, 410 bp, Zea mays
  Clone ID: LIB3079-014-Q1-K1-C3
ggcttggaacctttgggctgatttatgtgcttgtttatgtgcttgtttgtgttggactgcacggagggtaggtggatgaggaggagggacgagctctcctgggtccggatgaaattagaagataccttgttttaagaagagtgtcttactaggcagtaagggagtatagtcttgaaagtatacagacgttatctctggtagcggaaattccagggaagtcgcgaggccgttcttcggagaggacactaacgaacggtccgtggcgaacatcgcggaccctcccaattaagccaacacgtcgcacggtatatctatagaaccccgtatattcgagagtcgcttgataacgatagtcggtttaaagcatgagcatagacgggtcgacggcgcgtagacaaagaaatttacag

SEQ ID NO: 75739 - DNA, 107 bp, Zea mays
  Clone ID: LIB3079-014-Q1-K1-C4
ggacctttgggctgatttactgcttggggagtccttcgatatgtctaagtcccctgagcgtgctgatgctgacgggtttgagggaggtgaccaggctagtgatcata

SEQ ID NO: 75740 - DNA, 78 bp, Zea mays
  Clone ID: LIB3079-014-Q1-K1-C6
tggcctggaacctttggtctgatttagtgcttgggaggatggagagtgttagtgaggacctacggagttagataaggt

SEQ ID NO: 75741 - DNA, 413 bp, Zea mays
  Clone ID: LIB3079-014-Q1-K1-C9
cagaagcggcggcggcggagcaaacgctatgcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgcttgctgagggtcagaacaagcttgattatgttcttgccctcaccgctgagaacttcctcgcaaggcggcttcaaacacttgtcttc

SEQ ID NO: 75742 - DNA, 360 bp, Zea mays
  Clone ID: LIB3079-014-Q1-K1-D10
gtcttcaagcgctacgatgacctgccgacccggacgccaagcccatggcggtgcaggccacgctgtgggacggcagctactgggccacgcgcaagggcgaggtcaagatcgactggtccagcgcgcccttcgtcgtctcctaccgagactacaccgccaacgcctgcgccgtccacggccggaacggcggcggcagctcgtcgtgccccgccggtgccaacgagtggatggacaggcagtccgacgacaccgaccgtctcaccgtggcttgggcgcgccggaactgcttgcagtacaactactgcgatgactggtggcgctttccgccagggttccccggaaagtgcgcccgcaactgat

SEQ ID NO: 75743 - DNA, 359 bp, Zea mays
  unsure at all n locations
  Clone ID: LIB3079-014-Q1-K1-D12
gtcgcggtagccggcggcggcgcggttgaaagcaggcaggccatggcgtcggggtcgttttcgaccccggcggccgtccgcgagatgcagaaggatctcgaggtccaggccaacgccctcagcaagatccagaatgacatcgtcaagaaccaccaggtccgcaagcagtacaccatccaggtcggcgagaacgagctcgtcctcaaggagctggagctgctcagcgatggggccaacgtgtacaagctcatcggaccggtgctggtcaagcaggacctcgctgaggccaaggccaacgtcaagaagcgcatcgagtacatctncgcagagctgaagcggatggatcgggcgctcaaaga

SEQ ID NO: 75744 - DNA, 355 bp, Zea mays
  Clone ID: LIB3079-014-Q1-K1-D3
ggctctggaacctttgggctgatttatgtgcttgtttatgtgcttgcggggacgaacttcccgaacttcctacgctagagaaggacggcacgtccctactgccggtctggtgcgtaaaggtcccggaagaagtacctaatagcccagaaggaaccatacgtaataaagttgaaggcgtaacgcactcgcctttatgttcctacccattttagaaggtaaccggagtagtttaagtagctggtatcgtgttagacgtacatcatgtaaaatgttcatcggaagttatcggaactgctgctgcttttggcctcgggcccggataggctttcggaatgcggtatcctaggcgtatgac

SEQ ID NO: 75745 - DNA, 379 bp, Zea mays
  Clone ID: LIB3079-014-Q1-K1-D9
accacttcaacactatgttcaagtacatcggaagtctatatctcctagcaactgatcaaggttttataagccaaactgatttggtatggcagaggttggatgaggtgaatggagatgggggttttcttactagcaacttcacaccatttaaggctgaaactccaagaaatgattcatggaatgaacagcaagctatgacgagtactgctgattatcttgctcaatttgacaactccacttctggaaactctgatctggagctagctatagcacttcaacagcaagagtttgagcggcaaccacaaaggttccaagctccatcaccacagcagcagcaacaacaaccactacctcagacgcagcaccaaccagctcaatc

SEQ ID NO: 75746 - DNA, 411 bp, Zea mays
  Clone ID: LIB3079-014-Q1-K1-E1
ctttggtctagattatgtgcctgtaccctctagacgtaccgacaccgaatacgcactaaacacgcgttacagtaagggagtgccgtcccgcactgattgcatccccgttcgtttcactaactagaaagtatcgatcccaggtgtcgattcagccacctacctcgtaataaagcataccgtcggatataatgacgccaccggaggacgtgctagcggtagaaacgagccggcccttaaagcttgcacccactattacgcggccggcggcgcctcaaatttgaacgtcgtgcattccacttcctgaggtacgaaaatatcctactcttgcgcgtaacgctagaacaatatcgtctcctggacggtttagcccccagaggaatactcaaagaccgtttgcgctcatcacttcgg

SEQ ID NO: 75747 - DNA, 423 bp, Zea mays
  unsure at all n locations
  Clone ID: LIB3079-014-Q1-K1-E11
taccggtttcggaattcgccgggtacgactccacgtcgtgccggtggccaatgctcacaatcnttgaaactcctgtattcaaatnnattggtcaagggtacctttaggtgagttggctgnnctgaaaccctcccaatngnnaaatgactggnntcatggacctcataggtactcttagagtagcttgagactatgactgttattgggtacctctgtacaaatgtattccgcataaacgctttaaacttgagggcaataacttagtgtgtcgtatctcttatttgtttgttctctttcagacgattacctagaaagcgctagctanagattcagagctcgtaaatgccttagaaatgccaacatgtgctagaattcgtgtctagtaaaaataaatacctcnntctcagttaagaaaataaaaag

SEQ ID NO: 75748 - DNA, 262 bp, Zea mays
  Clone ID: LIB3079-014-Q1-K1-E12
gcgcggacgcgtgggccctagcattatagcttctcgtcaacacacctaaatctgcggcccggctagagaagatacgatctctatgcagattagctgcagcgatatatatagatggatgaatcgtgcaagcggttgaactatggtgctggaatctgtaatatatataagcggatcatccaaagtgcaaaacatataagttttgcattgccaaaaaaaaaaaattaaaaaaaaaaaatattaaataataaaaataaaataaaaa

SEQ ID NO: 75749 - DNA, 275 bp, Zea mays
  Clone ID: LIB3079-014-Q1-K1-E2
tggacctttgggctcgatttagtgcttggtaggcccctgccccatttaccccggccctccggccgttataccactcaacgattcagtcggtacatccacaccgtaacagtacactccgaaactcggaacacccgattattattcttctagtcattcggccgtacgttatagactcgaaacctcgaaacgtcgcgatcgcgatcgcgaggcacgaaaaaatagcgcaaacaatgtggccgttcatgcatacgcgcgataccccacatatgcgtaag

SEQ ID NO: 75750 - DNA, 373 bp, Zea mays
  unsure at all n locations
  Clone ID: LIB3079-014-Q1-K1-E3
ggccctggacctttgggctgatttatgtgcttgtttatgtgcttggagtccggctctcccgttacccccgacggttacccaggagacaaggcgttaagccatccgaaagtcaattcccccagtaatacaacgaaagagttctctcctcggctcagtttctaagaagtaacaaagaacgtacatcgtctcataaataagcacacctcagaaaacattaaataatccggattaagcggcctgatagtagccatcgtcaccgcagccgacggcaaggatacgcggacagtaaacgcangtgatctcagagtcgccgcgcgcgaaagaggtctcgtcaagtagtctatcgccgattacgagttttacgaaatcaacg

SEQ ID NO: 75751 - DNA, 391 bp, Zea mays
  Clone ID: LIB3079-014-Q1-K1-E4
tggacctttgggctgatttatgtgcttgtttatgtgcttgggatgcgttggttaatgatgagctggtgtctaagaaggtggcggtgtattagtttgcgcttgctgttactgaggttagtggtctgtatccttagcctcatcttgagggggctcctcttggtaggcgtgggatggagtcggattatggtgctgtggtggctggtcatggggctattgtggatggtattaagcatcggtcggctaagaatctgcggggttttgagcggggtgagaaggggcatacttgtacggtgtgtgatgcggttgttaaggagggatatcgtggtactgttacggaggtacctcatcgtgctaagattccgtttaattttaaggcttatgttgctgctca

SEQ ID NO: 75752 - DNA, 322 bp, Zea mays
  Clone ID: LIB3079-014-Q1-K1-C10
gcgaaaccgattcaacagatagtgatgaatcaagcactccctgcctgaaaagtgtcgactcgaatctgggtgccatgcctaatctggagcagatcaatgctctgatcaagcactacggcccaaccgttttcttccacccgcaagagacgtacttaccgtcatcagtttcttggttctttgagaacggagctacattgcacgagaaagacgcaaaaatgggagatgcaatactccctggtggcttgaatctgcctgttggtgggacaaacgatggcgagtactggattgatctccctgatgatgacaggaaagagctcgtcag

SEQ ID NO: 75753 - DNA, 353 bp, Zea mays
  unsure at all n locations
  Clone ID: LIB3079-014-Q1-K1-E5
tacggactcctaatacgcactaaacacgcgttacagtaagggtgtgacgtcctgcactgattgtatccttgctcgattcactaactacaaggtatcgatcccaggtgtcgattcagccacctacctcgtaatatagcataccgtcggatatagtgacgccactggaggacgtgctagcggtagagacgagccggcccttaaagcttgcacccactattacgcggccggcggcgcctcaaatttgaacgtcgtgcattccacttcctgaggtacgaaaatatcctactcntgcgcgtaacgctagaacaatatcgtctccctgacggtttagcccccagaggaatactcaaaga

SEQ ID NO: 75754 - DNA, 202 bp, Zea mays
  Clone ID: LIB3079-014-Q1-K1-E6
tttgtctgattagtgcttgaaaaaaaaaaaaaaaaaaaaaaaaaaacaaaaaaaaaaaaaaaaaaaaaaaaaagaaaggaaaaaaaaaaaaaaaaaaaaaaaaaaaaaaaaaaaaaaaaaaaaaaaaaaaaaaaaaaaacaaaaaaaaaaaaaaaaaaaaacaaaaagcaaaaaaaacacataacaggcaaaaacccaaaaa

SEQ ID NO: 75755 - DNA, 408 bp, Zea mays
  Clone ID: LIB3079-035-Q1-K1-C9
cccacgcgtccggcggcggctgtgggaggcctcgggcggacgccgacatggaaggagcgggagaacatcaagcgccgggagcgccggcggagggccatcgccgccaagatcttcacgggcctccgcgcgctcggcaactacaagctgcccaagcactgcgacaacaacgaggtgctcaaggcgctgtgccgcgaggcggggtgggtcgtcgaggactacggcaccacctaccgaaagggatgcaagccgccgccagggatgatgagcccgtgctcgtcctcgcagctgctgagcgcgccgtcctcgagcttcccgagcccggtgccgtcctaccacgccagcccggcgtcgtcgagcttcccgagcccgacgcgcctcgaccacggcagcggcagcaacagccacacc

SEQ ID NO: 75756 - DNA, 415 bp, Zea mays
  Clone ID: LIB3079-035-Q1-K1-D1
cgcgcatcgaatcgccaccagtgccgattctgctgacccctcgccatcgccggcgggcgaatcgacaccatggccgccgcacgccggggccgcgccgacggtgccaacggcgtcgtccgtccccgcccccgcgaccgtgtcgtcggcgtcagcggaagcatggcggggcgcgtggccgtcctcgccttctgtgtcgccgggatctggtccgcctacatctaccagggcgtcctccaggagactctatccacgaagcggttcgggccggaggcgcggcggttcgagcaccttgcgttcctcaacttcgcgcagaatgtcgtatgcttcgtctggtccttcctaatgactaagttgtggtcgggcgggagcgggagcagctccgacggccgtgcgccgctatcgaagtactggggcg

SEQ ID NO: 75757 - DNA, 448 bp, Zea mays
  Clone ID: LIB3079-035-Q1-K1-D10
ctccactacaagggctccaccttccaccgcgtcatccccgagttcatgtgccagggcggggacttcacccgcggcaacggcaccggcggcgagtccatctacggcgagaagttccccgacgagaagttcgtgcgcaagcacaccgtccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccaccttcaaggtggtcaaggtcgctgactgcggacagctctcctagatctctctgatctggtctgttcggccgacctaccttcgtcatcgtcgactccccctgcgtccgttcctttggatctgaataagat

SEQ ID NO: 75758 - DNA, 380 bp, Zea mays
  Clone ID: LIB3079-035-Q1-K1-D11
ggtctccaaggacgcgtccgatgatgacctgaagaaagcctaccgcaaggccgtcatcaagaaccaccccgacaagggcggggatcccgagaagttcaaggagctagctcaggcttatgaggtcctcagtgatcctgaaaagcgggagatttatgatcaatatggtgaggatgccctcaaggagggaatgggaggtggtggagggatgcacgatccctacgacatattgcagacattctatggtggcggaagcccttttggaggcggtggcatcagtatgtgcacaaggcagcgaatgggataagatgtggttcatcctctaaaggctactctggaggatttgtacaatggcacatcaaagaagctctctatgtcccgca

SEQ ID NO: 75759 - DNA, 214 bp, Zea mays
  Clone ID: LIB3079-035-Q1-K1-D12
ctccatgtatacatcaacgaccatcctggctacaatctacaacttctcaaacctgggtcagatttacctcactcgtgtctacatctacatcatcatattaatcaccatcagcctctaccactcaactagcctcctcgaacatcattcattacacactaccatctctatcaaattactcagcctttcatcaagactcaattctcccaatatatac

SEQ ID NO: 75760 - DNA, 434 bp, Zea mays
  unsure at all n locations
  Clone ID: LIB3079-035-Q1-K1-D2
cccacgcgtccgcccacgcgtccgcttgtgttgttcggagcgggcagcagcacacagccgcatcccaatcctagtcgatcttcttcccctcctcaagccggttccttcgtccacacgaccgcgcgctcggaaaactccgcggagggcgaaggaggcgaaccaagggcgacgtatccgccgccggagaaggtagccctcgatccgccgtctcccgcgattcgtttgtcttgcgacagctgggcgaccgtcgtcgccgccgcccttctccaggtgcccaggtcttcgccggtccctttgccgcctgcttgccgacgacgagcaccagccagaaaagaagctgaaccatggggaagagaaagtcagctgctaagccacctnctaagaagcggatggacaagcttgacactgtcttttcctgcccattctgcaaccac

SEQ ID NO: 75761 - DNA, 455 bp, Zea mays
  unsure at all n locations
  Clone ID: LIB3079-035-Q1-K1-D3
ccacgatcccgacaattggattcaacgttgagacggtgcagtacaacaacatcaagttccgagtatgggatcttggtggtcaaacaagcatcaggccatactggcggtgctactttccaaacacccaggctatcatatatgttgttgattcaagcgatacagataggcttgtaacagcaaaagaagaattccatgccatccttgaggaggatgaacttaaaggtgcagttgtccttgtgtatgcaaataagcaggatcttccaggtgcactcgatgatgctgccattacagagtcattagaactacacaaaattaagagccgccaatgggcgattttcaaaacatctgcaataaaaggagaggggctcttcgaaggtttggactggctcagtaacacgctcaaatctggaagcagctaaggagcctncgtctcgtcatgaatcatttgctggatg

SEQ ID NO: 75762 - DNA, 405 bp, Zea mays
  Clone ID: LIB3079-035-Q1-K1-D4
caggatgatatgaacatggacatggacccatatgttagcctgcctcaactgaaacaacatggacccagacattagccgctcttgtgctatcacaatggctgtgactctgtgagtatctttacagttatgctcgttatacccctgtggtgtacctgtttcgatcgtcttcgaccaaatgtcacgtcgactgcagtctccagttgttaatacagtctgttcagcacgctgatttaagtatttgggtcaagatgttcatataatcctgtggtatccagagatattatagtttgttttcgtaactgtttgcgcagagaccatgctatgttgcctgcaggctatcagtgtatttgttctaacagatcgcaacgcttgtacaacgcattgacctgccagactgggccacta

SEQ ID NO: 75763 - DNA, 367 bp, Zea mays
  Clone ID: LIB3079-035-Q1-K1-D5
gtacgcctccaattcgttctgaacaggcatgggttaaatcgagcaagcaatgacacgaggagagggatcatacgaagcatagcgccaacaagaccaccggaagctaggccgcacgcaagcacctgggcacgaaggtggccaggaagtcggcgccgacgaccgcacgcacgaacaagcccgacaagtacaggcacaggaccatggccctgaccgagatcctgaagtacaacaagagctcccagctgatcatccagctgttgatcttgcagcgcctgttccatgagatcgttcacgacatcaatacggatttgcagatgcagatgcacgcccagatggacgtccaagaagccgtcgaggaatacctcga

SEQ ID NO: 75764 - DNA, 453 bp, Zea mays
  Clone ID: LIB3079-035-Q1-K1-D7
acacgatcccgacaattggattcaacgtttttacggtgcagtacaacaacatcaagttccgagtatggtatcttggtggtcaaacaagcatcaggccatactggcggtgctactttccaaacacccaggctatcatatatgttgttgattcaagcgatacagataggcttgtaacagcaaatgaagaattccatgcgatccttgaggaggatgaacttaaaggtgcagttggccttgtgtatgcaaataagcagtatctttcatgcgcactctatgatgctgccattacagagtcattataactacacacaatcaagagccgacaatgggcgattttcaaaacatctgcaataaatggagaggggctcttcgaaggtttggactggctcagttacacgctcaaatctgtatcagcttatgagccttcacctcgtcatgaatcatttgctggat

SEQ ID NO: 75765 - DNA, 446 bp, Zea mays
  Clone ID: LIB3079-035-Q1-K1-D8
ggtggatccacacacttcttgaccagcagagaaggtggagggtggattaatgctgcaaaattctggactggtgcatcggccatgggaagccttgctattccagcaattctgaggcatgctggcttaatcgagaccggggccatgttcatcgagttcacgtccttcttcatccttgtatgcacagtgctgtgcttccatagggcgactctggatgaagactggtaaatgcgcatttcaccgacaccctgaaccctagcggttcttggctgcttctgtccatgctaagaaatattcctgttggaagctaacatggatctgtacaaagaagcgtatttcgagcgtagccgtagctgatgtcttatgtagacacttgtgaagattatgtggtcatgtggcaatgcagatgttattaccttcactttgactttgtcgtcacatgttctatg

SEQ ID NO: 75766 - DNA, 419 bp, Zea mays
  Clone ID: LIB3079-035-Q1-K1-D9
cttcaagcagctaacataattaactcatgggtgcatagagatatgccgtcgacgacccatgatatctatggttacttattattgggcatggagcacgtcatctcaatggaggagatcctcgggcccttctgggagctgctaccaccgtcagcgccagagccagagccagagcgagagcagcctccggtaaccggcatcgtcgtcggcagtgtcatagacgttgctgctgctggtcacggtcatggtggcggcgacatgatggatcagcagcacgccacatagtggacctttgagaggttactggaagaggaggctctgacgacaagcacaccgtcgacggtggtggtggtgccgaactcttgttgctcaggcgctctaaatgttgaccggccgtcggtgatggaagaggcggtaatgat

SEQ ID NO: 75767 - DNA, 274 bp, Zea mays
  Clone ID: LIB3079-035-Q1-K1-E1
taaaaaaaaaaaaaaaaaaaaaaaaataaatattaaaaaaaaaaaaaaaaaaaaaaaaaaaaagattaattaaaaaaaatcaatataacatatcccataacctcatacactttcatacttccccttttctctttcattctttcatctctattctttcctcttccctacttttttcaatttcttctctattaaatccctttccctcccctacttaatttcctttccatatatcactctttttccaacttcttttttacccaatcttccttctcca

SEQ ID NO: 75768 - DNA, 459 bp, Zea mays
  Clone ID: LIB3079-035-Q1-K1-E10
cgcgtacccggcgaggagctcaagccggcgtacatggtcatctcctcgccgcctaaagcggggccccggttcgaattcctcgtcaaaagcgtgccgggagctaccgcggggcggctctgcgccctccgagacggggatgttgtggagctcggcgccgtcacggggaaggggttccccctcgacaggataaatccgcccgacgtcgcgcagaccgtgctcatcttcgcggcggggacggggatcagtgcgattcgatcacttatcgagttcggtttcgctgccaaagaaagagctgatgtgaggctttattatggtgatacaagtctgaaatctatgtcataccaggaaaggcttagtaactgggagtcaactggaattaaaataataccagtcttatcacaaccagatgacagctggaaaggtgaacgaggatatgttcaggatgctttcttcagaaac

SEQ ID NO: 75769 - DNA, 446 bp, Zea mays
  unsure at all n locations
  Clone ID: LIB3079-035-Q1-K1-C8
tcgatcctcaccactggcagtatggatggcaagatcgtgaacaacgacgtgagaattaggaaccatgtggtacagacatacgaggggcacagccaggaggtgtgtgggctcaagtggtctggatcagggcagcagctggctagtgggggtaatgacaaccttctgcacatttgggatgtgtcgatggcatcccccatgtcaaccgctggccgcaaccagtggctgcacaggctcgaggaccacatgtccgctgtgaaggcactcgcgtggtgtcctttccagagcaacttgctggcaactggtggtggcggcagtgatagatgcatcaagttctggaacacacacactggagcatgtctgaactctgttaacactggatcacaggtctgtgcccttttatggaacanaaatgagagagagctgctgagctcacacggattcacaca

SEQ ID NO: 75770 - DNA, 448 bp, Zea mays
  unsure at all n locations
  Clone ID: LIB3079-035-Q1-K1-B2
ggcgggcgagcctgtctcggagcctaaaggtgatccgcgtcctcttctgtcacgggtcccgggccagcgccaccgtccgtgagtacgtgaagaagaactatggtgacatcaaggctcgcaacccctccctccccttacttgtccgcgagtgctccggtgaccagacccagctctgggcgcgctacgatatgggtgaggagagatgcgtgtacttggatggcctgacggaagcacagattgatcaaaagctggaggagcttgccaaggccggcgagtatcttaaaaccaaataggactgagaactctatgctgccatgtntaacgtgtgccaatcaatgatgccatatgggtgagcaattgctactctatcgttatctgtatttgtgcctggaattaagtcgttaattggcttaactgtgtgaaaatgtcactaatgtcttacttaaaa

SEQ ID NO: 75771 - DNA, 406 bp, Zea mays
  Clone ID: LIB3079-035-Q1-K1-B3
ctgaaagttgatctgagcagtgcaatatataattctggcatactattctcgcaatcgttggggggttcagaatgggactgacatcagagtaatatgtggcataccttctgatcctctgtactcgagaggattttgttgtggataagccacttgctgcctttgtttggtgggtaattgcttcgagcataagaaacagcgtatgctgctataaacgtctttttgcaacgcgaaaaaaaaaataccatagaaaaaagaaaaacaaaaaagtgaaggcacagaagagagaatcaaaggttgcaagattttatcactaaggctatgaagaaccattgcttaagctgatgagaatgaaaactgatcatgctggactagttattaatgctgaagaaagaacgctttccttgac

SEQ ID NO: 75772 - DNA, 379 bp, Zea mays
  Clone ID: LIB3079-035-Q1-K1-B5
cgagcctgctatagtgaatcatgcctcctccatggtgttcaatggatgccacccaagggtggaataacagaaggacaaatgcttaaattcatgggcgcaaacatacacttatctccaacacaagccaagatactgttggaggatgagactgctggttttgcatatttgaatcttcaggaagcatgtccaccattatattcaattattgggctcagggagcatattaagaaacggccaccattggctacctctgagaaagttcaacaatttgtgagggcacgggggagagaatcaatggttgcaggattttatcacgaatgctatgaagatccattgcttatgctgatgagaaggagaactgttcatgctggactagttg

SEQ ID NO: 75773 - DNA, 431 bp, Zea mays
  Clone ID: LIB3079-035-Q1-K1-B6
cccacgcgtccgagcaaatgcagcatccttgcaactagtgcaagggttctggagagacagtcagcgacaaggatagatgcccacagtgcaagggtgataaagttgtgcaggagaagaaggttcttgaagtgtttgtggagaaaggcatgcagaatgggcagaagatcacattccctggtgaagctgatgaagcgcctgacactgtcactggagatatcatttttgttctccagcagaaggagcatcccaagttcaagagaaagggcgatgacctcttctacgagcacaccctgaccttgactgaatctctgtgtggcttccagtttgttgtgactcacttggataacaggcagctgctgatcaaatcaaatccgggcgaagttgtgaagcctgattctttcaaggcgatcaacgacgaatgcatgcccatg

SEQ ID NO: 75774 - DNA, 301 bp, Zea mays
  Clone ID: LIB3079-035-Q1-K1-B7
acgctgaaagttgatctgagcagtgcaatatattattctggcatactattctcgcaatcgttggggggttcagaatgggactgacatcagagtaatatgtggcataccttctgatcctctgtactcgagaggattttgttgtggataagccacttgctgcctttgtttggtgggtaattgcttcgagcataagaaacagcgtatgctgctataaacgtctttttgcaacgcgaaaaaaaaggctacctatgaaaaagaacaacaattaatgaagtgcacagtggaaagaattaatggttgc

SEQ ID NO: 75775 - DNA, 346 bp, Zea mays
  Clone ID: LIB3079-035-Q1-K1-B8
gaaagggacagggaagtggacggtgcagcttgccgtcgagctgtcggtggccgctcctacgatcgaggcgtccttggactcgaggtttctgagcgggctgaaggacgagcgggtggaggcctccaagatcttccagggtgactactactccaccggctcgccggtggacaaggctcatctggtggaggacgtgaggcatgccctgtacgcgtccaagatctgcagctacgcgcagggcatgaacatcatcaaggccaagagcgcggagaaaggctgttggctcaacctcggcgagctggccatgatctggaagggcgggtgcattatacgggccattttactggac

SEQ ID NO: 75776 - DNA, 433 bp, Zea mays
  Clone ID: LIB3079-035-Q1-K1-B9
cctcccgcgtcagaagtcagaactagcctatcctattccgaaagccgaaaggactctgtggttgggtgcggcggatggcgacttcgtcgtcgttctctggccccggcgggtccccggcccactcgtctccgggaggcggaggcggcggctgcggcagcggtggcgtggggtcgtaccaccaccaccggtcgcggttcggcgacacgacgctgaccaaggtgttcgttggcgggctggcgtgggagacgccgtccgaggggctgcgccagcacttcgacgtctacggagagatactcgaggcggtcgtcatcaccgatcgcgagaccggccgctccaagggctacggtttcgtgattttccgggacccggacgcggcggctcgggcggtgcataacccgaacccggtgatcgccggccggcgcgccaactgcaa

SEQ ID NO: 75777 - DNA, 359 bp, Zea mays
  Clone ID: LIB3079-035-Q1-K1-C10
gaatcacagtcagtcccatcttaccttgattctagaccaagaacctgaactcatctgacctgcttcaccaactggccatgcagcactcccggcataccatcaccaggaggatgagctaggatagcctacattaccacatgcatccattcgtacataatcaagcataatcacgtttcttgcattcaactatataaaggaagtctaattatatatctacagctggctgtaaaaatgctgttatgtaccgcaccacttcgattttttttgacactccacttgtgaatgatgtaaatctgattgaattgaattatttgcaatttggaaaaaaaaaaatatttatttaataattaatattccaa

SEQ ID NO: 75778 - DNA, 447 bp, Zea mays
  unsure at all n locations
  Clone ID: LIB3079-035-Q1-K1-C11
cactcactcacaagtcacacagccacacttgaaccgctgcccgcagcggagggagcttgcgcgggccaacgcacacataacacaagctcgtcgtcgatggcgcggtgggctgcggtgctggcgctggccgcggccacggccatcgccgtggcgtccgtggcgggcggcgacatgagcgcggacaagacggagtgcgcggaccagctggtgggcctggcgccgtgcctgcagtacgtgcaggggcaggcccgcgcgccgtcgtccgactgctgcggcggcctgcgccaggtgctggggaagagccccaagtgcctgtgcgtgctcgtcaaggacaaggacgaccccaacctgtgcatcaagatcaacgccaccctcgcgctcgcgctccccaacgcctgcggcgccacccgcgccaacgtctnccactgcgctcagctcctgcatatt

SEQ ID NO: 75779 - DNA, 217 bp, Zea mays
  Clone ID: LIB3079-035-Q1-K1-C12
cagattcaaatccactctctaagaaacatacatctcattctcatcttttccacgattcgtattctatatatacttcagcaccatactccaattaactctcacattatacatacccatactcaaaaactcacatatactaatctattatttattaacaatatataatatccatcatcaaaaaccataactaatctataaacaaattctaaacctatca

SEQ ID NO: 75780 - DNA, 402 bp, Zea mays
  Clone ID: LIB3079-035-Q1-K1-C2
agaaagtactaaccacaatgaagatgaccattccgatagccctatcttctctgctctgagcacactcttctctgatccgttctcatccgacgatgatgaaagtgttccacactcttacgagaactgaagatagcgtcggacgcaggcttgcaatatggtgaagacgttctgcttctgaggctggcatctttatattgtagcttctgtacatatctctctgaacggtcgccccccataagacaaactattacctctccgttttactgaaaactatgtggcttgtaatctgctagtgcttgctatgttcacttgcctcgaataaatgttatcctttagcgtgcttaaaaaaacactcatggagctgcccggagcccaacagtcccttaacctgctgcaaggctt

SEQ ID NO: 75781 - DNA, 453 bp, Zea mays
  Clone ID: LIB3079-035-Q1-K1-C3
cccacgcgtccggttcactgccaatggctgggtgcagtcttatgggtcaaggtgcgtcaggcctccgatcatctacggtgacgtgagccgccccaaccccatgaccgttttctggtcgaagacggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaacttcaacga

SEQ ID NO: 75782 - DNA, 452 bp, Zea mays
  Clone ID: LIB3079-035-Q1-K1-C4
aaaagcttgaagatattgttccttcatcacacaactgtgacattccacatgtgaaccgtggtgagtatcatctgattgatatttctgaggatggatttgtgagccttcttacttcagatggcatcactaaggatgatcttagactcccaactgatgagactcttgtggcccagattaaggaagggctcgaaagcgggaaggatcttgttgtgactgtccagactgctatgggggaggagcagatctgagcgctgtatgatgttggccccaaataacttccttggctttggagacggaaccctactctatctcaacttaaatcggaaaagaagtgtatcaccaaaggattgctaccgagacattcacctggcttgaactggcttttgctatatcgtgcactgggttgctgggtgtcgtacctacctgacttatcattatctgtggttacattc

SEQ ID NO: 75783 - DNA, 310 bp, Zea mays
  Clone ID: LIB3079-035-Q1-K1-C5
aaaaaaaaaaaacaaacaaaacaatgacaattactatatacaaaaaaaaaaaaaaaaaaaacgaaaggcctaaaataataatacaagaacaaaaagccaaaaaaaccaaataaaccgaaatctgatcaaagacagcacaaaaacatgaaatatagggggatgaactttatgctgacctggcctaatcacaattctcaactggtcctttgtccttaatgaccagcccccgattgaaacttgcttcccgatcgcttttgcaatcaagactggagaaaaccatcttgatgcctatgttattcacgttatccaa

SEQ ID NO: 75784 - DNA, 425 bp, Zea mays
  Clone ID: LIB3079-035-Q1-K1-C6
attttgggaagctcgccgacctgggctacaagagaagcgccaagaagtgcaaggagaagttcgagaacgtgcacaagtactacaagcgcacaaaggaaggccgcaccggcaggcaggacggcaagagctaccgcttcttcgacgagctggaggccttgcacgcagccgcgccgcagccacagccgccgctacagaagcagcagcagcagttgccgccagcgagcaccaccgctccaccgttgcacgccttcgccgcgccagtatccgcgccgccgccgataagttcaatgccaccgtcgacggggccgatgcaaccagcgcccatatcgtcggcggcaccggcggtgcaggtccagacactcgtggagcttgccggggcccaccagcccctcaacctgctgcaaggcttcagcttctcttccatg

SEQ ID NO: 75785 - DNA, 448 bp, Zea mays
  Clone ID: LIB3079-035-Q1-K1-C7
taccatgtcactaccaatggctctatgcattcttatccgtcaaggagcgtcaagcctaccatcatctacggggacatgagccaggagaacctcatgaccgttttctggtccaagaccgcacacatcatcacgttttgcccaatgaacgagatgctgtctggcccattcacaatcctcaactggtccttggtgcggaatgaccagccgacgtttgagacttgctaccagatcactctttctatcaagaacgaagtctacgatctcgacgctggtggtattcaggttatccaaatcgacgaggctgcactgagagaagggctgccgatccgcaaggctgagcatgcattctacttggactgggctgtccactccttcagaattaccaactgcgagatccatgacaccacccacattcacacccacatgtgctactccaactttaacgaca

SEQ ID NO: 75786 - DNA, 457 bp, Zea mays
  Clone ID: LIB3079-035-Q1-K1-B12
tcttacacttcacgcttaaaatacatttacactatagctaacaacccatatactcacacaatgggcgtgttaaattactactacatatagaccatcacactatcaaacactcctactacagatactttcacttctatataccatttactaatactatatacaatcttatcctcccaccaccatactactaacacttactaacctaaataatcattatcatcatactactaactatactcaaccatatcaatatcatacctactatatatctataccaagttctatacctacctcatactctactataacatacatatccatatacatttacatatactcaaatatctatatactaatgaactattcaatcattattattaaacactcacatagagctttaacttcttcacaaatatcttaaatatttaaatccactctttattcaatactcatactt

SEQ ID NO: 75787 - DNA, 380 bp, Zea mays
  Clone ID: LIB3079-035-Q1-K1-A10
cccacgcgtccgcatttctagagtaagtgatactctgggggcatctcccgctcgcttagctgtgcccgccaggccatggagcgtgaggacgccgacggcgctctcgattcgtgggctcaattctgcactctttccaacgagcttctcgccggagacggtgatctcgccgtcggcccacgcctagctcccgtcgttggtgacctctgcacacgcggcctcgccacgctcgtccgcgactactattacgccctttgcttgcattgcatcccgtgttagacttgtgctcatgcgcttcactgcatcctgttgtatctggatggatttgaccaaatgcaaattgccaacatttttattaattaaaattgctactgcaatgtctc

SEQ ID NO: 75788 - DNA, 448 bp, Zea mays
  Clone ID: LIB3079-035-Q1-K1-A11
caagcgtataaagctacagatttccgatactggggtccaagaacgcttgccgactattacgaccgggtactaccgacgagctataggcatgttgctggtttatgatgtcaccgatgaatcttattttaacaacatccgaaactggattcggaacatttaacaacacgcctctgataatgtcaacaagattttggttggcaacaaggcctatatggacgaaagcaagagggctgtacctactgcaaaaggacaagcacttgctgatgactactggatcaaattttttgaaacgagtgcgaagacaaacctgaatgtggagcaagtgtttttctacatcgcacgtgacatcaagcagatgcttgcggagactgattcaaaggcagatgacatggcaatcaaaattaacaagccagaccaaggttccgaggcaccagcttcccagcgatct

SEQ ID NO: 75789 - DNA, 387 bp, Zea mays
  Clone ID: LIB3079-035-Q1-K1-A12
acgattgtaatcgcacactatcaaaaccgggattttatctttcccctgcaatgtaaagagatcgacagagtcacaccactgtatacgctttatacttgactgtgcatatcactgtcccaatttcaggaggtctattatacatggaccacccattgacctctgcacccttcataatacgcaacataatcaaatttcatgtgttcctcacacacaagcacactttcctccacgtgtaccggaagaagacgacagatgatctcatctcgatgccgtatatctagactctattcagctgcacgctgaagatactgtactcactggtgaagaccaactccatcccgctgctgaccatcaacgccttctggtgcgtgataaaagcctgctaca

SEQ ID NO: 75790 - DNA, 452 bp, Zea mays
  unsure at all n locations
  Clone ID: LIB3079-035-Q1-K1-A2
caataagagagctcgggccacagagtattcttgctattaaagcaaatcagttgcgaccttggaagtacgaggatttcaagaacgcgatggcggtgatcaggccaagcttgcagaagagcaaatgggacgagcttgagaaatggaacgaggaatttggttcgagctgacggcggctcgcactgcctgtgcctgatgatgatcaagcggtcctatttccatctgtatatatgatttatgtctcccacgctgtggctcacaacacaaggggtcacaccatgcgcccattgatgcgtcctcgttgggctaggcagcacaacatcgacagaagcagaatgtaaaggtatacttctggcaacggcctatacagccattgagggctagtttgaaacaccgttcaagggattttcattnttcaaagggaaattagctcattttcccggtaaaaatgaaat

SEQ ID NO: 75791 - DNA, 452 bp, Zea mays
  Clone ID: LIB3079-035-Q1-K1-A3
cccacgcgtccgctcgccatttctgtattacttcatgtgatggtccctcagctggcctaaatgcattcttgcaagacaaactggttatgaccaaactgttacagcaacatcttttgcgcgccaagcaatagatgaagtctatggatgataagcaccgcactgagtgtgaatttgctgttggagatctgaaggccgtgggtgtgctaacgtcctggtatctccgttgctgcctgccactgactctgcttggcacattcatgaacagatattggagcgacatctggtcgtcccaaccttcctcgttggcaacatgggaagacttggaagcactcaagcacacctttcctcaggctccagcttgggggcaagctggttctcatggaagagggaatgtcagtatcccttcatcagtcactggaggtcaggcagagcatgttcgaggagatgcagca

SEQ ID NO: 75792 - DNA, 418 bp, Zea mays
  Clone ID: LIB3079-035-Q1-K1-A4
aaatgatcgctctctccaagatagccctggtgtctgcggtggcgctgctggggctgggctgggcgtaccaggccacccgcccgccgcccccggcgatcttgggcgccccaggagggccgccgatcagctcacctagaatccggctgaaagacggccggcaccttgcctacagggaggaaggagtgcgcagggagaacgccaggttcaggatcgttttcatccatggcttctcctccaccaaggagagcgggttccccgtgtcccaggagcttgtggagcagctgggcatatacatgctcttcttcgacagagccgggtatggcgacagcgacgccaacccgaagcgctgcctcaagagcgacgccacggacgttcaagagctcgtcgacgcgctgcagctcggggacaggttctacgt

SEQ ID NO: 75793 - DNA, 422 bp, Zea mays
  unsure at all n locations
  Clone ID: LIB3079-035-Q1-K1-A5
cccacgcgtccgctcgccatttctgtattacttcatgtgatggtccctcagctggcctaggtgcattcttgcaagacaaactggttatgaccaaactgttacagcaacatcttttgcgcgccaagcaatagatgaagtctatggatgataagcaccgcactgagtgtgaatttgctgttggagatctgaaggccgtgggtgtgctaacgtcctggtatctccgttgctgcctgccactgactctgcttggcacattcatgaacagatattggagcgacatctggtcgtcccaaccttcctcgttggcaacatgggaagacttggaagcactcaagcacacctttcctcaggctccagcttgngggcaagctggttctcatggaggagggaatgtcagtatcccttcatcagtcactggaggt

SEQ ID NO: 75794 - DNA, 398 bp, Zea mays
  Clone ID: LIB3079-035-Q1-K1-A6
gcggacattacagtttagagatagaaagattaaattctttgagagacggaagattgagaggatgataaggcgactcgagaagcaacaacgttcaaatggtgacggtgtcaacaataatctgtcaaaattgcgagaagatcttgaatatgttagattcttccctaagaatgagaaatatgtctcgctgttcactggagggaacagtcaagatattgttcaagagaggaataaatggcgcaaacagatcaaggagaatctcatggctgctgcagcaaacggaaaagatttagaagagacagcaagcgacgacgataccttggatgtgagtgatgatgacttctttatgtctggaagttcaagtgatgaataggctgatgatgagtggactgacaaaagtg

SEQ ID NO: 75795 - DNA, 407 bp, Zea mays
  Clone ID: LIB3079-035-Q1-K1-A7
gcgtgcacgcgtcagatagacattggtgtaatatttaatgtgacggtccctcagatggcctaggtgcattattccaagacagactgcatatgaccaaagtgttacagcaacatctttagggcgccctgcaatacatgaagtcgtatggatgacaagcaaccgaacctgaagtcaactcgctgatgcacatcatgaatgccagacgcgtgctaacgtcctgtggatctacgaagcatgcctgccactgactctgcttggcacattcatgaacagatattggagcgacatctggacgagccaacctttctacttggcaacatgggaagacttggaagcactcaagcacacctttgctgacgctccagcttgtgggcaaactgggtctcatggatgaaggaatgtcagta

SEQ ID NO: 75796 - DNA, 445 bp, Zea mays
  Clone ID: LIB3079-035-Q1-K1-A8
ggcgtctgaacagaccgtccgcgtctactgcaaggccggcgaagggtacagcctcaccgggaggaacggcaccgtgtgcctggcgccaaccaaccccagggacgagttccagcactgggtgaaggacatgaggcacagcactagcatcaaggacgaggaagggtacccagcgttcgcgctggtgaacaaggtcaccggcgaagccatcaagcactcgctgggacagagccacccggtacgccttgtgccctacaaccccgagtacgttgacgagtcggtgctgtggacggagagccgcgacgtcgggcacggcttccgctgcgtgcgcatggtgaacaacatctacctcaacatggacgccttccacggcgacaaggaccacggcggcgtccacgacggcaccaccgtcgtcctctgggaatgggccaagggcgacaaccagcgc

SEQ ID NO: 75797 - DNA, 443 bp, Zea mays
  unsure at all n locations
  Clone ID: LIB3079-035-Q1-K1-A9
cccgcgacgatgcgggccgtgcagtacgactcctgcggcgggggcgccgctggactcaagcatgtggaagttccggtcccttcggcgaaaaagaacgagcttctgctgaagctggaggcagcaagcatcaacccagtggactggaaggtgcagaaaggcatgctgaggcctttcctgcctcgtaaattaccttttatcccagtgactgatgtggcaggagtcgtggctgatgttggtccaggaatcaatgggttccaagccggagatcaagttgttgctatgctcaactcatttaacggaggtgggcttgcggagtatgctgtggcatcagaaaatctgaccgtcaagaggcctcctgaggtatctgctgccgaaggcgcanggctgcccatcgccgncggcactgccctccaggcgctcanngaccatcgcgccaagttcga

SEQ ID NO: 75798 - DNA, 451 bp, Zea mays
  Clone ID: LIB3079-035-Q1-K1-B1
cttgagctagggttttcttcgccgctaccttcctacgaggcgggcgtgcagccatggcgctggtgcaggcgggcatgggccttacccgggtcgttatcctcgtcggcgccggcgttgccggctccgtcgtcctccgcaacggccgcctcgccgagatcctcggcgagctccaggagatactcgacaaggggaagaaggtgaaggatggaggagggggagacggggaaaccgatctcaacgaggctcttacctcgcaggtgcgtcgccttgccatggaggtccggcaacttggtaattcacgttcaataactgttgtcaatggaagttctgcacaatcaggagtatcaggcctgatagtacctgcagcaactgtaggagcactgagttacggttatatgtggtggaaggcgatctcgttctcagatctaatgtatgtcaccaagcgcaacat

SEQ ID NO: 75799 - DNA, 446 bp, Zea mays
  Clone ID: LIB3079-035-Q1-K1-B10
gtagttttcttctcccgtccaccttgcgtgctcgcgcgcgagctctcgtggctcaggctcgactaggcgaccgccgtggcccctactccacgtgctctagtctagcctcgtcgattgcttccccagtttaattgatctacaagcttcagatcatgttcaagaatacatttcagtctgggttcctgtccattctttatagcctcgggaccaagccattgcagatatgggataaggaagctgcgaatgggcacattaaacgaccccaagatgaagatatccaatctaatgtacttgaaattgttggaacaaatgtacagtcaacttacatcacatgcccagctgatccttctgctactcttgggattaagcttccatgtctggctattattgtgaacaatcttaagaaatacttcacgtttgagatccaagttctggatgacaagaat

SEQ ID NO: 75800 - DNA, 414 bp, Zea mays
  unsure at all n locations
  Clone ID: LIB3079-035-Q1-K1-B11
gcagccgcatcgaactctacctgcctttctctcgtccctggcggcggcggcaggatggcggcttgtactgcgaggacggtgaacgatgtgaacccccacgagtttgtcaaggcctactccgcccatctcaaacgctccggcaagatggagcttcctgagtgggttgacattgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctncagcagctgcaggagatgggcatcattgatgtcgatccc

SEQ ID NO: 75801 - DNA, 375 bp, Zea mays
  Clone ID: LIB3079-035-Q1-K1-A1
ctcctcccctccttccacccggcaataacttcgcgtcggccactctccggaggcgactagggtttcagcccctgggacacgccgccggtcgtggcacctccgccaccggatcccggtacccgagctacgccatcgccgccccgcccccggtcaccgccggtgcgcttccgccgacaccagacgcagctcgtccgccccgtcacgtgcacctctgcgtgagcactggattggatagcgtttgcagtttcggcggctggcgccaaatcctaccgctgctgctcgcgcacgatgtctcgagcccttggggttcccctactacgctccggctggagttctctatgaaacttgttctacagtgctcttttggtgcatgac

SEQ ID NO: 75802 - DNA, 374 bp, Zea mays
  Clone ID: LIB3079-026-Q1-K1-F3
tcccgcgtccgatcaagacagccccgtgctagctcacccgccggggctcgccacgatgagaggcctcctcgcgtgcgccaccctcgcccgccgcgccgtcgcctcctccgcgcccgcgcgcgtccgccacctggcgggcgccgcggaggcggcggaggccgagctcaagaggacggcgctctacgacttccacgtcgcccacggcggcaagatggtgccgttcgccggctggagcatgcccatccagtacagggactccatcatggactccaccgtcaactgccgcgccaacggcagcctcttcgacgtcgcccacatgtgcggcctcagcctcaagggccgcggggccatccccttcctcgagtccctcgtcg

SEQ ID NO: 75803 - DNA, 414 bp, Zea mays
  Clone ID: LIB3079-026-Q1-K1-F4
tcgcggaaagctggttatccctgcccaccttacaagattattatacttgactaagcagatggaatggcagaagatgcccagaatgctttgaggcgtaccacagagacttactccaaagtgaccagattcttttttatatgcaactatatcagcaggataatagaaccacttgcatcaagatgtgcaaagtttaggttcaagcctctttcagaagaagtgatgagtagtcgcattatgcatatatgcaatgaagaaggcctcaatcttaatgctcaggcgatgtccacactgagtgtcatttctcaaggtgatcttcgtcgtgctataacctaccttcagagtgcagctcgcttatttggatcttctatctcttccagtgacctgatcagtgtttctggggttatccctgaagat

SEQ ID NO: 75804 - DNA, 409 bp, Zea mays
  Clone ID: LIB3079-026-Q1-K1-F5
agggagcagaagccaaccggctcgtccgcccgttgcctgtcgtcgctatggccgccggggaggtgtgcgtgaaggccgtcgcggggaaccccgacacgctcggcgattgcccgttctcgcagagggtgctgctcacgctggaggagaagaaggtcccgtacgaggtgaagctcgtcgacctcggcaacaagcccgaatggtttctgaacatcagcccagagggtaaggtgcctttgttcaacggtggagatggcaaatgcattgctgattctgatgtaatcacccaagtcattgaggagaagttcccgactccttctctggtcacccctccagaatatgcatcagtgggatcaaagattttcccagcctttgtcaagttctcgaagagcaaggatgctagtgatgggtc

SEQ ID NO: 75805 - DNA, 447 bp, Zea mays
  unsure at all n locations
  Clone ID: LIB3079-026-Q1-K1-F6
gctagccactcgtctcgtccacgtcgtccggcaagatggtccttngatgacctggaagaggctatactcaaacacagggactaacttccgggaggttgccatcaaaggtttctgggacatgtacgacccagagggctactctttgtggttctgtgactacaagtacaatgatgagaacaccgtctcctttgtgaccctgaacaaggttggtggattcctgcagcggatggacctgtgccgcaagtacgcctttgggaagatgctcgtgataggctctgagccacccttcaagctgaagggcctttggctcttccgtggccaggatgttcccaagtttgtaatggacgaggtctatgacatggagctctacgagtggaccaaggtggacatctctgatgaggcccataaggagcgtgtcaatgcgatgattgaggaccaggagccctt

SEQ ID NO: 75806 - DNA, 436 bp, Zea mays
  Clone ID: LIB3079-026-Q1-K1-F7
ctgggagcggcattttcgctgccgggagcaatggagacgctggggaggcagctgctggcgcgaagcccgcccgaacctcctcgcgccaggcgagcagtactgtaagccacatctcgttcgctgaggatggaaccgatcctcccaaaaagcccacatcagtagctgaggtggcaaagcagcgtgagcttagtggcactcttcaaagcgagacggatagtaagacgaagaagcagatctcaaatgcaaagtccaaggagctcagcggccacgacatctttgctgatactctggattccaggtctaacagggcaaggaacccatcgaacggcagcacagcctcacacgcacctgccaaaaatacaaacgccagcaccttctcgtttggagatgccaacactgacagcacgccaaagacggcaaggaagataaccggcaa

SEQ ID NO: 75807 - DNA, 437 bp, Zea mays
  Clone ID: LIB3079-026-Q1-K1-F8
cccacgcgtccggaaaagttctggtgtcgtacgcagtctcacacatcatcagggttggtctgatcaggccgtcgcaccatcccaatcgatgtctacatctcagccttccattctgtcatcggagaccttgtctatgaaagaggaaacttcgttgacacctgggtctacatttggaaccgtaaagcccgagtcactgaacccttaccagggcagagaagagaactcactgcaagcgagcagcagctgcagcagtgactgtacgccattgagttctaacatcataagtgagatctcgaagctcagattgaactgaagatcactgatcaagcaactcctgtctgaaatctctaccagatttactccctaccagccacaaggctaggtagctgacgagttcccacacctggacatgatcaacgacctgctggatgacgagc

SEQ ID NO: 75808 - DNA, 427 bp, Zea mays
  Clone ID: LIB3079-026-Q1-K1-F9
gcatctggctgccatgtccacccaatgggtataaagcccttggctatgtggttactaagggaccaaagaagccctcactggaagcagttcggtgtgtgcgagatgacctaacggacacgcgcgaaaatttccattcaattgcaaatatggacaacgcatgccagatttggaagacaaggccttgccaccgaggagtgggagggcgtggtataccggttggtacattctcctgcgaaaccgattcaacagatagtgatgaatcaagcactccctgcctgaaaaatgtcgactcgaatctgggtgccatgcctaatctggagcagatcaatgctctgatcaagcactacggcccaaccgttttcttccacccgcaagagacgtacttaccgtcatcagtttcttggttctttgagaacggagctacatt

SEQ ID NO: 75809 - DNA, 340 bp, Zea mays
  Clone ID: LIB3079-026-Q1-K1-G1
caaatgctaccggacccactcctgacatgcggcttctgctcccatttgtggagtctggtttgcgagtgtcttacggcgtgtcgtctatccaactatttcatgaaattgggcactttttggcagcatttccaaaaaatgctaaactgggaattcctttctttattccgaacttcacccttggaacttttggcgcaattactcacttcaagtccattcttccggatcgaaagacaatgtttgacatatcaatggctcgtcctgtggctggagctgcacttttcttttcaatgttctttgtcgggttattactctcttcaaatcctgttgacgcaagtgattt

SEQ ID NO: 75810 - DNA, 420 bp, Zea mays
  Clone ID: LIB3079-026-Q1-K1-G10
gcattcctgctctcttgctctcctcgctctcagaccacagttgccgccgccgccggcgtaagccagggtgctgaggctttcgttggcctcttcgccggcagcgagcacccaccagcagttctgtagaaatggctgatggtgaggacatccagcctcttgtctgcgacaatggcaccggaatggtcaaggctggttttgccggcgatgatgcaccaagggctgtattccctagcatcgttgggcgtcctcgtcacaccggtgtcatggtagggatggggcagaaggatgcatatgttggtgatgaggcacagtccaagagaggtattctcacgctcaagtacccgattgagcacggtattgtaagcaactgggatgacatggagaaaatctggcatcacactttctacaatgagctccgtg

SEQ ID NO: 75811 - DNA, 427 bp, Zea mays
  unsure at all n locations
  Clone ID: LIB3079-026-Q1-K1-G11
ccaagacgaactcggtgaactctttccggttcgttcccctacgcccgtttctctctgggcgcgcaacatcagagcacaagcgaggaacccagtccagtcccgggaatggagtgcgtattgggcgtggttggccgcgacttcgcgctggtggcggccgacacctccgccgtgcagagtattctcgtccacaagaccgacgaggacaaggtgatggtgctcgactcgcaaaagctgatgggcgcttcaggggagcctggtgatcgggtgcaatttacggagttcatacagaagaaccttcacctgtaccagttccggaacaccatcccgctctcaaccgncgncgncgncaacttcacacgcggcgaactcgccacagcccttcgcaagaatccatatatggtcaatattattcttggtggttatgata

SEQ ID NO: 75812 - DNA, 428 bp, Zea mays
  Clone ID: LIB3079-026-Q1-K1-G12
gttcctttcgccgctgccgacgttctaccgcgtgtaccgcaagaagtcgacggaggggttccagtcgaccccgtacgtggtgacgctgttcagctgcatgctgtggatcttctacgcgctgctcaagtccggcgccgagctgctggtgaccatcaacggcgtcgggtgcgtgatcgaggcggcgtacctggccgcgtacctggtgtacgcgcccaaggccgccagggcgctgacggccaagatgctgctggggctcaacgtcggcgtctttggactcgccgcgctcgccaccatggtggtctccagcgccggtctccgcgtgcgcgtgctcggctggatctgcgtcagcgtcgcgctcagcgtattcgccgcgccgctcagcatcatgcggcaggtggtccggaccaagagcgtggagttcatgccca

SEQ ID NO: 75813 - DNA, 391 bp, Zea mays
  Clone ID: LIB3079-026-Q1-K1-G2
gttttcatgcagaaaggaatgaagaaagctctgataccttattttgagctcacaaatgctgggggggttggggaccttgaactgttcagggctgttgcagacaaatttgcaagcacattcagcgcagacaggactcgtaatttgattgtgaggctgcgccataatgtcattcgaactggactgcgcaacatcagcatttcttactcaaggatctcccttgctgacattgctaagaagctaagactagactctgagaaccctattgctgatgcggagagcattgtagccaaggccataagagatggcgccattgacgccaccatagatcatgcaaatggctggatggtatccaaggaaactggtgatgtctactcaacaaatgagccacaaa

SEQ ID NO: 75814 - DNA, 379 bp, Zea mays
  Clone ID: LIB3079-026-Q1-K1-G3
tcgcacactcttgcaccgagctagcagccaagatggcgaccaaacacctggctctttgcctccttggtctctttagcataggcatgggcatggccaccgctgctgcaaaccgcaaactgggttatggccccgggggaggaggtggcggtggtggtagcggtggcggtggaggcggtggttacggaggaccaggctatgggtccggatcagggtatggtgagggcggtggcagcggaggtgctgctggagggtatggacatggtggtggcagctgctgcggtggtggtgagggtgcgggagctggtggctctgggtatgggtccggtcaaggatctggctaccgagctggcagcggtgctgccggtggatatgggagtgg

SEQ ID NO: 75815 - DNA, 318 bp, Zea mays
  Clone ID: LIB3079-026-Q1-K1-G4
tcgcagaatgtcgcgcgccgctagcccgcaatgcttcaaccaaacagaccggtttttggagcccggggatctttagcactaggacggccatcggcaccgttgctgcatacgcgcaactctgttaatgtaccccgggagcagctggtcgtcgtggcagcgcgggtacctgatgagctacttacacaggtccaacatcacggtcctgaacaggttctacacactgaccctgtcggcgaacagctcgctgcacggcattgtcattcggctgcgggcactctcagagcgtgctgatcaaccgcgttctacaggcttctgggc

SEQ ID NO: 75816 - DNA, 427 bp, Zea mays
  Clone ID: LIB3079-026-Q1-K1-G5
gcgccacagtgagcgctagtctgcgggacacgggggcgctgctggtgatggacccgggctgctccgccgtggacaacgaccgcttcctcgacgtcgtcgagcgctacttcgcccgatccgacgacgcaaagcgcctgcaggaacggccccacctgcactaccaggttggtgtcacacccgaaggggtggaggtgcctcgcagtttggtcgacaagaacatgcaggagaagatcaggagcatgcctaaggactttaggccagccactcctaaagggccggacccgaaatggcgatacatgtggagagtgggtcctcgccctacaaacacccgttttaaggagctgaactcagaacctgttatccctgagggattacctgagtgggaagagatgatggattcctggggttctaaaatgatttctgcaat

SEQ ID NO: 75817 - DNA, 388 bp, Zea mays
  Clone ID: LIB3079-026-Q1-K1-F2
gtggtgaaggatacggctctgggtctggctttggtggtggtgctgccggcggcggcggtggagatggtggcggtggtggtggtggccaaggtgggtctggctatggctctggttcaggatatggatcaggtgaaggatacggacaaggtggtgctcatggaggaggctatggaagcggtggtggcggtggtggcggcggtggtcaaagtggtggtggctctggctatggatctggatccggctccggttatggaggcggcaacgacaacggacattattaggctctttttaagagctagatacatgttatacaaatatgtcaccagacatgagtctgtcttgttgcatgggatgctagctgtgtccatcgtgtgtgtaacaccgcaag

SEQ ID NO: 75818 - DNA, 267 bp, Zea mays
  Clone ID: LIB3079-026-Q1-K1-D9
ggaacctgatgtggatctctgaatgtgtcgctcagaaccagaagtcccgggtccatggcagtgtcgtcttcatattctgagaacccccgccactatatatgtatgtacaaaatgcctgctttgatgatggcacaatcgctcgacaattataaatctgggacttattattattcccattccctctgttagacgccggcgtaaaaaatgccagacctggagttgatgtattatttgttttgtagtcaaataaaagtgtgattatctggc

SEQ ID NO: 75819 - DNA, 227 bp, Zea mays
  Clone ID: LIB3079-026-Q1-K1-E1
tccaaataggttggaagcaagcccctttatgtagctcttgcgcagcgtaaagaagacaggaaggggaagctacaggcagaattttcacaaatgcgtcctgttgcaatggcgccttcagtaggtcctcgcatgcccatgtttccacctggtgtccctgaagttggccagcacctgttttatggcaagccacaaccagctttaataaaccttaaggctgaatttgtttt

SEQ ID NO: 75820 - DNA, 180 bp, Zea mays
  Clone ID: LIB3079-026-Q1-K1-E10
gcgagttgtcttcttcccccccgggagaaaagtgcttccgagaataaattttttccggcggaatgtctgaaactatgttgggtgtatcctagtggttggttgagcattaatggctcatattttgtcaggtctatgtgtcgccgtgaaacttttaatcaaatcagttcactcttttgcctc

SEQ ID NO: 75821 - DNA, 422 bp, Zea mays
  unsure at all n locations
  Clone ID: LIB3079-026-Q1-K1-E11
aatggattgaccttctcaagcaaagtgatgaaacttggaagatgggtgatattgtgcgcacactgacaaataggaggtggttagagaagtgtgtaacttatgctgaaagtcatgatcaagcattagtcggcgacaagactattgcgttttggttgatggacaaggatatgtatgatttcatggccctcgatagaccttcaactcctaccattgatcgtgggatagcattacataagatgattagacttatcacaatgggtttaggaagagagggctatcttaatttcatgggaaatgagtttggacatcctgaatggatagattttccaagaggtccgcaaagacttccaagtggtaagtttattccagggaataacaacagttatgacaaatgtcgtcgaagatttgacctgngtgatgca

SEQ ID NO: 75822 - DNA, 435 bp, Zea mays
  Clone ID: LIB3079-026-Q1-K1-E12
cagcagcagacacctccgccacctgcaccctcgaatcgttccccaccatggcgtcgcagggatcctccgtgttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttaagagtcggaagtgaatttcttgcaaggcactatcacgagcgca

SEQ ID NO: 75823 - DNA, 399 bp, Zea mays
  Clone ID: LIB3079-026-Q1-K1-E2
aattcccgttctagcacgggttcgtccacgcgttcgtccacgcgtccgcagaccagtttctttatctactccagagcgcacgggaacgcgatctacaccaggagggtggtgctcgttgccctctctctcctggctctctctgcgagcgccacctccacgcatacaagctgcggctgcggctgccagccaccgccaactgttcatctaccgccatctgtgcatctgccaccttctgatcacctgccacctgcagtgcatcttccaccgcctgtccacctgccgactccagtccacctgccacctgctgtccatgtgcctcctgctgttcatctgccggcgccaccatgctactaccctactcaaccggccctgcctcagactcatcctcagacacaccca

SEQ ID NO: 75824 - DNA, 419 bp, Zea mays
  Clone ID: LIB3079-026-Q1-K1-E3
cgaattcccgttcgagccatcgtccggcaggtccttactagtgatgcgtgggaacagtgccgacatggcgcgacatgtggtgtgcccggggtccaaccggcgcgtgagcatcacgttcgcaagggtgaggccatcgacgccggtggacatgagcccactcccgtcccccaccaaggccatgacaccctggcagccgcagccggtcacggcctcccaggtgccgtcgcccgtgagcatgactcataagcccccggtcagcggtgccataatcggttatgcccctaccccgcatgccgtgctggcgcccgcagcctggggcatggccatgctcgcgcccgtcatgatggtggctgcagcgcctgcgaagcccatggtgatggcctcatcgggcaccggccgcggcaacatcagcaagcgga

SEQ ID NO: 75825 - DNA, 415 bp, Zea mays
  unsure at all n locations
  Clone ID: LIB3079-026-Q1-K1-E4
gctgaatcaagagtttttgcaagacccactcaatcttttgcacatactcctgattatggtgtgctcagttatccatctcaacctgccatgccttttaccccagcgttctttgccccagggggcagtccatacttggtggatgcaaaaggtgcaccagtcataccaccgctgtcaggtctaagcctcggcatttctcatccatctttcaacaccagagcaacacagccctcatctaatgaactgagttacttccatcctagcgtggatttcagttatggagtgtcatctgaaggcgcacgtagggaagcagggagctactggcccatgtcctaccagggtcagacaatgtttgtggatgaacgcatgangaatgtatcacaggatggtacttctgggttggtgctgaagcgaaaag

SEQ ID NO: 75826 - DNA, 431 bp, Zea mays
  Clone ID: LIB3079-026-Q1-K1-E5
attgagaccaactagcaacatagaaagcacaatagtgtaccaacaatggcagccaaagtattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttc

SEQ ID NO: 75827 - DNA, 413 bp, Zea mays
  unsure at all n locations
  Clone ID: LIB3079-026-Q1-K1-E6
ttttgttcattttaaggagcggtacatggctatgaaggctctgaagaacactgagaggtatgaactcgatggtcagctgctggattgttcacttgcgaaacctcctgctgataagaaggatagtactgtatcaacacctactgcaaaaggaggcccgttactcccaagttatgccccacttggatatggactggtgggagcttataatccacgtggaaagggattggcagatgcttataataacccccttggaaatggactggcaggtgcttatggtgtgctttccgctcgtgctgcacagccaatggtgtatgctccaggtgctcctcccggctcaacaatgatcccaatggtcctaccagatggccgtcttgtatacgtaccacaggccgcggngcagcagcctgtgcatg

SEQ ID NO: 75828 - DNA, 386 bp, Zea mays
  Clone ID: LIB3079-026-Q1-K1-E7
caaaaccaatcgcggagattcaatgacgtacgtatacacacggccacacgggcacgtggctagctagcagtcgtagcgtgacgatgagggttctctctgttgcggtcgctctggtcgtggtggtggccgcggcctgcctcgccgcgccgcggggcgcggactgctcgggcgagtgcggtgcgacgccgccggacacggtggcgctgaggctggcgccgtgcgcgtcggcggcggatgaccccggctccgcgccgtccggctcctgctgcatcgcggtgcacgccatccggaagcagagccccaggtgcctatgcgccgacatgctgtccaacaccgacaggagcgccgggatcaatgccgaggtcgccatcaccattcccaaacgc

SEQ ID NO: 75829 - DNA, 373 bp, Zea mays
  Clone ID: LIB3079-026-Q1-K1-E8
tccactcgttcgtccactcgtacgcagcagcgcatgacttcgtatctgcaaggcgttgcgactagcctgcacgccgggagccctcgtctcgcccttctccacctccgaagatcctgcgagttcaacccgcgagtgagcatgtcgtcctactccccgccgtcgtcgtcgccgcgggaccagtccatgtacaccgaggcacccaacgcgcccatcaccagggagcggaggctcaaccccgatctgcaggagcagctacccaagccatatctagcgagagctctcgaggcggttgacccgagccacccgcatgggaccaaggagcgcgacccccgtggcatgagcgtgcttcagcagcacgccgacttcttcgacc

SEQ ID NO: 75830 - DNA, 429 bp, Zea mays
  Clone ID: LIB3079-026-Q1-K1-E9
ctgatgttcagcggctagtgttgcttctcaatggttggaattactgcatcaggacatgaggggacgtcttgctgctttaaagcgcagcaggaagagagtcagaaatgctcttcacacggaactgccatacctaaccgcgacagaattttcatctaatcaagagaacgaatcatccattgcaaatacttctgagattggatgtactgacaaagcggtttcagaagctcatgtggcacgatggaggtctctgtttgttcagatggacaaaacacttcaggaggaagggaaacagctggagaacaagttgaagcaagtgcaagaaatgcaattgaattgtgataaaggcctcaaacacatgacctgtgaagctcctctgctaggacctatggctgaactatggaagctgaagaacccaaatattttcgagag

SEQ ID NO: 75831 - DNA, 394 bp, Zea mays
  Clone ID: LIB3079-026-Q1-K1-F1
gaagaaagaagagcgtaagaagaagcgtactgttcaagaggaggaaagggaacgtggggaagtgagctccaaagtttatttgtcatacatgggggaagcttacaaaggtacactgataccactaattatcttggctcaaaccatgttccaagttcttcagattgcgagcaactggtggatggcatgggcaaacccacaaacagaaggagatgctcccaagacagatagtgtggtccttctggttgtttatatgtcccttgcctttggaagttcactatttgtgttcatgagaagccttcttgtggctacgtttggtttagcagctgcccagaagctttttataaaaatgcttaggtgtgtctttcgagctccaatgtcattctttgacaccaca

SEQ ID NO: 75832 - DNA, 423 bp, Zea mays
  Clone ID: LIB3079-026-Q1-K1-F10
cccacgcgtccggcagcagcagcagccgccgccctccgccggcgggggcgtcgcgcaccccggcatgggcggcggcgcaccgcagatggcccccgccggggggcagcagcagcccatgaagcggccccgccccaccgaattctcagatgtacccggtgcacctgacacggctggctattatccacgcgatgaagaaagggcagggtatcgtgctgctagagataccgagtctcttaacgcttcctacgaacgttttctacgtactgggcaaattcaatcctttggtggtggacatgctggagaacctattaggcctgctgtgggtggcaatgctgcctacccagttgatgatcgttcaatgatggctgctaggggtatggatagcagaaatatgggtttcgttggtggaatgccagagccacc

SEQ ID NO: 75833 - DNA, 400 bp, Zea mays
  unsure at all n locations
  Clone ID: LIB3079-026-Q1-K1-F12
cccggcggcgtgctgcagagctgggaccccacgctcgtcaacccctgcacctggttggacgtcacctgcgaccgcgacaaccgcgtcacccgcctagatcttggtaatttgaacttatctggtcatctggtgcctgagcttgggaaattggagcatctgcagtacctggaactttacaagaacagcattcaaggaacaatcccttctgagcttggtaatttgaagaatctaataagcttggacttgtacaagaacaacatttcggggacaatacctncttcccttggaaagttgaaatcccttgtattcctgcggctcaatggcaatcatttgactgggccgatcccaagggaactttctggaatatctagtctcaaagttgtcgatgtttcaagcaatg

SEQ ID NO: 75834 - DNA, 422 bp, Zea mays
  Clone ID: LIB3079-026-Q1-K1-D8
ctgcaaccccgcccgatcaatcttgctcgttccgccgctccctcgcctccggcagcggggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgtcgtcatctgcacgtttccaagtgatccgactcttgcgatggggagcctgtccattgtggcacttgtggtagctgccatcgtaggccatgttgccatcttctttccatactcgggcaagtcagttcctcgtggagcgctgtttcaaagcaccagcttgacagtgttctttgttggtgctg

SEQ ID NO: 75835 - DNA, 407 bp, Zea mays
  Clone ID: LIB3079-026-Q1-K1-C4
gttcgaccgcctcggcgtcagggtgcccaccatcatggtctcgccgtggatcaagaagggcacggtcgtcggccgcgccctcgggcccacggacacctccgagttcgaacactcctccattccggccaccatcaagaagatcttcaacctctcgtccgatttcctcaccaagagagacgcgtgggccggtaccttcgaccacatcttcaccgagctcgaccaaccaagaacagattgcccagagacattaccggaggtgccatttgagagaccaactccacccaaagaacacggctggctctcagatttccagcgggagctcgtcgagctcgcgagcttcctaaacggcgactacatgctgacgagccttgcgcaggagaaccgtaagaagaagatgacagtcaaac

SEQ ID NO: 75836 - DNA, 445 bp, Zea mays
  Clone ID: LIB3079-026-Q1-K1-C5
cgaatggacagccgcctcgccatcgccgcgctcctcctgctcgcctccgcctcctccggtgccgctgccgcggacggcgggaaggtggccgtggcgctgtactacgagtcgctgtgcccctactcggcgcgcttcgtggtgaaccacctcgccaaggtcttcgcggacggcctccgcgaggtcgtggacctcacgctcgtcccctacggcaacgcccggatccaccccggcggagagatctcgtgccagcatggtccgtacgagtgtctgctcaacaccgtggaagcttgcgccatcgacgcctggccggatctggatgtgcatttcagcttcatctactgcgtggaggacctggtggtgaaacggcagtacaaggactgggagtcctgcttcgagaagctgggcctcgaccccaagcccgtaacagaatgctacaaaagcgagc

SEQ ID NO: 75837 - DNA, 421 bp, Zea mays
  Clone ID: LIB3079-026-Q1-K1-C6
atagcttctctgcctctctctcccgtcctcttctctcgtccactcctttgtcgaaagggtcgatatggctcagcagcagaaggtggtggtcagggtttcaaccatgacagatgacaagatcaagcagaaggccatcgaatctgctgcggacatttacggtattgactccatatcagcggatctgaaggagaacaagatgaccatcataggcgagatggatgcagtagcgattgccaagaagttaaagaagattggaaagattgacattgtgtctgttggacctgcaaaagaagaaatgaaggaagaaaagaaagaggagaaaaaggaggaaaagaaagaatagaagaaagaggagaagaaagaacagaagaacgaagacaagaaagaagaaaagaagtgataaacctattaaacatatata

SEQ ID NO: 75838 - DNA, 424 bp, Zea mays
  Clone ID: LIB3079-026-Q1-K1-C7
ggctgggctggaatccaggcgattccaaggacggtgtggctggaccccagcgggaaggagctgctgcagtggcctatcgaggaggtggaggcgctgagagaaaagtcggtcactctcaagaacaggttaatcaaggcaggacatcacgtcgaggtgaccgggatacaaacggcacaggctgacgtggaggtgagcttcgaggtgtcgccggcggccctggccggtgccgagacgctggacccggcgctggcctacgacgcggagaagctgtgcggcgtgaagcgcgcggacgtgaggggcggcgtggggccgttcgggctgtgggtgctggcctccgccaaccgcaaggagagaaccgccgtgttcttcagggtgttcaagcccgccgtcggcagcgacaagcccgtggtgctcatgtgcaccg

SEQ ID NO: 75839 - DNA, 383 bp, Zea mays
  Clone ID: LIB3079-026-Q1-K1-C8
cccacgcgtccgcccacgcgtccgggacggcgacagggaggagggaagctatgcgacggtgctgcagcggtggtcctcgtcggtgtgggccgtcagcggcagcgggcgcctgctgtgggcgggcaacgaggcgtggcgggcgcacgtcgggatggccctcgtccaggtcgcctacggcggctaccacgtcctcaccaagtccgtcctcaacgtcggcatgaaccagatcgtcttctgcgtctaccgcgacctcgtcgcgctcgcgctcctcgcgcccatcgccttctttcgcgagagaaacgtgcggcgcccggtgactcctcgcctcctcgcgtccttcgctctcctcggattcactgggatcttcgggaaccagctcctct

SEQ ID NO: 75840 - DNA, 270 bp, Zea mays
  Clone ID: LIB3079-026-Q1-K1-C9
aaaaaaaaaaaaaaaaaaaaaaaaagattataaaaaaaaaaaaaaaaaataacaaaaaggttaaaaaatctaggaaagaataacaccaaactactatctcttttacacccttcactcttttacctcatctttaattcaccccactgtctactccatccttccaccttttatcaacttactgcttccacaattaaatccctttcataataaaatccattaccccatcaaactcattacctatccatcctaaatccttttctatactttcac

SEQ ID NO: 75841 - DNA, 422 bp, Zea mays
  Clone ID: LIB3079-026-Q1-K1-D1
cgggccctctctagtttgtaccccccaacattggcctgatgctgctgccatgtatcccatgtattgagcgctccccccgggggttcaccggcggcggcaacgacggtgaaaactacatcgggtgctagctccgacggtggtgcgtgccctgttgacgatagggcgcgcggtgcgcgggcagcttgtaggcgttcgatcggccatgtagggcaactatacatctttggcaggtctccatcatccttcctgggagagaagatgcatggtaatggagtgcgtgtgtatgtatgtgtatgcccatggcgcgcgcgcgcggctctgggcgaatcacagtagagatgcaatatcatgtatccagtatctttcttacaacacaaacagtgagaaattattagtcaagtgtgcattgtggtgcaagcact

SEQ ID NO: 75842 - DNA, 388 bp, Zea mays
  Clone ID: LIB3079-026-Q1-K1-D11
cccacgcgtccgcccacgcgtccggtctcgcccaccgttggtggtgggggatacaagggtgcctccgccaacggagtgatggtgcagaagccgtccaactggaagacaaggatctgtaacaagtgggagatgactggatactgcccatttgggagcaaatgccactttgctcatggttctaccgaacttcacaagtacggagggggcctcgtggacatcgacggcagggacatcttgtccactcctgattcgaagcaagccggtggctctgctaaagctcctctagagtctgctgctgcgtccactgcgttgccccctcatgcagacgtgtaccatctcggcatccagtcgcagcgctcggccatcgccagccagaggtctggacagc

SEQ ID NO: 75843 - DNA, 398 bp, Zea mays
  Clone ID: LIB3079-026-Q1-K1-D12
acgcccacgcgtccgacctctagtaaaaactcacctctatgaacgtggatcttactattgggttgacccagaatcctgggacacaatacgcaaggacaactttgttctccactatgagatggtagagaaaaggccagttctgccttcaacatcaccaaaccttagatgaaaagaaaatctaggacggagagaggaacacagaaacatattacgatctgcaggaaggactaaagatgcaggaagtcgcagaacagaattgatgatgtccaattaacaccccttgtgattactaaaactgtgagcgaatgttacgttgttcttgcactaaccccttcgctctcctaatgaaactgtctaatgttcaggattaggtcctcttcagcttcaagataacaacg

SEQ ID NO: 75844 - DNA, 454 bp, Zea mays
  Clone ID: LIB3079-026-Q1-K1-D2
aattcccggttgctagccactggttcgcccacgcgttcgctggaggattcacattccgttttgttgcagtgctgccagttttgtggatccgaataaatacgtgggtggtgataaacctgggtggtgacacatggatgagagttggcatatggctgctgatgggtgttctcctgtacattttctacggacgaacccacagctccctaacagatgtcgtctacgttccagtaacgcaagctgatgagatgtacaggagttcatcaggatatgtatcatagaaaagaacagtcgcagttacttcaaggtggctggtcattcagttgtagataattggttatcaaccaggaaagaggggaattggctgttatttatttcatgctttggcaacaagatctcgtggatgcaactttgcaagatatatatgatgttcactaacctggtcaatttacacatt

SEQ ID NO: 75845 - DNA, 428 bp, Zea mays
  Clone ID: LIB3079-026-Q1-K1-D3
cgacaatgcattcatggacggggaaggatacgggtttcagtctgaactgagagttttgaagagcagcagctgtgttcggctcacagttgcaggggtcggcagagtgattgaatccttcaaggctcttgagtacttggatgttcggtcatgccctcaggttacaagggacagctgcgagcaagctggagtgcagtttcctgctggctgtaaggtgaatttcgatggcagtttgctggaatctgatccatctgctgagatgttcttctaaaatgtgatctcggttgaaatcagatttagtgtgaactgcaaaactaagatttgaagagctcggtcatggaggcgagtgcttgacattgctgctgatctttcactgtcaaaatctatgcaagaacctgagaccacaacggatgcaagccatgatcatattc

SEQ ID NO: 75846 - DNA, 408 bp, Zea mays
  Clone ID: LIB3079-026-Q1-K1-D4
aatcacatcgccatggcagccaagatgtttgcattgtttgcgctcctagctctttgtggaacggacactagtgctacccatatcccagggcacttgtcaccactactgatgccattggctaccatgaacccatggatgcagtactgcatgaagcaacagggggttgccaacttgctagcgtggtcgaccctgatgctgcagcaactgttggcctcaccgcttcagccgtgccatatgccaatgatgatgccaggtatgatgccaccgatgacaatgatgccgatgccgaatatgatgccatcgatgatggtgccgactatgatgtcaccaataacgatagctaatatgatgccaccgatgatgatgccaaacatggtttcaccaatgatgatgccgagtatgatgcct

SEQ ID NO: 75847 - DNA, 250 bp, Zea mays
  unsure at all n locations
  Clone ID: LIB3079-026-Q1-K1-D5
tcgtgggaactgtgttaggtcaggtcccttgttgtccttgcattttcagactatgtatggaacgcatttgggtaatgtacnntattcggcgagatcaactcatttcaagtaacctttctgtctaatgtcttcctatcctgttaatcgtctcttaganntgtttggcgtgtcctggtttgagatttcagtctgctagtctgcataattctgtaccttgttgctacagtctatttgtactttcttaatgtaa

SEQ ID NO: 75848 - DNA, 222 bp, Zea mays
  Clone ID: LIB3079-026-Q1-K1-D6
cgggcctcttttcctttcgcttccgctgggctgcaccgagtggaaggtttgcatggggaaacatagggggaaaaaactttatatgacctgagatgtttggttgatgactcgatgtattctcgtgccttcatggagagagaaatgactgttcacgatttcaactttttccggtgtattagtagtcgaatggagacttgcattggaagagtttcactttgctgt

SEQ ID NO: 75849 - DNA, 391 bp, Zea mays
  Clone ID: LIB3079-026-Q1-K1-D7
tcgtccggtctcagctgtggggtaagatctcggctgcgccttacaatggttgccgcctcggtcgtcttcttcggaacggttttaccgaacgcttcaaccaaccaagaagaagttgaaccggttaaacttcaaccaggttataaggagactagagaaaacagcaaggtatttcaagaatttggataccctggggttctggtccaagttggtgtacacaattgtctctgctggaattttggcattctatacagttgtcacggaaaatgtcacagcaccctacacattatatgagactgctgctggtattgctgctgcttatatctcatccttctggtcatttggttacatccgtctctctgaaaggcttagaagaacatcaaaggaacctgct

SEQ ID NO: 75850 - DNA, 433 bp, Zea mays
  Clone ID: LIB3079-026-Q1-K1-C12
agatcgcgagcgccgccctttttttgtttttttgatccagttttgtcttgcgtggaggtcctggtcttaaaggagacttttgtatgcgaaggtggactacctgatgtcgtacctgcatatgtgcttgtacttctttcatgtttagaagtgccaacctctgcattacctaacatcttcaagctaccttttttcggacggcatcttggacattgccacttcccagggggtagacgcttaagaggaggattgaggcattccaagtggtaaacactaggacagctatcacaacatagcagattgccaccaagatcacattctacacactcaaaaaaatacccatcgtgtcctcttatcttcttggctgatggagaaatgttagtgtcatgcttcaacttctttatggtggaaccatggctcattggagagtcaaatg

SEQ ID NO: 75851 - DNA, 307 bp, Zea mays
  Clone ID: LIB3079-029-Q1-K1-B7
cggacgcgtgggacgattcattggacacgatgtacgaatacatgtcatagcgcatgcacgagagccattcctttggacagcacgacagcttatctagatgcgattctttcagcagcaatgctgacaacagtaggaatgacactcttgcgaggattgattctttgcacatcacttcagatcaaggtgggggcaacatgttgacgaggtacgatggcacgaacagcagctgcaaccatgactgaatcgctacgtctgcgaggataggttaggtgaagagcatggactgcgacaatcggtgctactctgt

SEQ ID NO: 75852 - DNA, 448 bp, Zea mays
  Clone ID: LIB3079-029-Q1-K1-B8
caaccagcacacatttccctttggcggatcgaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattcgacgaggatgcaggccggccatacaggaagttcctgtaagcggcgtccagggctgcaggagacgtcgatccctcgaccggggctgcgaggaggggagtttccattcagtttgtgtcggtattgttttagtctgaatctgatggagcagtttggaatgctgaactattgtgcctgatccaaatgaataaggtgtaatgactcgtcttttcaattactgaaactgaacatgttt

SEQ ID NO: 75853 - DNA, 223 bp, Zea mays
  Clone ID: LIB3079-029-Q1-K1-B9
ggccacctcttcccaattgcatcgcatccccaggacttgccggccggtccagagacggcgataatgggggcttctgaggtgtggtcaccggtgccggcctggctggcgatcgccgtcggcttggcggccgcggtttcctcgtcggaggctcacgtcttctacgccggtggccgcgacggctgggtccttgaccccaccgagagctacaaccattgggccgggc

SEQ ID NO: 75854 - DNA, 247 bp, Zea mays
  Clone ID: LIB3079-029-Q1-K1-C10
ggagaactagatttcgctgtctagttagagatctggcctgggcttggggttaataagaggaggcaatgctagcctgccctttcgatgaggaggtacatacacgctggcgatggaccgcgcttgtgtgtcgcgttcagtttggcttttgccaagcagtaggatagctgcccgtgtcagtaattatatggtatgaaccatcagcttttggctatacatggtatgaacgtaagatacaaattccaactaa

SEQ ID NO: 75855 - DNA, 270 bp, Zea mays
  Clone ID: LIB3079-029-Q1-K1-C11
ctctccaagtgaggaaccccaaggccgcgccatggcgttgcggatcctggcccgatccaaaggccttacccttgtcggcggccttaaccctggcgctgccaaagcaacaacgcctattgccggagcccgcgcgcttttgtacctgccccgctacccgtctgccccgtcggcccatgggctctgcaagggtctgggatatgaaccaacatcttaccttagtggaccacaagttttacctcgttggttttcctctctagcattcaatggatc

SEQ ID NO: 75856 - DNA, 357 bp, Zea mays
  Clone ID: LIB3079-029-Q1-K1-C3
cgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatccgcagtcatcgtcgt

SEQ ID NO: 75857 - DNA, 439 bp, Zea mays
  unsure at all n locations
  Clone ID: LIB3079-029-Q1-K1-C4
cctcagtagcgtagcgcatgtggcaatattatcgcgtctaacgacgctggcattcactgtgtcatcactcctcggactcacggcgttgtcacgtctatatgcctntcacggccgcgtngagctcgtggctgtgccgacgtagcgactcagtccagcgcggcgcatccgcatgtgctgtgatgctggcaacagcctacaaggatgactgcactgctcgcaagcaccgtgcctgctgtgaacagctctgtctcggagcgtcgttcgtcagccaacacctgactcaccgggatgaaccttaggctgatgctcaacttcgtcggattctaccagatctgcaaactgagcatgattccggtggtctgtctcatggcatgggtgctcaacagcaagcactacaccactaaggtcatatccgcagtcatcgtcgtggccgacggtg

SEQ ID NO: 75858 - DNA, 313 bp, Zea mays
  Clone ID: LIB3079-029-Q1-K1-C5
cccactcgtgcgccggagcacgcgacggctgtggaccctaagaatggcagtctgagcgccattgtctccatcggcatcggcttcatccagggggccaacatcatggtgggcggctccttctacggagctttcattaaccgctgcttgtccttctgccgagacgttgtcagatgggagtggggctaccagtgggcgtactgctttggaccactcatcggcggctgactggacgacgttatctaccagctgctactcatctgccacacccacgagcagcatccctgcagcgactactaaaagccgcagccgaccg

SEQ ID NO: 75859 - DNA, 413 bp, Zea mays
  Clone ID: LIB3079-029-Q1-K1-C6
caaaacagaaggatcaagttaaagatgaacctgtggatagcagcccatctaaaccagcaccatcaggacatgctcgaggcacacctccggcatccaaatccaagcaaaagagaaaatcaggtgttgatgatgcaaaaacttctagtggtgcagcttcaaagaaagcaaaggtggaattggatgcgaaagcatcaggcctcaaagaggaggcatcatctttggcaaaacctgcatcaaagacctctgctgcatcaaaaagtgggacaagcgtatcacctgtcacagaggatgaaatcaggagtgttcttcttgcagtggctccagtcaccacacaagatctggtatccagattcaagtctaggcttcgaggtgcagaagacaagaatgcatttgctgaaattctgaagaaaatt

SEQ ID NO: 75860 - DNA, 375 bp, Zea mays
  Clone ID: LIB3079-029-Q1-K1-C8
gtgctcccacacctacccagctcaaggctatgctggcctcctcgacccttccttcccaggacgtgatgaatgctctcctcgaggctctctttgacggtgtgggcaagggatttgcaaaggaggtcgtgaagaacaagaagtaccttgcagttgctgtgccagatgagggtgcccagaccctgctggttcaagccatcgaggcttttggcagcaagtgcaaccccgaggcgctgaaggaggtcccagttgtcctgaaagccctgtacgacggagatatcctggaggaggaaaccgttgtggactggtacaacgctgctgtcgcagctggaaaggactcccaggtcgtcaagaatgccaagccgtttgtcgagtggc

SEQ ID NO: 75861 - DNA, 396 bp, Zea mays
  Clone ID: LIB3079-029-Q1-K1-C9
cccacgcgtccgggaagccaccgctctccaatcgcctgcttgccttcccatcctccgcgtaggtctccggcaccgggcaccatgagctcctactccggcgaccgctcctcctcctcctccttgcgccccaccaacacctccttcgactcctacaagttcgacttcggcatcaactcctcccgctcctccggctctcgccccctccgcgaccagcggccgggcgcggctaccaaccctccaacgaggcccgccaccggcgccacgtggatgcaccagcccgccagcgccaagccgacgtggacccaccagccttcctccgccgcggcgtctgcgcccaccatggctgggcctggatccgggccaaccttcatggtctgcgacatcttttgcctgagc

SEQ ID NO: 75862 - DNA, 330 bp, Zea mays
  Clone ID: LIB3079-029-Q1-K1-D1
cgcacgctcaggatccacatcttcccgagcgagttctcggacgacctatagctattgggaccacctacaaggctcttggagtaccttgccactgtcaccaatcaaggtttcatgtcagaccttgacattcagatgccaactgccttcgatcccttcgttgaggccaatgctcgcgactctggtgccgccgcacggtcaaacgactacgtacacgtgcgcattcagcagcgtaatggtcgcaagagcctgaccaccgttcatggattgcagaacgagttcagctacagcaagatcctcaaagatctcaagaacgagttctgctgcaatggt

SEQ ID NO: 75863 - DNA, 246 bp, Zea mays
  Clone ID: LIB3079-029-Q1-K1-D10
ccgtgatctctaattctcactatctcgagttaataacggaagcttgatcatcttgccttgcggtcttgataaagagcagggcattcgtctagcttctgtagtctgatatcattctgtactcgctgactccatgctactaagccttcggcttcatcaggaaacccaacaagtaaccgacttctactagaaagccatacctctcttactattatcaggaccaccaaaactgcctcttgatctgttgct

SEQ ID NO: 75864 - DNA, 370 bp, Zea mays
  Clone ID: LIB3079-029-Q1-K1-D11
gtatactagcatttagcagctcatcaacgcgctcaacctagcacgacgtacggcgaggaggcgccgcggcagcaactgctcgccgcttgcggctgctgccctgcccctactactcctcctcgtcgccggctgcttccactgcatggcagcggcggctcgccacctgccttctcctggcgccccagtccaagcgctggatcaccaagccgagaacggagtcaaggctgcatcagctggcgcagacggcgccggcggccttgtgctccaggaaggtggcacgggcaacaacggcgacgacctctcctacaaaaccctcctcgagacgacgacgacgacgatgggagcggaagcgtgccacgaggggaacgac

SEQ ID NO: 75865 - DNA, 334 bp, Zea mays
  Clone ID: LIB3079-029-Q1-K1-D12
ggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggccggcgccgtgat

SEQ ID NO: 75866 - DNA, 396 bp, Zea mays
  unsure at all n locations
  Clone ID: LIB3079-029-Q1-K1-B6
aaaaataaaaaaaagaggtagcaagtgaagagggagaaaaaagagatgtgttattgtaggtcttagtacatcctagtcttgccaatgcagctcaaaagaaaaaagaggtagcaagtgaggagggagaaaaaaaaagaggtgttattgtaggtgttactaatgttgtagctgttgtgcagttgtaaatcccccttcggcagctggttttatttcctgatgtaatgtaagcaagagcaaggtcctgtcagatgcgtgcgctgaaagtctgaacctccgataatatctgatgcttcttgtagatagctgtttcagaattttcggttaatgaacccagttactgcttgcttgttgatctattttctgtgttgctatctgatgggatngttgtggtgaaaa

SEQ ID NO: 75867 - DNA, 445 bp, Zea mays
  Clone ID: LIB3079-029-Q1-K1-D2
cgacgactacggctacggctacgccgacgaggacctcggcctcatctccaagaaaggcaacatcaacagcggacgcgctagccaggtccagggaggcgccgccgctaagaaggacgacgacgagtaggcctcgccgcctcggctcgcccgcccggtcccgtcgatcgccagcaagaaccaacaagcccttctgtctgtttaattccagtatcagttcgattctcatgttgaataatcatgatcatgtgggtttaggtgtcgtgctcacgagtatgtagtgtagctcctgctagcacagagcacagcacagagccactgggcgatcgacgggccgtgcatggcctgtagataccatctcatatgttcaccactgctactttgctcatgttgggggcctctcctgaactgggttcctggatgaacttgatttctattagttttccgg

SEQ ID NO: 75868 - DNA, 372 bp, Zea mays
  Clone ID: LIB3079-029-Q1-K1-D3
cccacgcgtccgcccacgcgtccgggaaatttatccagatgttcttccttgcccctcaagagaagggttactttgtcctcaacgattactttcacttcgttgaccaagaacatgtgcagcctgcgccagtgattgctcaggaagactacgagagcaatttggcacccaacacagttgttgagaccgctcctgagtacgttcacgaggaagaagctcaacaaatagcacctgaagtacatgatgtggtcgaaaactatacttattctgagccacaacagcaagtagtgtctgacaactggggagaggagcctctttctgaagaaccggcttctttctcaaatgaaatggcagtcgctcctgaggagccagttc

SEQ ID NO: 75869 - DNA, 357 bp, Zea mays
  Clone ID: LIB3079-029-Q1-K1-A1
atgagacctactcggaacattccaagcacaataatgcaccaaccatggcagatcaaatattctgcctccttatgctcctcggtctttctgcaagtgctgctacagcgaccattttcccacaatgctcacaagctgctatagcttaccttctttacccgtacctctcaccaacggtgtctaccgtatgtgaaaacccaattcttcaaccctacaagatccaacaggcaatcgcatgctggcatcttacctatatcacccttgatcctccaacaatcatcagccctattacagcagttacctttggagcatttattggcacagaacatcacggcacaacaactacgacaacttgtgcta

SEQ ID NO: 75870 - DNA, 276 bp, Zea mays
  Clone ID: LIB3079-029-Q1-K1-A10
acgcacttatttggacagtcttgggtgtcaaggatccaatttctgcagcattgtcaattgtcaggggaggtcttacacctattgatgtggtgtctgttgaatggattcaaagtgggactatgcattatggtacaaccgtatcatattttggctttgttagcaatgttcttgagctctcagactagtatcataagcattttatttctttacgatactgcgtaactggttctctctaattactgtgtttgccaaaagacaattttgaataaggatatt

SEQ ID NO: 75871 - DNA, 413 bp, Zea mays
  Clone ID: LIB3079-029-Q1-K1-A11
gtaccgattcgaattcgaggacgcgtacgcacacagcgaggtctgcggcggatgatgatttacggaaggccatggaaggtcttctggaacgcgctgaggaggaagtaccaaggggttcggcaaaagttcgagctgtctttagtagtggcagtggaaaggtggccggatgcatgattacaacaggaaaagttgttcaagattgtaatgtgcgggttcttcgtaaagggaaagaagtatatgtgggttcgcttgattccttgagaagggtgaaagaaactgtgaaggaagttggtgctgggctagagtgtggtattggggtagatgacttccatgaatgggatgaaagtgacatcatagaggcattcaataccgtgaataagctgaatggtgagctgaaactattgtgctgaaac

SEQ ID NO: 75872 - DNA, 343 bp, Zea mays
  Clone ID: LIB3079-029-Q1-K1-A12
cccacgcgtccggtctacccagccgcggggctcggtgccccggccatccatcccctgcgaatctcgatccgccctcaaagggagtcaagcctcctccagcctttcctttcaaatcggatttgtttgctcaagttgcaagatggataagaggaccaaggttgcagtttgtgttgctgctgcacataacttactgtcaatgatggccgtgattattgcgtctagaaaaagaaaacgaaatgcaaggagcgcacagattacctatgcaccattgcatgtgagtggtacaggctgggatgaagataattttgttattactctggatgaagagcactataatggttat

SEQ ID NO: 75873 - DNA, 389 bp, Zea mays
  Clone ID: LIB3079-029-Q1-K1-A3
gcagccagctcgagcccaaaggagagaacccaggttggcggcggcgctccggcggcgatggactccccctacgctctccacctcgccatcgccgcgctcgtcggcgcctccttcgccgccgcctccgcctactacatgcaccgcaagaccctcgaccagcttctccgtttcgcccgcgaccagcagcgccgccgcaaccgcctcctccccgaaggcgacgaactggaggacggcgaagaggaccctccgccgcactgggatcatgatcgccgcaccctgcccatcccgacgggcctcccgccgctccacaccggccgagagggtaggccagttgtttctccaggttcgactaaaagagttggacctattgttagaccgactacacccaa

SEQ ID NO: 75874 - DNA, 265 bp, Zea mays
  Clone ID: LIB3079-029-Q1-K1-A4
ttctacgatggtgatcggcgaccgtgagcttacatgtgctgtgttctgatacttgagactgttattatgactatgtataagatattgtctcttattagtattggatgatgagatgtatcttattatgactatggatgagacttttgagatgtcattgatgagactatggatttaaatattgttatgtgattgggtgtgaaaaataatgagaagcaaaaaaactgaaagacaagaaaaaaagaccctacaacggactgggatcatg

SEQ ID NO: 75875 - DNA, 442 bp, Zea mays
  unsure at all n locations
  Clone ID: LIB3079-029-Q1-K1-A6
gcctaaaggatatgggttcgtgcattttggagatctgaatgagcaggcacgtgctatgaccgagatgaatggaatgatgttatctacaaggaaaatgaggattggggctgcagctagcaagaagaatacagatgctcagcagacatatgcaactaatggtgcataccagagttctcaaggcaattgttcagagaatgatcccaacaatacaacagtctttgtgggtgggttagattccaatgtagacgaggagtatctaaggcaaatttttactccgtacggagaaatttcctatgtgaagattcctgtaggcaagcattgtggatttgttcaatttaccagcaggtcatgtgctgaggaagccatccaaatgctgaatgggagtcagattggtggacagaaagctcggctttcatggngccgtagtactcaaaacagacag

SEQ ID NO: 75876 - DNA, 306 bp, Zea mays
  Clone ID: LIB3079-029-Q1-K1-A8
cccacgcgtccgcaagcacttgctgatgagtatgggatcaagttttttgaaacgagtgccaagacaaacctgaacgtggagcaagtgttcttctccatcgcacgtgacatcaagcagaggcttgcatagactgattcaaagccagaggacaaggcaatcaaaattaacaagccagaccagggttccgaggcaccatctgcccatcgatctgcatgctgcggttcataagcagacgcacgatagccataatcattggttatttgacactatttatttcctgcttggcatttataggaagaatctgaa

SEQ ID NO: 75877 - DNA, 392 bp, Zea mays
  Clone ID: LIB3079-029-Q1-K1-A9
cccacgcgtgcggcgcaggtcctgttggtgaggacatgttccattggcaagcgaccgtcatggggccttcggacagcccatttgcaggtggggtattcttggtgaacattcacttcccaccggattaccctttcaagccaccaaaggtgtctttccgcaccaaggttttccacccgaacatcaacagcaacggcagcatttgccttgacattcttaaggaacagtggagtcctgctttaactatctcaaaggttctcctgtcaatctgctcactgctcacggacccaaaccctgatgatcctcttgtccctgagattgctcacatgtacaagaccgacagggccaagtatgagtccaccgcacgctcctggacacagaagtatgccatgggc

SEQ ID NO: 75878 - DNA, 429 bp, Zea mays
  Clone ID: LIB3079-029-Q1-K1-B1
attgtcactgcccctcttgggctgcatgagcttatggtggtatgtgcttgtgagttccctctgttatttctatcattttcagcagctgttagtagagaagccaagtagatatgacgtggatatggtttgcagttattaaaacttagcagttattttggaattttgttaacaaatagatctctagaattgctgtcctcttctggaaaaagaatgttgaaattttctacaaaacaaaattataagtaatatctatgtagatagtggccttgtcaaccttcatgtatgtgtaccttgatgttatgtcgtatttgcatagtgattatttttaaggtctaagggcatttaagtactgtatactgtaagggcttatgtagcaactagtgtcagaaatgaactataagtgtataaaagtgtttaaaaagcaatttt

SEQ ID NO: 75879 - DNA, 373 bp, Zea mays
  Clone ID: LIB3079-029-Q1-K1-B10
gatgaaattgcacaacatgcatcaaatgtgggaaacaaatcacatcatgcgtatacggtcagcaagggacaggatgggggatcatgatgtctgcgctgctatgtctagagcgctgatggataaaagtgaaacaatcacactagatatatgtacctctattatgcctgtcgtcaccaatcttctggacagcaaaatagacagacactcaatcatcgcatcggaatcgttcgtgaagcttgtaacgacttcatgtccaatgatacatacaacagtatcgacaggtccttgtgttggactagaccttgatgcagaacatacgacgcagcgctgcaacttatgcttcatcgaattggagaaagccaaaaataatctt

SEQ ID NO: 75880 - DNA, 365 bp, Zea mays
  Clone ID: LIB3079-029-Q1-K1-B11
cggacgcgtgggtttccccatcacccatgcttacgaggacagcctcttattcgccggctgggcgccatagaccagcggcacgatggaggtccgcaccgacatgtacaacaccaacctggacggcaccaaggactacctatctgtcggcatggcctccgtcccggcgatctacgcctacttcgccgtctgctatgtcgtgttcctggccggatggctctacgtcaccctctaccgcaaccgactgtccgcgcagcgcatgcaccacctcatgtcgggcctgctcgttgcgcggatgctctactgcatctcggcggccgacgaccagcactacattcgcaccgtcgggacaccgcacgggtgggaca

SEQ ID NO: 75881 - DNA, 398 bp, Zea mays
  unsure at all n locations
  Clone ID: LIB3079-029-Q1-K1-B12
cccacgcgtccgcgatcggtcgaggcgggtaggacaggatctagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcccaccgccgcctccgccgtcggcctcgccggcccaggcgccgcggatgtgctgccgtacgtggaggcggatctcaagcgctccgncctgcgcgtcgtcgaaaaagccaaaggcctctgcacacaggcgagcgacgctgtgtttgaggccctctgaggggaccct

SEQ ID NO: 75882 - DNA, 390 bp, Zea mays
  Clone ID: LIB3079-029-Q1-K1-B2
cagactttggtcttgcaagggaagtttcatctttgccgccatatacagaatatgtctcaactcgctggtatcgggcaccagaagtattgctccagtcatctgcttatgattctgcagttgatatgtgggcaatgggtgccataatggctgagttgttgacactccatcctctctttcctggaactagtgaagctgatgagattcacaagatatgcaatgtcatcggtagtccagatgagcaatcttggcctcaaggattgtcacttgcagaagcaatgaagtatcagttcccacagatcaaaggcagtcaactggccgaggtgatgacaacagccagtagcgatgcaattgacctcatctcatcactatgctcatgggatcctagcaaga

SEQ ID NO: 75883 - DNA, 350 bp, Zea mays
  Clone ID: LIB3079-029-Q1-K1-B3
ggcggcgacgcggcggcagagcagcatgctctgatcgacgcggacctgcgggagctcggggtcgacgcgcggaagctcgacaaccacgcattcgtactaggcggcgggctggggttcggcacctgcttactcaaatggctggccttcctcgccgcagtgtatctcttgatattggatcgcacaaattggaagaccaacatgctgacagctctcttggttccttacattttcttcaccctgcctaatgtgctgctttctctgatcagaggagaggtggggaaatggattgcgattattgctgctattctgcgtatattctgttcacgacacttcccagattggttagagct

SEQ ID NO: 75884 - DNA, 96 bp, Zea mays
  Clone ID: LIB3079-028-Q1-K1-H8
aaaaaaaaagagcaaataaaaaaaaataaaaaagaaaaaaaaaaaaagataaaaagaggaaaaaaggggcgggcgttctggaagaagcaagatgct

SEQ ID NO: 75885 - DNA, 429 bp, Zea mays
  Clone ID: LIB3079-029-Q1-K1-B4
gtcgtgttgattttgaaaaaacagtatagcattggcaacaggacaaatggactggttgtttccctgtcaagtggcacattgtgaaggatgttccaaacagcttgctgaagcacatcattcttgagaacaatgaaaacaagccagtgacgaacagcagagatacacatgaggtgaagcttgagcaaggccttcaagtgcttaagattttcaaggatcatgtctgcaagacatccatactggatgacttcggcttttatgataatcgtgagaagatgatgcaagagaggaaagccaaacagcagcagtcgctgaaaaaggtcattgatgtgaagctgcccagcgtcaccgacatggagagaagtcctaaatgtgagactggatcaacagaactcactgtggttgggactgacttcttgaacaaagagcgtt

SEQ ID NO: 75886 - DNA, 444 bp, Zea mays
  Clone ID: LIB3079-029-Q1-K1-B5
ggcagccgcaaacgccttcgccgtcgcgtcccgctcctccgcccgcccgacgcgacgcctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcagcaaaggtccgcgacaaaggttacctttcctttagtttggaccaatacctgctgcagccaccctctgtaccgtgagtctgagcctatccaggagaactaccttggtgtgagaaatgcagcacagaggaggctactggatgagctgg

SEQ ID NO: 75887 - DNA, 337 bp, Zea mays
  Clone ID: LIB3079-028-Q1-K1-F5
gattttgatgttcactgacacaacctttgttgtcatcgagtgcgctttgtgttggagtttttctttagttcttcccagtttgtgagttgtgacatctagtcatctataggtttataggctggacgatatggggtgagagattgtgcgtgcccatcttttgtcgggcttgggcaaagatatgtcgagatgtttactttctctgtagaatttcgtgaagctgttgcattgttcgtttgaagatggcgacgatgttcagatgatgcttcatgttgaaggacatatctttatttgcttcattgtacccagattttatttgcttcatgttgaacgacagact

SEQ ID NO: 75888 - DNA, 406 bp, Zea mays
  Clone ID: LIB3079-028-Q1-K1-F6
ggttcgctcgcgtaccctcccgggtctatatgttgcctcggtctagaaatcgacgcgttcttctagctgctcgtctacatctaagcatgcctacacctgcggtttccagatagggtgtttggtacgatcgatcaacggagaatctcgctctgatatttgctcggtcgaaacgcgtggctatgctcttgagatgatgtgcaagatccgatctgattggttagattgatgagtggcgaatcgaattgaaacgagaccagggctgcatgctttgcgtgctccgaggcttctgatctggctgtttgctccgagactatcggtgcctgacccggcaaattgcaatctgcctaccttcatagccaggtcgatactgcgagatctagacgtagaaggctattaaagcgtggct

SEQ ID NO: 75889 - DNA, 231 bp, Zea mays
  Clone ID: LIB3079-028-Q1-K1-F7
taaaaaaaaaaaaaacaaaaaaaaaaattaaaaaaaaaaaaaaaaaaaaaaatataggagaattttttaaaatacatgggagaaaaataaataaaaaaaaaaaaaaaaaaaaataaaaaataaaaaaaaacatttatcaactttagggctcctcataattcttttcttttcctcacttatttttcttccatattattttccttttaccctatttaattcatctccaatatt

SEQ ID NO: 75890 - DNA, 357 bp, Zea mays
  Clone ID: LIB3079-028-Q1-K1-F8
cccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaaggagcaaccaggtgttctccaggttgtgccgagccagacttaccagctacatggtcctgggtctggcactcaccagggcacgacacaca

SEQ ID NO: 75891 - DNA, 356 bp, Zea mays
  Clone ID: LIB3079-028-Q1-K1-G1
tgatcttttatgcagtacaaagctttcggaatcagtgaaattctacaacatttatgggattgattatgatactccacggactgtctgctatggcagtgaacagcatccggtttcaagtcttagtagcctcttatatgctcagggaaaatacgtctatgttgatggcgacggatctgttcccgcagaatcagcaaaggctgacggatttaatgcagtggcaaaggttggggtggctgctgaccaccggggaatcgtgtgcagtcgccgcgtgttccggatcgttcagcactggctgcacgctggagaacctgacccgttctacgacccgctgagcgactatgtcatacttccaacac

SEQ ID NO: 75892 - DNA, 51 bp, Zea mays
  Clone ID: LIB3079-028-Q1-K1-G2
taaaactattatgcagtacaaaaactttctttatcaaaaaaatactacaac

SEQ ID NO: 75893 - DNA, 317 bp, Zea mays
  unsure at all n locations
  Clone ID: LIB3079-028-Q1-K1-G3
ctcaacttctcaaggattacatgaatggaactgagaaaacaaactttatatatcctagtgctgttgacaatttccgaaggcaatttgctaacttggaggaaaatggaggaaagagtgtggcgcacaccgcttcatcagacaggaagcatgtttcgctcccaaggacaaccacagttcattctaatccaatccctccaaatggaaccttccaagttccccgaaagattcccacaggtagaccaggaagagtggttggttcagtaataccatttgagaacgcaactgctgttgatccatacagtcaacgcanggtggtg

SEQ ID NO: 75894 - DNA, 365 bp, Zea mays
  Clone ID: LIB3079-028-Q1-K1-G4
tcgctgacgcgtgggcggactcgtgggcggacgcttggggcgctgcccatgcgttgccgtgatttaattagaaacttgttgtgaaaagaagttatttgtttttgcttgtcgtgcgcactgggtaattcacttcatgttgtatgtttaactttcctttgctagccgattcataatacttggtatgttttgtcaaatacaaatggaaccttccaagttccccgaaaagattcccacaggtggaccaggaagagtggttggttcagtaataccatttgagaacgcaactgctgttgatccatacagccaacgcatggtggtgaggaatccagtgctttcttcagtcacctcagacctgtcagcttaca

SEQ ID NO: 75895 - DNA, 234 bp, Zea mays
  Clone ID: LIB3079-028-Q1-K1-G5
agcggagcccccaggccaggccccagccactcagcctcctcagctgatcaaccgggtacccatctgctcagcctgagctgtcattcccgcgaagcgccgtctcccggatctattgatggaccgagtcgccgacctggtcgtagcgctcctcgtgctcttcttggtcgtcggggccacggagcacgccccggtcttgtcgcccaagcgcactacagcgccagcgctacacaggac

SEQ ID NO: 75896 - DNA, 360 bp, Zea mays
  Clone ID: LIB3079-028-Q1-K1-G6
cttttcagagagttagctgatgacaatagcaagtttgggaagttgacattagcccggctattgcttgcttgtgctgctataaaatcccgtggaagatctctaattgaaaggaagggatactgtgaagaggcactggggctcttcactgacttgattcacctggatccatctcataagcagtactatgaggatgaacggagcttagccctgatggataagttaacatgtgacatggagactttcacgaagcattgttctgttcaggttcaaccaaattcagctcccctgcatcatgtgcagtttcgcagattgtctgtaacacgcatcggatttgctgagcgcctgttgtgggttcaaatg

SEQ ID NO: 75897 - DNA, 407 bp, Zea mays
  Clone ID: LIB3079-028-Q1-K1-G7
tccacgcgttcggacgctttttgcagagatccaaccgatcgtgccagacaaggggggtctattgcaggagtcatacaaaaacttcaagatgggtcagattaagaaagaccagttcatccagttccttcgcaattacgtcggagaccaagtgctgaaaaccgtggccaagaaacttcgacgatgctaaatttctagtgcgcggtgcgacatcattatctccttgatttctactcgagctgtctgtagtagtgctcagtagagatgaggaggttcacttctgtttctgttgattcaagtttctgtcaagggcttatagggggtttggcgcgctgttcttacattaaccaacagtgcaacacataggatagatgcagtttctgatactgagacgtttgattcttctttta

SEQ ID NO: 75898 - DNA, 385 bp, Zea mays
  Clone ID: LIB3079-028-Q1-K1-G8
cccactcgtccggacgcttcttgcagtgatccagcagatcgtgccagacaagggtgatctattgcaggagtcatgggaaacttcaagatgggtcagattaagaaagaccagttcatccagttcctccgcaattacgtcggagacgaagtgctgaaaaccgtggccaagaaacttcgacgatgctaaatttctagtgcgcggtgcgacatcattatctccttgatttctactctagctgtctgtagtagtgctcagtagagatgaggaggttcacttctgtttctgttgattcaagtttctgtcaagggcttatagggggtttggcgcgctgttcttacattaaccaacagtccatcacaaaggatagatgcagtttctgatactg

SEQ ID NO: 75899 - DNA, 362 bp, Zea mays
  Clone ID: LIB3079-028-Q1-K1-H1
cccacgcgtccggtgccacctgacgagagcagcccatcaccgccaccgccgcatgcgcaggctccctatgcctctccaccaggggtagactcgaggcatggatattctcaaccggaggcaagacctgcatactcgcagccataccccccatcctatggggcgacaccgcaacagccgacgtatggtgcacaacaccccgggcagtaccagccgcctcctggccatgactgcggtcagccggcatatcctggatggcgcgggccatacccatactacaatgccccccagccgcagcaatctgtgccttgtccacaggcgccgtacaatgccactggggcttacccttcgcaccagagcaacta

SEQ ID NO: 75900 - DNA, 302 bp, Zea mays
  unsure at all n locations
  Clone ID: LIB3079-028-Q1-K1-H2
gtcggaaatcgagggtttggtaagcgagatcgccgccggtgacagactgacagggacgagatggactccggctgaggcggcgtcttggccgccgtgctctgcatgctgctggtcttcgccatcttccttctcctnctctggcgccgccactccgatgccgccaccgccgataaccaccgtgtcccgccccagcccctccaggaggatcaggtgctgcacggtctcactgcggcgcgacggatgcgtctgaagcctggggctgccggagcaagctcctctactgcgtcaactagccgcaatgc

SEQ ID NO: 75901 - DNA, 364 bp, Zea mays
  Clone ID: LIB3079-028-Q1-K1-H3
gcgccgcaggaggacgttctgaaacacgaggcactgggctgctacgtcacgcactgcgggtggaactcggtgctggaagctgtgcggcaaggggtccgcatgatctgctaccctgtctccgcagaccatttcgtcaactgcgcctacgttgttaacgtgtggaaggtcggggtggagctggccaccagtggacagggtgatgtgaaagactgcatcgagagagtcatggaaggcgacgatggacggcgtctgcagcggaaggtgaatgcgttgcgagaaacagtcacggcgggtgaggcaatgcgtgctgccaagaggaacctcaccttattcatggacagaatcaatggcagttagcgccaga

SEQ ID NO: 75902 - DNA, 429 bp, Zea mays
  unsure at all n locations
  Clone ID: LIB3079-028-Q1-K1-H4
gcttttcatagtgctcaattggatccatcccctgagcataggagaaaagtatcaagttgtacagtggatccaagtattctataaagcatgcatgctccaatttcccacaagcgagaatggcatgatatgatggatgaaatggctgttgcggtcaaatgtctttcaaggatcaattgtctttcaagaaccacacttatgtattggtttgtgtgcagttcaagctctgcaaggtaaggtctgttcactttggccagaaagtcatgccctacctgaacacctacgacgaccgcaccatccgacttcgaccctctcatcaaggccaacgacaccatcaagatcgatctggagaccaacaagatcatggacttcatcaagttgtatttgccatntcatagacttcatcaagttatatactttagtaggctcaat

SEQ ID NO: 75903 - DNA, 296 bp, Zea mays
  Clone ID: LIB3079-028-Q1-K1-F4
tcggtcctcacataatcatcttcattcactcactctcttcgatcactgtactgaagataccatggccaagtcgaccgcgatgtttgtagccgacctggccctggtggtggtgatggcgacgactagcacaggcagtggcatggcggcagcggcgtgcgatcccaagccgctggtggtgtgcgatccggcgttcatggacggagcgaaacccggggcagcatgctgctacaccctgcgtgcgcaggatgcatgcttgtgcgtgtacgccatagaccccaagtttgcaaaatacatta

SEQ ID NO: 75904 - DNA, 380 bp, Zea mays
  Clone ID: LIB3079-028-Q1-K1-H5
gcaaagctttctggtggagttgctgtggttaaggttggagcatcgaccgaggcagagctagaggaccgcaagctccgcatagaggacgcgaagaatgcgacttttgcagcaatagaggaaggtattgttccaggaggcggtgcagcatatgttcatctatcgacattcgtaccggctatcaaggagacgttggatgatcctgaggagcgcctaggtgctgatatcattcagaaggctttggtggcacctgcagcgctgatagcccataatgctggggtggaaggtgaggtgattgtggataaaatccgggaaagcgagtgggagttcggttacaacgccatggcggacaagcacgagaacctggtggaggctggtgtgat

SEQ ID NO: 75905 - DNA, 437 bp, Zea mays
  unsure at all n locations
  Clone ID: LIB3079-028-Q1-K1-H6
tccaattctaaccccttcctatcgaccatcattctcccctctgcctgcgtcgtgctcgccgccatggaccttgcggacgggcgagacgacgccctcaatggaggcgtcggcgtcggcgtcggcgtggaggagacaaggaggaggaggaaggtggagctggtgcaggaggccatccgtggcttcctggaggagaagaggagcgatggccagggaggaggagaggagcgcttgacggccaggctcagggaggaggagcaggagctcctgttgtcgttgctctccaagttgggcgagctaaaaaccgaccccgatccagacatcttggaagaaccgagctccttccgcccggaccacggtcaccagcctgcangaggaagcgaacgcagcaaggaggtggagccagctgacatcggccatgacctgagcaggatcaagag

SEQ ID NO: 75906 - DNA, 271 bp, Zea mays
  Clone ID: LIB3079-028-Q1-K1-H7
ggatagttgcggcgactcgaaagattacgcctgtttatttgttgatgcttggtgtggaggcctggtgggtgctcttggcacaagttacatgctggggagctataggagggtacctgttgcgttgtggaagacagtagctagtattatgtgttgtaattgtatgccttcgtttcatgttctgggtgcgtgacttgtcgactttgctgcttctggggttctgaccttggtaaggagagaataaagagataatatgagtgcgagatgcttgctg

SEQ ID NO: 75907 - DNA, 74 bp, Zea mays
  Clone ID: LIB3079-017-Q1-K1-H7
taaaaaaaaaaaaccactcaaactaaacatacaaaaaaaaatcctactacactgaggagcctctacaactacag

SEQ ID NO: 75908 - DNA, 419 bp, Zea mays
  unsure at all n locations
  Clone ID: LIB3079-017-Q1-K1-H8
cccacgcgtccgctcttgtcgaggtacgatgtacctggcctcgagtatcattcatcaactgttggtcgtctattcaaaagtggactaggtagattcgggcttggacagtctaaaccagccttcggtgatcaatctgttcttatcatttttgttcttggaggtattaatactcttgaggtccgggaagtcatgacagcgatatcggagagcagcagaccagatgtggagcttattctgggtgggacaacccttcttaccccagacgacatgtttgagttgatgttgggatcgtcaagctttgcttaggctcaaccttcactcttgagtcatgtgcgggacttggaaagaaatcggagcatatntttttcttattcttcagaatagttacttgtctgatgtagcagaagcattcagactcg

SEQ ID NO: 75909 - DNA, 375 bp, Zea mays
  Clone ID: LIB3079-017-Q1-K1-H9
cggacgcgtgggcggacgcgtgggcggacgcgtgggctaacgagtacaaagtacgaacgacacgcacacacaccagcaggcagccgcgcgcgggctcgatcgcaatggcgtccaaatcctccaatgggggccttttcctcttacgcgggttttctggttgtcctggtgcttgtggcgggttccacgcttgcccaagcgcaggcgacgccggcggcggcggccaacttcttgtggccctttaatgggttcgtgccggtattcaacattacaaaaggtcttggacttgttgcggagcttgaccttgacactgtgcgccaatggcttttgaacggtttggaaaggggtaatttccttggtcggcttcttcttcggttc

SEQ ID NO: 75910 - DNA, 231 bp, Zea mays
  Clone ID: LIB3079-018-Q1-K1-A1
tgcttggtgttgttgtagtttgtagctgtccgtgtgtagtaatatccggtattgatgctttacggtaccgttggtagcgctcggctgacttgacggtctttatgaagaaactgaagaagagtatagagagtactaataataagtcgtagtcggcgacgaaaagtggtaagcatatttcgggtcataagattggctcgaagatgtcgtgtaatcgtaaaggaaagtcgacta

SEQ ID NO: 75911 - DNA, 413 bp, Zea mays
  Clone ID: LIB3079-018-Q1-K1-A10
cgcaaattgcaccaagaaatccatcgagaggccgtcgacaggggaattaatggcgtcggcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggat

SEQ ID NO: 75912 - DNA, 428 bp, Zea mays
  Clone ID: LIB3079-018-Q1-K1-A11
ccacgcgtccggtgcaaacttggcttgaatgatagggttcttttggaggctcaaggcagagcggctaagggcaaagcgatagacctcgatgatatcaaatttcatcagtgtgtacgtttggctagatttgagaatgatagaactatatcgttcatacctcctgatggatcttttgatctaatgacatacaggcttagcactcaggtaaaacctcttatctgggtcgaagcacagattgagaaacattctagaagccgtatagaactcatggtgaatgcaaggagtcagtttaaagaaagaagcacagcaacgaatgttgaaatttgaatgcctgttccttcagatgccacaaacccaaatataagaacttcaatggggtctgctgcatatgctcctgagagagatgcaatggtttggaaaaataaatc

SEQ ID NO: 75913 - DNA, 390 bp, Zea mays
  unsure at all n locations
  Clone ID: LIB3079-018-Q1-K1-A12
cccacgcgtccggggggggggtagggagggcttcacgagcacagctttctcggtgaaggtaaagctgtttcggagacccgtttggcaaaacagctttgcatgtatttttagaacatgatctcacagaatcccagagagccgacaagtgtgaggggaagctgtgaaacgttaatattttcagctaatcccaccttattcccatgtgaaggcacagtttaaggagcttcatgggtgaagctgtttccaaaagacctgcttggcaaaaaaacagctcacaacatctcatgaaactgttggtgaagctgtgccaaatagacccttagttacacaataatacaccttgatcattatcagtaacagttatgttgntattggattcacagctgatgc

SEQ ID NO: 75914 - DNA, 397 bp, Zea mays
  unsure at all n locations
  Clone ID: LIB3079-018-Q1-K1-A2
ttggacctttgggctgatttatgtgcttgtttatgtgcttgtcttgttatggttgtagtgcttttaatgagtgtggntctactgcgctactcgcggagaatggtatgaagttggagcctgggtcggttttgtacggggctgagtaggtgtgtgtggttggtgaaaagccttggaaggagtccgatgagaccggcgcgttggcgggccttgctaagacctgccatctgttgcctctatggattattgagatggtcagagcggctgttggcgcgtctggtacttttcccgaagtcttcagccgtgaagtggcgtcgggatcctgcgagtgtcatcccgggttactacacgagccatccctatacgacaagcacgtagatacacgggtagcagacgaagt

SEQ ID NO: 75915 - DNA, 370 bp, Zea mays
  Clone ID: LIB3079-018-Q1-K1-A3
tttggcctttggtatgtgcttggttatgtgcttgattgttgtgagacttggtcttgtccttagaagtcctcggaatgttggccttacgagtgctcgactggttgttgttacgggtcgtgtcggacttatttttaaagctgatgagaatagtaagaaatcgaaaaggttcaaggtccggaagtacatttaattaaccatattggtatggtcgaaatagacgtgcgacgagcctcgggatatggtcttgtatcatggaggttaaaaagagactcgggacgtctcgagggccgttgtggagcttgactcagtttccgtatagattactgcggatagcgtcggaactactgcgctgaatttcgatacgatgtct

SEQ ID NO: 75916 - DNA, 409 bp, Zea mays
  Clone ID: LIB3079-018-Q1-K1-A4
acctttgggctgatttatgtgcttgagtcgggtcgctaaggaagttatcatccataactaaaataagcatacattaccctcgtgagacgctatcggcgaagctcctccccatatacgttatcgaactcggactcagtagtctagtcagcgatgcgaattatagacagcgttaatcgagaacgtagaacgttacggcgcaaatttcataacaggtttttaagaatacgactaacgtatcattctcaacgggtacaacacgtcggtaaccgtcggctaagaacttctctaggccgagtcccgggataccctaagcgtcagatagactgcaattccgttttaaatacgcagcgttaacgtgatagactacgtcatcaagaataatggatcacgtacggtcgcgtaagtccct

SEQ ID NO: 75917 - DNA, 415 bp, Zea mays
  unsure at all n locations
  Clone ID: LIB3079-018-Q1-K1-A6
tggcttgngacctttgggctngtttatgtgcttgggaaagagtccatgtcgtcggggccacgggtgagtttgcctgcgtcttgggtgtgtagtgtgtctagttctaaaggttctattcatgtccatcttgaggagaattctgatgataagagtgagtcctcttctagtcttaattttgcgtctaagaaggcgtttgcgtctacttattatggtaagtttgctcgtgagctttagactactgcgtagcatgctgatgaggtcccttttgttgttgtattcaacccttccttacttgattttcatgattgtgttaccgtctgtcctcgggttcttcatgctgatgataagcctcatagtgtgcggacatttgcgcctaggggtaggaatggtggagaaacggtggaagtggtgaggt

SEQ ID NO: 75918 - DNA, 329 bp, Zea mays
  Clone ID: LIB3079-018-Q1-K1-A7
tttgggctgatttatgtgcttggttgttattaggcgtagagctccctgctactctcctcttggtgaagaatttttagctgtttattagactatccgccaaatcccgccgaggggcgacggtggccctccctgtaaattctaatcttgaggtagggtccaaaaagtccgacgagcattcctctatctgtagtcatactatcggtcattaagtccttaaggacgatccggtcgctcatatcctgcccctggtcgtctttctgcttaagcacactaatgcagtaaggcggcccaattataccgacgtgtctgcgaggtcgagtggaaccatc

SEQ ID NO: 75919 - DNA, 268 bp, Zea mays
  Clone ID: LIB3079-018-Q1-K1-A9
ttctgcacacacgatgcgatacgcaacgccatcacacttcatgagggacgaggagatgcacagccgcatcatcggcatgaacgaggccgagctccacggccgccgcatgagcgtcaacgaggcctactgccgtggccgtcgaggcggcggctacggcgggtacggtcgccgtcatggcggcggcggctacggcggtggcgggcgctacgatggcggcggcggctacggcggtggcggcggctactacggcggtggcaactacggcggt

SEQ ID NO: 75920 - DNA, 415 bp, Zea mays
  unsure at all n locations
  Clone ID: LIB3079-018-Q1-K1-B1
tttgggctgatttatgtagcttgtttatgtgcttgtttatgtgcttgtacggngaccgaggcccgtgcgaaaaccctgcttgcccggcgcggcgtcaaccgacgacacaccccggccacgtcccgtacgcccgcctggccggacgtaacaacgggtcggccatcgtccctacgctgaactcgaccatcctcgaccgacgtacacttcccccggtcgccggtcagtgaacgtccctagaaattattctcctcgcccagtcaccccgggtagcaagctaagtagcgtcccgcaccccgcaaacaggtacctcccacgccaacaaactcgcacagaaataaaaccggctacctaacaactaacagcaccactagaaccataccctcgcatcataataaccaccccaactaataaggcc

SEQ ID NO: 75921 - DNA, 416 bp, Zea mays
  Clone ID: LIB3079-018-Q1-K1-B10
ctcatctgcgtacacggtctccctcttcctgtcagtagtagagtgagagtgaggcagggagtatgagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctcagggagatgcgcatcgcgcacttcgtggtgaaggagccgatggtgatcgggcacgagtgcgcgggcgtggtcgaggaggtgggcgccggcgtgatgcacctgtccgtgggcgaccgcgtggcgctggagccgggcgtcagctgctggcgc

SEQ ID NO: 75922 - DNA, 391 bp, Zea mays
  unsure at all n locations
  Clone ID: LIB3079-018-Q1-K1-B11
atcacaccggatccgctctggctccaacaacggtgatgggctccatggaagcgtcgggcgcgccggagaacggctcctccgctgccggtggcggagccggcggcacggcgtgcaacggggcgggcgccgcgtctaacggacgaggcatggagaggcagctgacgtcctcggccgcgttcgcgtcttgggcggcgcaccttcccctggacgtgggcacgcgcgtgatgtgcctgtggcgcgaccagaagctccacccggtcaaggtgatcgagcgccgcaagggctccgcgtgctattcccncgtcgactacgagtattacgttcactacaccgagttcaatagaagacttgaccagtgggttaagctcgatcagcttgatcttgacactgt

SEQ ID NO: 75923 - DNA, 261 bp, Zea mays
  Clone ID: LIB3079-017-Q1-K1-H6
cgcgtacggactcgggtcaaaccctaaacacggagttgatttatccgatgcagccacgaggtaggtgcactctgcgtggtggcaggatgccatataccagattgttggggatgccaatgcgaagaatatgaagttcactgagactgttgaacttcatatcgttctgaagaattatgattcacacaatgacaagcgtttcaattgcttctgttaaagttccccatatccctagtcccaagatgaatgtgttcattcttggtg

SEQ ID NO: 75924 - DNA, 424 bp, Zea mays
  Clone ID: LIB3079-018-Q1-K1-B12
tctttctcttgccacctcgggcatcctctctggcttagaaaaaaaatatgcgcttcatagtccatacctagatcttttggtgttcagttttggtttcaagccatggcgaattctcggattggacgttacaagatgtctactctctcagacccctcaaaagaagatacttcacctgagggttcaggtactacccagagaaatggagcctggagtaacacattgaacactcttctgcagcaagcctcagtatatggtgtggccgctgggtattggttatcagcgtccctgctctcgatcatcaataaatgggcaatcatgaaatttccatatcctggagccctgacagctctgcagtacttcactaatgttgctggagttctcctatgtggacagctcaagctcattgagcacgatggacttaact

SEQ ID NO: 75925 - DNA, 313 bp, Zea mays
  Clone ID: LIB3079-017-Q1-K1-G1
atccgtccacgcgttcgcccacgcgtccgatacatctcacttcgccaaaaaaatttcgtcaacagtggaagttatacccatggcaaaactactcttgggtttgctccttgcccttgctattctagggacaacatcggctgctggttgtgtacaagacgcggaagacatgaaacgagagtgcaagcagtttgagctattcccagcgaacccaaagttgccaccgtcggcagcatgttgtgctgtgtggaagagggcagatgttccatgcctatgcaaatatgttaacaaggaagtagagaatgtatggtgcatg

SEQ ID NO: 75926 - DNA, 250 bp, Zea mays
  Clone ID: LIB3079-017-Q1-K1-G10
ccacgacagcaatgccatactagggcaatagttactacaatacaatttttgtatgtggctagctgttcatattttacactctaccatcatatgatcatatctagcgaagtaaaataaaaaaaaaaaaaaaaaaaaaaaaaaaaaaaaaaaaaaaaaaaaaaaaaaaaaaaaaaaaaaaaaaaaaaaaaaaaaaaagatgaaaaaaataaaaaaactaaataaaaaaaaccatgcattgaacttcctaatt

SEQ ID NO: 75927 - DNA, 389 bp, Zea mays
  Clone ID: LIB3079-017-Q1-K1-G11
cccattcgtatctccgtcgccatcgccgctgactcctccagagacgcgtctacagctgctcctcttcagtggcgtcttcagtggcgccgtttcctgctcgcagtcatggtcgcacggaacgtgctgcggctcgtggtcggcgttgccgttgccgtcgccgtcgccaagtaaagagagacagggaggcacactagacggcggcgtggacaggagcgagtcaagcagaggatggaacggggactgcaaccggcactggactaccatgtcgactatgataacttctatggggattctgaagatcatgaagttcagcgtctacgtctgcgtgcacgtctcgctgacctacgtggtcacctacgacttcaagaccgtctagaagatcatgggca

SEQ ID NO: 75928 - DNA, 420 bp, Zea mays
  unsure at all n locations
  Clone ID: LIB3079-017-Q1-K1-G12
ctttgtcttatatgctgaagcaattctaccagcacgaatcagcaaaactgcgcaaccagatccagatgctgcaaaacactaacaggcacttggttggtgattccgtgggaaacctgtcactcaaggagctgaagcagctggagagccgccttgagaaaggcatctctaagatcagggccaggaagagtgagctgctggctgcggagatcagttacatggccaaaagggagactgagcttcagaatgaccacatgaccctcaggaccaagattgaggagggagagcaacagctgcagcatgtgaccgtggcacggtcagttgcagcagcagcagcagctgccaccaacttggagctgaacccattcttagagatggataccaaatgcttcttcactggcggncccttcgcaacgctggaca

SEQ ID NO: 75929 - DNA, 221 bp, Zea mays
  Clone ID: LIB3079-017-Q1-K1-G2
gcgctctgaagccatacactaagagagcagatcatgcatatgggtcatatctcaagtcggggagcacatgccatcaacggggttaagcaggcgtaatggactacctgtcaccatgctgatctagcaaaatcattgcgctactaaaagcttagaatagttcctggcttgagatccgctggctctgcctgtgaacatgatatacaatgattgtaatagggacc

SEQ ID NO: 75930 - DNA, 223 bp, Zea mays
  Clone ID: LIB3079-017-Q1-K1-G3
agcagcccgcgccggctccgatcttagatccactagagactaaaatcctggtcctgggggggcgccttcatcggggagaccctcaccacctcgatcttcctctacattgccattctcaccgccacagtcgtctccaagtccacctccaactgcgccaccgatggcatccatggcatcgcctggtccttcatctgcatgatcttcgaacttgtctactgcacca

SEQ ID NO: 75931 - DNA, 445 bp, Zea mays
  unsure at all n locations
  Clone ID: LIB3079-017-Q1-K1-G4
ggaagaaacaaaacgaaaggcggtgtcagctgctcctccacttcccgtgtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagaggattgctataccaacaccagcataacaaaaggatgagcttgcctgccatggcacagctnctcttcaataccctgtactacaagcgcttcttnccatattacgccttca

SEQ ID NO: 75932 - DNA, 448 bp, Zea mays
  unsure at all n locations
  Clone ID: LIB3079-017-Q1-K1-G5
ccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaagggaggcatgcagatctttgtcaagaccttgactggcaagacaatcacccttgangtggagtcctcagacaccattgacaatgtcaaggcaaaaatccaagacaaggatggcattccacctgaccagcaacgtctcatcttttgccgcaagcagttggaggatgggagg

SEQ ID NO: 75933 - DNA, 318 bp, Zea mays
  Clone ID: LIB3079-017-Q1-K1-G6
ggaagaaacaaaacgaaaggcggtgtcagctgctcctccacttcccgtgtttctaagtgcggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatataaaagctctgcac

SEQ ID NO: 75934 - DNA, 320 bp, Zea mays
  Clone ID: LIB3079-017-Q1-K1-G7
ggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctggtcctggcgaggaaagtgtccctcaccagggcggtgttttacatcatcatgc

SEQ ID NO: 75935 - DNA, 140 bp, Zea mays
  Clone ID: LIB3079-017-Q1-K1-G8
cggcgtcacgtgcagcaggacgctgcgctcctacttgttagccgaatccagcgtcggtgacccagacagagcgacagaccgagtgacatggcctctcacatcggctctcaccgaggccgtctactagggcctctgatact

SEQ ID NO: 75936 - DNA, 121 bp, Zea mays
  Clone ID: LIB3079-017-Q1-K1-G9
catgtacgtacatggaaagctgatggcttcctgacttttaatttctgggcaggtcccaaaattttcgccctgagaatgagatattatatagataacatacatacataccatattcgttgcc

SEQ ID NO: 75937 - DNA, 231 bp, Zea mays
  Clone ID: LIB3079-017-Q1-K1-H1
aaaaaaaagccaacgacggcaccgatcttaaagcccagaagagctcaagtacaaaaacgggtggcaaacaaaaatgagaagagataaaaaacaacttaatataaatatacagtgtactccttgaacggcattcaagtttacaaatccttctttacgtgcgcttccgtctgcattcagggcatctactggtacttaagtggcatgatcttcacacttttctactggacaaac

SEQ ID NO: 75938 - DNA, 429 bp, Zea mays
  unsure at all n locations
  Clone ID: LIB3079-017-Q1-K1-H10
cggacgcgtgggcggacgcgtgggcggacgcgtgggttccccgtctacgacggccgcggccccgacgccagccttgtggcccgcgtgcaggggatcaccagcgaaatcgggaacgcgcaccaactgttcgtcgttgttttcgacaccgacagctgttcgtctcgccctgcatatgcgtctctctgctgccaggctcaagggctccacgctcgtcaccaatggcgtgataacggccgggtctgacgagtgggcgatctacggcggaaccggggtgtttgccatggcgaggggcgtcataaggagaaggtatctcgccgacagggccggcgggaacactgatgagctcaacatggatgtcttctgccggccgtttggctcacagtcagagctgcaagattagatgcangtgcaggggcagggctctagcgt

SEQ ID NO: 75939 - DNA, 425 bp, Zea mays
  unsure at all n locations
  Clone ID: LIB3079-017-Q1-K1-H11
cccggcgtcttctccctccgcaccgcggctccggcgatggcgggcgtcggctccgcgctgcgtcggctctacctctccgtctacaactgggtcgtcttcttcggatgggcgcaggtgctgtactacgcggtcctgacgctgcgtttgagcgggcacaaggccgtctatgccgccgtcgagaggccgctgcagttcgcgcagacagccgccatcatggagatcgttcatgggctcgtagggttggtgaggtctccggtctctgcaactcttccacagattggatccaggttgttccttacgtggggtgtcttgtggagttttcctgagacccagtcacaccttcttgttactaccctggtcataagctggtctatcactgagatcatcagatactctntctttggaacgaaggaggcatttggctt

SEQ ID NO: 75940 - DNA, 320 bp, Zea mays
  Clone ID: LIB3079-017-Q1-K1-H2
cgtaccggaactgaattctcgactcacgccacgcgtacgcagactcacgcgaagcaggacgctgcacacctacctgttagcctactccagagtcggggagccagactgagcgacagaccgactgacatggcctctcacatgggctctcaccgaggccctctcctactgcctccgatactgccttcgtaaccgtgcctacagcctgctgaaggaactgatcagcgaactgcacctacgcatcgactatcactacgaagccaattcggtacatgctctgcatgatcttattgatcagcttgtagtccacattgctttctaca

SEQ ID NO: 75941 - DNA, 331 bp, Zea mays
  Clone ID: LIB3079-017-Q1-K1-F8
ggcaaacggtggctgtcggagtcatcaagagtgtggagaataacgacccaactggagccaaggtgaccaacgctgctgccaagaacaaatgatctatctgcctggtgctgtgcttgcttgttggttacctcgtggaagcttaaaatatctcctcttgtcgacatccttgcagttgtctcgtgaacaactaatctatcatggcaatgtttgcctggtcatgaagtattattactttcgttgaaaccgtgatgctattaatacttaattttcatatcgaacatcgaatgtaaggcatacatggttatgagttttgtactaccccttgcattgt

SEQ ID NO: 75942 - DNA, 310 bp, Zea mays
  Clone ID: LIB3079-017-Q1-K1-H3
gggtttggagcccacgactacccatccagtggtgtgtttgaggtggaatcaaagaggggccctggctttatctacagaagaacagtgtggctaggcacaacagacatgtctcaggaagaattccgctcgtttattgaaaaacttgcaggtgattatcatggcgacacatatcatttaattaacaagaactgcaatcacttcacagatgatgtctgccagaacttaactgggaaacccatcccttcctgggtgaataggcttgcaagagtagggtcagttttcgattgccttcttccagaaagcgtacaag

SEQ ID NO: 75943 - DNA, 453 bp, Zea mays
  Clone ID: LIB3079-017-Q1-K1-H4
gcggtacgaccacgcgtccgctcttgtcgaggtacgatgtacctggcactcgagtatcatggatgagactgttggtcgtctattcaaaagtggactaggtagattcgggcttggacagtctaaaccagccttcggtgatcaatctgttcttatcatttttgttcttggaggtattaatactcttgaggtccgggaagtcatgacagcgatatcggagagcagcagaccagatgtggagcttattctgggtgggacaacccttcttaccccagacgacatgtttgagttgatgttgggatcgtcaagctttgcttaggctcaaccttcactcttgagtcatgtgcgggacttggaaagaaatcggagcataattttttcttattcttcagaatagttacttgtctgatgtagcagaagcattcagacttggaagaggatactaccagaagaaag

SEQ ID NO: 75944 - DNA, 209 bp, Zea mays
  Clone ID: LIB3079-017-Q1-K1-H5
ggcactcctagccctaggtcatcgtcaacagcttgatcatggacgacttctaggggggttaaggcacttgccatagtggcttaccaactcaatatgtcacaacatactgctctgtacacatagctgcctacaaccattccacagtgccaggtactaatgttacttctagacccattcacctagattattcaaagatctcaattgcaata

SEQ ID NO: 75945 - DNA, 410 bp, Zea mays
  Clone ID: LIB3079-017-Q1-K1-E11
cccacgcgtccgcccacgcgtccggatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattacta

SEQ ID NO: 75946 - DNA, 231 bp, Zea mays
  Clone ID: LIB3079-017-Q1-K1-E12
tccacgcgtccgaacacgcgtacagctctcagtcacctgcgccgccgccacgttcggggggggcctccaatacggggagttcaattgaccgacctcgttcttctggacaaggtctactaacgtattaacatttccgccgtcaacaatgactcttcggtcacacactatgatatttttcaacacaatgctattttcgctcacttgcagcactttactatctatgaccagttg

SEQ ID NO: 75947 - DNA, 211 bp, Zea mays
  Clone ID: LIB3079-017-Q1-K1-E2
aaaaaaaaaaaaaaaataaaaaaaaaaaaaaaaaaaaaaaaaaaaaaaaaaaaaaaagggaaaaaataaaaaaaaaaaaaataaataaaaaataatacaaaaataatatatccaaatatttattaactatctcaatgtctctctgtcttcactctaagtattaacttttttattgcttcttctaaatttatttttttgtccttcttctaaa

SEQ ID NO: 75948 - DNA, 414 bp, Zea mays
  Clone ID: LIB3079-017-Q1-K1-E3
cccacgcgtccggtttattgtatccatatggccacgaagaattggccgtttgtgaagatgttgaccaggttcgtggtgcaatggagaagtacccaccataccagtctatattttccaggatttcatatggagaaagtcagatgttggataaggcattttatgaggaggaagtcaagaggctatgcttgtcctttgagcagcagttccactacgctgttttcttcgcttacatcaggctccgcgagcaggagatcaggaacctgatgtggatctctgaatgtgtcgctcagaacccagaatcccgggtccatgacagtgtcggcttcataatctgagaacccccggcactatatatggatgtacaaaatgcctgctttgatgattgcacaatcgcttgacaattattaatctggg

SEQ ID NO: 75949 - DNA, 319 bp, Zea mays
  Clone ID: LIB3079-017-Q1-K1-E4
tcgtccacgcgttcgggaatacagggaaaagaagatggatagtccatggaggggtaggccaattgaagagtctctgaaattatttgaagacatgaggcgtgggttgattgcagagggtgcagcaactctccgtatgaagcaagatatgcaaaatgagaacaaaaatatgtctgacttaatagcatatagaataaaattcaccccccattcacatgctggcgaccagtggtgtgtctatccgagctatgactacgctcattgcatggtggattctcttgaaaacatcacacattcgctgtgcacacttgagtttgacata

SEQ ID NO: 75950 - DNA, 233 bp, Zea mays
  Clone ID: LIB3079-017-Q1-K1-E6
cccacgcgtccggctccttgcaagtggtgtttatgttagacgactgcgtatggggccgagttcttggattcagcagacttaacgcatgtacaagtctgagactccatttttctatgagacatctaatagactatatgacataactttaagactcagtattataaatgcagttaatagacaaaataaaattcaccccccatccacatgcttgcgacaaaaagggcgtctattct

SEQ ID NO: 75951 - DNA, 330 bp, Zea mays
  Clone ID: LIB3079-017-Q1-K1-E7
cgagaaggccatacttctcgtcctattccgaggaccaccagaactgccgcttgatctgtagctcgaagggtttcaaggacggtggctggtgtgacgaaagcgtggagcacaaagtgtgctgctgctcccattagaaatataatagcgtatgttatgttgatgcatatatatatgcatcatccatctacctgtgtggtgcaaaattctgaataaaacctgaataaacctgattgattaaaaaaaattaattttatctctcaagttgaaaatattatttttattttttaatgtatatattttttgttctttttttttgtgttttatattttt

SEQ ID NO: 75952 - DNA, 400 bp, Zea mays
  Clone ID: LIB3079-017-Q1-K1-E8
cacaggagtttactctccaaaggctgtggacaacaagcagttaccttcacacccatctctgctgcatgcatcgcttgggatgccctcccctggccggatgtctccacgatgtgtcgaatcaggctccccgatgaactcccacctagctgctgctcttgcccagcgtgagaagcaacagcagacgatgagaagcctcagttctcgtgaccttgggcccagtgcggcacgagcttcagctctcggctcccctctaagcacatcatggtctaagtggggatctccttcaggggtaccagactggggcgtacatggtgaagaattgggtaagctccgtcgctcattcgcgttcgagctcatgtctcgctgcgatgaccctgatctctcctgggtgcatacactg

SEQ ID NO: 75953 - DNA, 422 bp, Zea mays
  Clone ID: LIB3079-017-Q1-K1-E9
gtttttgctgtcttcttatgcatatctgaagatgtagtgagttttttttagcagagattgcatagtttcagtttggtcccttgattacgttgcctccttgaccatttttaggtggagtgttcatatcagtgtcagccctttgttggaatttaactattaaattcattcgtaattctcttgtagtgttataatcaaatgtgtaggttgcatgtaaccataggtatcctaccaaattttgtgtttgtggacggatgttctgcggggtttttttttgtgtgtcgatgctatttggcattgcttatatcggtttcttgtgttgatgaacgccgatgattgtttccacttagttgtctgatttacaatagttaacacgacacgacatccattctacacattattaccttaaacgtaagaatctgatg

SEQ ID NO: 75954 - DNA, 287 bp, Zea mays
  unsure at all n locations
  Clone ID: LIB3079-017-Q1-K1-F1
tgattaatgatgttatggcgttaccagaagatttgaagacaaagctcagcatcgacgatgagctggtctcaagtccaaaggaagccttttcccgtgtttcggctgatcggagaaacaaacttatgaagagtggcctatctcaatcatattcaacacacggagacaaaaatattgtgaaattgagtaaactaacagaaaccaataggaggtttggtggagggcgggcccttgaaccgnctgctatcaaccagggtgcaatcacccagctttcagaacagatttcaaca

SEQ ID NO: 75955 - DNA, 416 bp, Zea mays
  Clone ID: LIB3079-017-Q1-K1-F10
tcttgagtcattaggcataaaagagctggagcacctggagaagcagctcgattcgtcgttgaagcacataagatctacaaggacacaacacatggttgatcaactgacagaacttcagaaaaaagaacaaatgttttgtgaagcaaataagtgtcttcgaagaagactggaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatccttcagaggcactgactagctcatgcatgaccaccttcctgcccccgtggttgccatgagatcgaactactgcgcaattccgaattaataagcatggccgcatgc

SEQ ID NO: 75956 - DNA, 305 bp, Zea mays
  Clone ID: LIB3079-017-Q1-K1-F11
aaaaaaaaataaaactaaaaaaactaaaacaaaaaaacaatctaataaatacaggttggttactaacatcaagaaagacacatcacatataagatcatctgactaaacttgagtggcccgttcttaataacccaagctactgttaaatctcttccaagaccaaactttttcaccatccacctcatatctcattacaccggcgatcttttcaaacctaagttccttaaaaaaccctatcgtttccaattttaccacttttatgataaatgctattttccttgtgtgcccacattaaacataggccc

SEQ ID NO: 75957 - DNA, 407 bp, Zea mays
  Clone ID: LIB3079-017-Q1-K1-F12
cccacgcgtccggcaccctttcatcagcctgcctgtccactgttggcttggtgacttgctgcgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtcttcggcccggcggcggtggaccccaagctggccgctggtggcgcgccggacgccggcgcggatgctgcaggaggcacggtgct

SEQ ID NO: 75958 - DNA, 396 bp, Zea mays
  Clone ID: LIB3079-017-Q1-K1-F2
cacaggagtttactctccaaaggctgtggacaacaagcagttaccttcacacgcatggctgctgcatgcatcgcttgggatgccctcccctggccggatgtctccacgatgtgtcgaatcaggctccccgatgaactcccacctagctgctgctcttgcccagcgtgagaagcaacagcagacgatgagaagcctcagttctcgtgaccttgggcccagtgcggcacgagcttcagctctcggctcccctctaagcacatcatggtctaagtggtgatctccttcaggggtaccagattggggcgtagatggtgaagaattgggtagcttcggcgttcattcgcgttcgagcttaggtctggcgcgatgaccctgatctcttctgggtgcatacac

SEQ ID NO: 75959 - DNA, 252 bp, Zea mays
  Clone ID: LIB3079-017-Q1-K1-F3
gcgtccacgcgtacgagagaccaggccgaaggaaaacaatcctgaaaccaagccatgggtctgggggaggaatttgaggagcatgctgagaaggcaaagaccttgcctgagagcacgagcaatgagaacaagctgatcctctacgggctctacaagcaagccacggttggagatgtgaataccgatcgtacgttcatattctaccataaggacatggccaaatgggatgcctttaatgctgttgaatgcaaa

SEQ ID NO: 75960 - DNA, 410 bp, Zea mays
  Clone ID: LIB3079-017-Q1-K1-E10
gcgttccctcaccagggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacgaggagctcgtggccgcgctgcccggcgacgactgccgctacgccgtcttcgacttcgacttcgtcaccgtcgacaactgccagaagagcaagatcttcttcatcgcctggtcaccggcggcgtcgaggatcagggccaagatcctgtacgcgacatcgaagcaaggcctgcggcggctgctggacggagtccactacgaggtgc

SEQ ID NO: 75961 - DNA, 284 bp, Zea mays
  Clone ID: LIB3079-017-Q1-K1-F4
gcggacacaccacaggcgcgcaagcccaaccgatcgagcagctctagcatggcgagcggcggctactactacgaccagagcgcgggctacggcggctacagctactcggcggcgccgaggacgacgccgtcccacctcctggtgttcctggccaccgtggcgctgctgggcgccacgtcgctctactcgcgctacgagtccgcggtggagagcctggtggaccaggtgcggttcgccgtggtgctgtccccgctgctgctcctgctcgcggtccagtactgggc

SEQ ID NO: 75962 - DNA, 109 bp, Zea mays
  Clone ID: LIB3079-017-Q1-K1-F5
aaagaaacaaaaaaagaacacaaaaaataaaaaaacaaacaaatataaaataaaaaaggggaaaatactactacaacgagaacgcaaaactaaggcagctacagatact

SEQ ID NO: 75963 - DNA, 293 bp, Zea mays
  Clone ID: LIB3079-017-Q1-K1-F6
ggtaaccagctgccgagggaggaaccctagcggcacactgtgcatgtgacggcggggctcttcactacgaccggagatacggctgcatcggctacatctactcctcctccatccacgacgacgccgcgcaagctgccagcctgcatggtcacctgactgatattactcgctaactgtgtctagcaagcctaatagtccaccatggatagccttaagcacgaaacactggacgacaccatgctggccgctgttgatctcatgcttgggctgcaatactgtgtgataccggacga

SEQ ID NO: 75964 - DNA, 261 bp, Zea mays
  Clone ID: LIB3079-017-Q1-K1-F7
aaaaaaaaaaaaaaaaaaaaaaaaaaataaatataaaaaaaaataaaaaaaaatgaaggaaaaatataaataaatagaatactattaataaaaaaaaatttatatcgtatactatcttacttaaaggatccaattattatttttgctttttttctcacttttaatattttatatatttgcacttaatttcaattttttgttcttattttaacatttttcttacctggataaccttttgctttatccatttaaatatttttt

SEQ ID NO: 75965 - DNA, 359 bp, Zea mays
  Clone ID: LIB3079-033-Q1-K1-C6
cagactatacttagacctcaaggagaatgacacaataacagtgcgattgggtaacaggtacaatacatatagcttaggtggcaagaaaaagctggtcctatccactgcaacctgccttgtggggaagaacgattttcttggctttgcataccttatagttggtgggctatgcattttcctggcattggcattcaccttgctgtacttcgtaaaaccaaggaaactgggagaccacaactacttatcctggaacagactctaggatgattcggaacaccaagtgtccgtactactcgaaatgtagcttgtatgaaatgaaatgctctgaaccagaaatgtcgatgggcataagcaagcat

SEQ ID NO: 75966 - DNA, 235 bp, Zea mays
  Clone ID: LIB3079-033-Q1-K1-C7
ccgatccgtcctactccacaatccacatttaccctccacttcttcctacacactccgggacactgctcactatcaacttgtgactaacatgcccagctaaacttcctcttataagagacctcaatttccaccttctccctctcactcactacccaaaccttaaacactatcccccacatgttgtatcacatttacctgactaactacacctaccacataaacctcaacagcttca

SEQ ID NO: 75967 - DNA, 94 bp, Zea mays
  unsure at all n locations
  Clone ID: LIB3079-033-Q1-K1-C8
ngtaatcttcccattaatttttcacttaaacaatgtggtacatgtaatagaaactggtgncattaataaagacatagtagtatcacgtttttgg

SEQ ID NO: 75968 - DNA, 427 bp, Zea mays
  Clone ID: LIB3079-033-Q1-K1-C9
tccgatctcatttcctttggctgcaggataggcctaataagaaaacaaataattccaattcatatatgaacatttttgcctccttatggcttggaaatgtggaattggaattcctttcctttggcttcaggataggcctaataagaaaacaaataattccaattcatatatgaacatttttgcctccttatttcttgaaaatgtggaattggaattccccgaggaattccgatctcatttcctttggcttcaggataggcctaataagaaaacaaataattccaattcatatatgaacatttttgcctccttatttcttgaaaatgtggaattggaattccccgaggaattccgatctcatttcctttggcttcaggataggcctaataagaaaacaaataattccaattcatatatgaacattttt

SEQ ID NO: 75969 - DNA, 320 bp, Zea mays
  Clone ID: LIB3079-033-Q1-K1-D1
ccacgcgtgcgatgacacaagagagcacgctactactcatcactcgccaacgtgcacagatgagggaagcggcactccatccactgactgaccgctcatggcgaaggtccacctctacgtcgccgcggcctgcgccgtcgtcctcgcgctcgccaccccggccctcgccggtgacccccacatgctgcaggacgtctgaccggctgactacccctccccggtgaagctgaaccggttcgcgtgcaaagctaacttttcggccgacaacttcttgttgcacgggctgaagaaccctggccacagcaacgacccggggggct

SEQ ID NO: 75970 - DNA, 420 bp, Zea mays
  Clone ID: LIB3079-033-Q1-K1-D10
tgtggtctattctgctgtccgcgctggctcctctgcaactgtgctctcgccaccagactcaggcgtgggaccgacaagccattgcttcccttcagcaaggcagacgaacaagaagataagaaggatgtgccgaggccggtgacatactcctactctttctttcacctcatcttctccctggccagcatgtactcggcaatgctcttgactggctggtcaacttcggttggtgagagcggaaagcttgtggatgttgggtggccatctgtctgggtcaggattgcaacccagtgggcgacggcaggtctgttcatatggtcgcttgttgcacccgtactctttcccgacagggaattctaagttcaaccacggtaagcctggagcatcaaacgtgtctactgtggtagctaaaatattcta

SEQ ID NO: 75971 - DNA, 262 bp, Zea mays
  Clone ID: LIB3079-033-Q1-K1-D11
catcccttaatacctcaacgttcattaaccccgcgtccagttcatactcgtaccatccacaaggtctatcgaccatacaacccctgaacatgtctaatctctcccatttctcaaacatctttcaacaccagatcaacacattctacatctactacaacgtcaaacttccattttacagcaccttcaagccttatcccaccaatctcaggtccaccattacacactatacagctcttatcctatgttctaccagcttcataca

SEQ ID NO: 75972 - DNA, 102 bp, Zea mays
  Clone ID: LIB3079-033-Q1-K1-D2
aaataataggtcatatacacattaattggtcactgaaacaatgtggtacatgtaataggaggaggtgcattgaataaagacatagtagtatcacgtttttgg

SEQ ID NO: 75973 - DNA, 352 bp, Zea mays
  unsure at all n locations
  Clone ID: LIB3079-033-Q1-K1-D3
gaagaagcgaaagtatgagcttggtcgtcagccagccaacaccaagttgtcaagcaatgaagacaggtaggagggtccgtgttcgtggaggtaatgtgaaatggagggctcttcgccttgatactggtaactactcatggggaagtgaagctgttacccgcaagacccgtatcctcgacgtggtctacaatgcgtcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaagataatgctganggaca

SEQ ID NO: 75974 - DNA, 322 bp, Zea mays
  Clone ID: LIB3079-033-Q1-K1-D5
gccaagcatccgtacatcgagctggatctcagttcgtgcggggagctggagttccgtgtgcgccggagcggctcgtcagacgagctactatgacgcggtagttggctgcagccgccggcgccaccgaggcctggcggcaaggcgcaggaagttgacgtcggcggcggcggcggatgtggtggcgccggcaggaggagcgccgcgacggtggcgccgctgcagcactcgcactccgcggggttccgcgacgacacgcatcccgtggcggcgaggctgcgcaccgagtgctcccgccgcatgaaggcggcgcagacggtgcacg

SEQ ID NO: 75975 - DNA, 306 bp, Zea mays
  unsure at all n locations
  Clone ID: LIB3079-033-Q1-K1-D6
caaatacatatattgtcggtattagctcttacccttttcacccatgatgaggaantggcagaagcgcgcgagcattcaaggactttggctcctttccatggttcttctagcgtcgtcctctcttgtctgtgcaagcatggcggtagatgggcaaaccaaagaggacatcaacgcaacgagtgtgacgagcatgaacatgacgaggtcatcgtcgtcgagctacaacatgactggcggcagcggagaacttaacagaggtccgtgcgtaatgagatctggattctactggttccagaacattggcta

SEQ ID NO: 75976 - DNA, 369 bp, Zea mays
  Clone ID: LIB3079-033-Q1-K1-D8
ttcccgaattgacgcatgcatccacgcgtgcgaacacgcgtccggaagatgctcatgcatctagttccgtggctacgcagtctggggcaagctcgtgaaagtcaaggtttcgtacaagctctcggacgccgacaagaaggcattcctcaagaccaaggctaagccggcaaatgccgccgctgccaagaccaccgcccccaagccggccaaggccgccgccgacaagtcaaagaatgcagcggctgccaagccaaagaaggccgctgctgctgggaccaagcgcaaagtgcccgagaagaatgtcgtggcgaagcctaagaagtcccccgccgtcaaggccaatgccaagccgaagaccgtgaagtcccc

SEQ ID NO: 75977 - DNA, 282 bp, Zea mays
  Clone ID: LIB3079-033-Q1-K1-D9
gtcgctggccatcggcaaggacgctcgcctctacgtgttcaacaacgggagggcgcacgtcagggtgtcccgtctcaccgcgtgggagatgaagaagccggtcatgaacggggcctgaagatcttgaataaatatatcacccatgcatgacatagtggcgcctgaggaatctttcctttttttaaaaaacatattttagatgtcgtttattaagagttgattgtccatactaaagggcgccccgttatatgttacaatggtaccagctgcacttctagtaac

SEQ ID NO: 75978 - DNA, 163 bp, Zea mays
  Clone ID: LIB3079-033-Q1-K1-E1
aaaagaaaaaaaaaattcaaaaaaaatataaaaaaataaaaaaaaaaaaaaaaaaaaagagataaaagaaaaatattaaaaagaaaaaatccaaaacaataaaaaaaaaaaaaaaaaaaaaaacaccaaacaaaacaacggaactactaaataaaaaactaaa

SEQ ID NO: 75979 - DNA, 301 bp, Zea mays
  Clone ID: LIB3079-033-Q1-K1-E10
gttgttgctagttcgtgaaaatcataggcttaaatccatgttcagtattcacatcgcgccaggaatctgggccatgactccatggcaatgaatcaaaatagtacgagccgcatcatgtggacaaccttggcagatctttttattcttgtctttattgctgggagcactgtagctttaaacctacaagtagtgcttgaatgagatgagattcatatcatctcctgtggtggaatgtgaaattgtatgcgacctttagactaattaaaaagtacaatacagcgctaagcatactgcttgtatt

SEQ ID NO: 75980 - DNA, 265 bp, Zea mays
  Clone ID: LIB3079-033-Q1-K1-E11
gtgacacacggttctcctggacattcttacgtgccaactattgctgacgaagcaagtggcttaggaataatctgctgatgtctgcaatacaggaccttccagcagcgcacttcaatcacactaagaaccggaatacgatctgacatcatgcgctctaagctcacgcggggagtctgtaaaatccattgtctatataccgtgagcgtacggattggacttatacactcagttctgagaagtagaaaggctgaccaatttatcatat

SEQ ID NO: 75981 - DNA, 425 bp, Zea mays
  Clone ID: LIB3079-033-Q1-K1-C5
tcccgaattgacggagtcttcacaaacgccggcgcaaactctcgcccgagcccgacagatcttcaattcctcattccgtccagcgatcggccttcacgccagtctcggtctcttgcgaaggcttcgctcgcggttgttagagaggagaggaggaagatgagggagtgcatctccgtccacatcgggcaggccggcatccaagtcggcaacgcgtgctgggaactttactgcctcgagcacggtatccagcctgatggccaagtgcctggagataataccgcgggacatcacgatgatgccttcagcaccttcttcagtcagactggtgctgggaagcacgttcctcgtgcaatcttcgttgatctagaacccactgtgatcgatgaggtgcgcactggcacgtaccggcagctctttcaccctga

SEQ ID NO: 75982 - DNA, 444 bp, Zea mays
  Clone ID: LIB3079-033-Q1-K1-E12
cccacgcgtccgggtaaatgaatctcttggtttgcaatccaaggatgatcctgggaagtctggtcctactgagcatgagattgatcttcaggtggtggtgactttatagtgtactttggacagtcagaaaccttccagcctcagcatgagtcccattagttccactggtcatttcttgatgctgttctggttgataattttgttgaccttgcctcattgccgtaatctacaataaggaaaaaaagctattctttatttcctttgggaaatattctgatctgactagccaagcgatagaataattaactcttgaggttaagttatattattcttaatagggctgacatagggaatagttagggtttcaatgtttcatttcctttccaagcttcacattgcctgtcagaatatggagtcatgtcacccacgattatgcattgattt

SEQ ID NO: 75983 - DNA, 372 bp, Zea mays
  Clone ID: LIB3079-033-Q1-K1-E2
agaacgtcaaccagtacccgttcatggccatgacctcctgcggcaaccagccgctctggcgcgagggcaagggatgcggctcctgctacaagatcaggtgctccaagcacgccgcctgctccggccgcaccgagaccgtcgtcatcaccgacatgaactacaccccgggcgtcgcgccctaccacttcgacctcagcggcaccgccttcggcaggctggccaagcccggccgcaacgacgacctgcgccgcgccggcatcatcgacatccagttcgccagggtaccctgcgagttcccaggcctcaaggtcggcttccacgtcgaggaaggctccacccaggtctacttcgccgtgctggtcgagtacgaga

SEQ ID NO: 75984 - DNA, 196 bp, Zea mays
  Clone ID: LIB3079-033-Q1-K1-E3
aaaaacaaaaaaaataacataactggttaaaaattaatctacaacaaaaaaaaaaaacgagaaagagaaaatttaaaaccgagaaaaatccacacccacaatcacccaaatatcacaaacaataactttccaataatataacccaaattcaatgacacccaactacaattcacaacaccatagaatgacaaaaccc

SEQ ID NO: 75985 - DNA, 327 bp, Zea mays
  unsure at all n locations
  Clone ID: LIB3079-033-Q1-K1-E4
cccacgcgtccggttctccagccgccgtcttcgctgataggctacgccgcccgctgggctgcgcgcgccgtagccttaccctgtgtgcaccctgttcctaaccctgcgtgtggccgccgccgactggcttgcgtgcgcccgcgcctccgcctaaccctgctagcttgcgcgcccaacgccagatgccctgagcccaccgccggctgtctgtgcacgcaagtgaacccatccggctacctgggcacgccatccgacctccctgcgaacctctgtatctgccgatattcctcaagaacacagtgcanacagtaagttctggagacagca

SEQ ID NO: 75986 - DNA, 403 bp, Zea mays
  unsure at all n locations
  Clone ID: LIB3079-033-Q1-K1-B1
ccgacgagtcctcattcaccaccgagagcacaagggactcgttcagcgttgtggactgcggcgacgacgctggcctggacccaatctcctcgatatttgggccaagctatgctccggagcatcatcccggtccacctggcagtttcgccgcgtgcacgaggctctcgccttccaacccacagacaaggtacttctcggagagcacagggttcgtctcggactactcttccagcggcattgtacatagaggaagggatccaggtagggcatacacctgttcagcggaaccgctcgcttcggctgcggcggcgcaccagcaccagcggtgaggcgtattaaatnttggctgcatgtcattcctaggctagctcgattcaatgtancgagagagagaggaacaaat

SEQ ID NO: 75987 - DNA, 436 bp, Zea mays
  Clone ID: LIB3079-033-Q1-K1-B10
ctctgatgatcctggtagtccttatcacctgcctttaatgcctcacaacacagcaccggactggaatatcatggaagaattagatgattggcctgtgctcgcaaagaaagaatacgatgactggcttagttcaaaggcttcatcctcttataaccctgttgatgatatattaaccactgagatgaacagttagctgccacaatctttcacctacggaggcttcattcctcaatcatgtgcacccggtcattcaagtttaagtgacaacacgaccaaggaagagccctctatgacatttactggttttcaaggatgcactgtcagtggaaacggaatgccttcatctacagtgccaatagatgatatctatggatatcgaggtccacgttcacatcggatcttacgtacgccaatgccatcttatggtaatgatata

SEQ ID NO: 75988 - DNA, 216 bp, Zea mays
  Clone ID: LIB3079-033-Q1-K1-B11
gccacacctcctcccactcatcctgtcctccactctgcacttgacgaacaacacaaacgacccgatcatcttcaacgcgaagacgacccaccccacaaactacttcgaacactcaaaccactacatccccattccccagaccaacactcactttaccgatactattcacccgcaacacgactttccacccaacatgcactacatctacaccttcct

SEQ ID NO: 75989 - DNA, 420 bp, Zea mays
  Clone ID: LIB3079-033-Q1-K1-B12
aaggagcaggctgcgtgtagttctcagaaaagacgagctgctgacatcagtaattttggcagggctgttattagagttagcagatcacagacaaaactaaacactgaaattgtaaaacatctgggtattatccatgagtacatggagacaatggcttctgttcataatgcttttactgatcgttccaatgctttgcttcgtgtgcaaaatttgtcagcagatctatatttcttgcatacccgggcaggaaaacttgaatctgtatcagcgagaggaatggatcaggagagatcaaggtatcaaaagatagaagaattgaaagaaacagtaagagccacggaagatgcaaaaacacgtgcacttaaagaattggaatttattcaaggaaataacatgaatgaaattaaaagatttaacaag

SEQ ID NO: 75990 - DNA, 400 bp, Zea mays
  Clone ID: LIB3079-033-Q1-K1-B2
gcacagaggatctcctctgtgaacgccatctccgccctctgcgaggccaccggcgcgggtgtgagtgaggtggcttacgccgtgggcaaggacacgaggattggccccaagttcctgaacgccagtgttgggttcggtgggtcttgcttccagaaggacatcctgaacctggtgtacatctgctagtgcaatggcctgaccgaggtggccaactactggaagcaggtgatcaagatcaacgactaccagaagagccggttcgtgaaccgcgtcttgtcgtccatgttcaacaccgttgccggcaagaagatcgccgtcctcggcttcgccttcaagaaggacaccggcgacaccagtgagaccccggccatcgatgtctgcaagggcctgctgggtgaca

SEQ ID NO: 75991 - DNA, 385 bp, Zea mays
  Clone ID: LIB3079-033-Q1-K1-B3
aatttccggcggatgatgatccggatatcattgctgctgctcgtgattacaatcttgcttcactcttcactgatctgcttcaggggaatgggcttgacgtactccagattgtctctgctgtttcactagagaaactctcgcagcagtcaaaacatcttaccaagatactgcctgctcccagcccatggctgtgcttttcaatatttccatgcctcagccagaagactgtagcaactggggtctgtagagttcactgtgggatttgttcctcaagggagagcttctgtctcttgcatggcaaggcagtggagaagctagttgcctgcttggataataataacgagaaagtagtcgaagctgctctagcagcgctgtccactttact

SEQ ID NO: 75992 - DNA, 396 bp, Zea mays
  unsure at all n locations
  Clone ID: LIB3079-033-Q1-K1-B4
ccgtcgacccctcctcctcgatctacaccggcgatcggcggcgagtgatggggtggggcgacactgttcctggcggcggtgtgcttctttgctgcagctgtcctcttcgtccccgaggctctccttggttccccctccggcgcaggcgccgtcaccgctgccaagctggcccacgtcctctcctttgccacttcctggggcgccggcctctgggccacctttatcggcggcatcatcatgttcaagaacctgccgaggcacatgttcggcaacttgcagagcaagatgttcccggcctacttcacgcttatctctgcctgcgcagccatctcggtcgccaccttctcgcaccttcacccgtggaagacngcctccaccgtggagcgctaccaactt

SEQ ID NO: 75993 - DNA, 417 bp, Zea mays
  Clone ID: LIB3079-033-Q1-K1-B5
acccacgagtccatacacacctatattcacaaaagctagtccatttgcctcattgctatactgtcagtgactacaagcagaaaaatcgagactgactcactccagtatgtccacacaaaagatctgattatggattacctgaggataaatttatttttgcttgcttcaatcagctttacaaaatggaccctgagatatttgacacatggtgcaatattctcaaacgtgttcccaacagcgcattatggcttttaagattcccggcagctggtgaaactagagtgagagcatatgctgctgccagaggagtaagatcagatcaaattgtattcacagacgttgccatgaaaaatgagcatatacgacgcaatgccctggcaaaccttttcctggacacttccctttgcaatgcacaca

SEQ ID NO: 75994 - DNA, 134 bp, Zea mays
  Clone ID: LIB3079-033-Q1-K1-B6
tccgaattacgcatgcacccacgcgtccggaccgttgtataaaatgtatggatataatgtagagttcagtctggtgagaggaattgacattgaagctcacccgtatttaatcaaagtttgtactgactataaaa

SEQ ID NO: 75995 - DNA, 377 bp, Zea mays
  Clone ID: LIB3079-033-Q1-K1-B7
cggaattcccggcggatgatgatcctcctatcattcgtgccgctcgtgcgtgcactcttgggttggtttctactgcccctccggatcgggatggggttcgtgaggttctacatggttcgtgttcctgggttagcggatctagatggctgcgtcagatgttgaataccgctgcttcgtcgtcggactcacctgggccactgacgaccactcccttcacaacgccttcagcacctaccgcgaggtcctcgagtccaagatcatcctcgatcgggagacgcagaagtcccgcggcttctgcttcgtcaccttctccacagaagaagcgatgcggaacgccatcgatggcatgaacggcaaggaacttgacggtcgcaaca

SEQ ID NO: 75996 - DNA, 434 bp, Zea mays
  Clone ID: LIB3079-033-Q1-K1-B9
cacagatgctcaagtcagcagtgatgtctggagagaaatgatccggatgtcagtgaggagaaggttcaaccaaattacagtggatggtgatactagtaccaatgactgtgttattgctatggcaagtgggttgtctggtttatctggaattcaaagtcttgatagcattgaggctcaacagttccaagcatgcctagatgcagtaatgcaaagtcttgcaaaatccatagcatgggatggtgagggtgcaacatgcctaattgaggttactgtaagtggcgccaacaacgaggcagaagctgctaaaattgctcgttcagtagcatcttcttctttggttaaagccgctatatttggaagagacccaaattggggacgaattgcttgctcagttggttattcaggcattcaatttgacgcaaatcgacttgata

SEQ ID NO: 75997 - DNA, 355 bp, Zea mays
  Clone ID: LIB3079-033-Q1-K1-C1
ccgtcgcggccgggtcggcggtccccagttctcctccgcttcttcctccacgctcccgtccccggggcgcgaggaacttcccacttccaggcccagcttgtctggttaggattagggtcgtcgcttcgcacgtgtccggtgtgccgccgtcggagatgtcgcggacgctggtgcagccggtggggcagaaacacctcaccagcgtggccgcgcacctatcggccgcgagctaaacgaggatcctaaccttaaccctgggcagactgatactctactcctggatgacaatactaaactacttcggcaacaacattcccatcaacggatctatgtctggctgtcatcgcgaagatca

SEQ ID NO: 75998 - DNA, 302 bp, Zea mays
  Clone ID: LIB3079-033-Q1-K1-C10
aaagagccttcactgcaggcgtctgtgctaagtcctgggccagctcgccaatccgatggtccggctgaacatacaggtgaacacgccgctaaaaagcaagcgacgtaaccaagggcgacgccaaggcggacatcaacgccgctatcagctctgctaatatccctttgactgtcacgttcacagacacttgcgcaagctacgacaccaacgtcgagatcgagaagatctaggagaagctccagctgaagaggcacctgaagatgcacaccatgctgaacacttacatggcggatatcctcgcc

SEQ ID NO: 75999 - DNA, 363 bp, Zea mays
  Clone ID: LIB3079-033-Q1-K1-C11
gccaaaaccacccgggctgctccggcgacccagagacggggatcatcactgacatgaggtactgccccgtggccaaggaccacttcgacctcagcggcacggcgttcggcgccatgggcaagcccggccgcaacgacgagctccggcacgccggcatcatcgacatccagttcaagagggtgccctgcaactaccccgggcagaaggtgacgttccacgtcgaggagggctccaaccccgtctacttcgcggtgctggtcgagttcgaagacggcgacggcgacgcggtgcaggtggacctcatgggggccaactctgcgtcgtggacgccgatgcgcgagtcctggggatccatctggaggc

SEQ ID NO: 76000 - DNA, 404 bp, Zea mays
  Clone ID: LIB3079-033-Q1-K1-C12
cccacgcgtgcgctcgtgaggctgagcggaattactgcagagggccaaggtgtgaagggtgagagcctcagcagttgcttcagccccaactccagatgttgctgaagcacaggccccagttgctgaggaggacgacgacgatgatgttgacctttttggtgaggagaccgaagatgagaagaaggctgctgaagagcgtgctgcagctgccaaggcttctggcaagaagaaagaatctgggaagtcatcagttttacttgatgtgaagccatgggacgatgagactgacatggccaagctcgaggaagctgttaggagtgtccagatggaagggctgctctggggcgcattcaagcttgtcccagttggatatggtatcaagaagctgcaaatcatgatgacca

SEQ ID NO: 76001 - DNA, 160 bp, Zea mays
  Clone ID: LIB3079-033-Q1-K1-C4
attcccggctctacccactcatcctaaaaaaaaaaacataaaaaaaaaaaatttaaaaaataaaaaaaaaaaaaaaaaaaaaaagaaaaatgtaaaatttaaaaaaatttaaataaaaaaaaaaaaaaaaaaatataaaattaaaaataaaaataaatat

SEQ ID NO: 76002 - DNA, 388 bp, Zea mays
  Clone ID: LIB3079-033-Q1-K1-A9
gcagatcttcaccttcgcggaccggtccttggcggccaggttcccgaacagcgcgttcgtgaacaaatcctacggcgtgaaggtgcccggcgcgccggcgtcgtggagctacagcctcaacctgcagcggctgtgtttccggacggcgtacgtggcgagcaccacggggctggccctcctcttcccctacttcaacgaggtgctgggcgtgctgggcgccgtcgtcttctggcccctcgccatctacctccccgtcgagatgtactgcgtccagcgcggggtcctgccgtggacgcggacgtgggtcgcgcttcaggcattcagcgtcgtctgcttcgtcgtcggcaccttcgccttcgtcggctccgtcgagggagtcatccgcaag

SEQ ID NO: 76003 - DNA, 157 bp, Zea mays
  Clone ID: LIB3079-032-Q1-K1-H3
cccacgcctacactgaggctatgactgtggatatgaatgtgactatgaaggaaacagtgaaggggggagacaggaatgtggacgggattatgaaggagatgattgagcgtttggaatcgcgtgtgaagacggacgaggaaaccggggacgaaaagga

SEQ ID NO: 76004 - DNA, 408 bp, Zea mays
  Clone ID: LIB3079-032-Q1-K1-H4
acggttggcttctcctccccctccggttcgggttttggttcgtgaggttctccggggttcgggttggtgggtgagcggatcgagatggcagcgtcggatgttgagtaccgctgcttcgtcggcggcctcgcctgggccacggacgaccactccctacacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggtcgcaacatcaccgtcaacgaggcccagtcccgcggcggccgtggaggcggcggctgtgggtacggtggtggtcgtggaggcggcggctacagcggt

SEQ ID NO: 76005 - DNA, 325 bp, Zea mays
  Clone ID: LIB3079-032-Q1-K1-H5
aggccacgcgtccggcatctgatgataacaagactgtcaatgtgatcgcgacctgatgtgtctcaagtaatggcggctaacgaatttgagtccaaagatccaatggatggctctatgtccaagcaccacggcatacgctacctattcggagatggttcacgactggtgttccgtctatacataaccgtgcatgttgagtgccaccatccgtgtctacactcgacgatacgagaacgattccttcaagaccgtcagggattcacaggatgcccttgctccaatggatgatgttgcgcttaaacttctccaaaatccaagagtacac

SEQ ID NO: 76006 - DNA, 333 bp, Zea mays
  Clone ID: LIB3079-032-Q1-K1-H6
acggttggcttctcctccccctccggttcgggttttggttcgtgaggttctccggggttcggattcgtgggtgagcggatcgagatggcagcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgag

SEQ ID NO: 76007 - DNA, 235 bp, Zea mays
  Clone ID: LIB3079-032-Q1-K1-H7
gcgtcaggcatcctcctatactatgactgttggttggaatgtgactacgaacgactcgtcagggtccggtagagcgacctgcacttgattacgaacgggacggttgcgccatcgccatcgaccctgaaagcggtacaggaaaccctggaggccaccgcagctgtcgaaaaaatcaccgggttcaccgctacgcggatccccttgtactaccccttctgcctcaacggagtcagca

SEQ ID NO: 76008 - DNA, 446 bp, Zea mays
  Clone ID: LIB3079-032-Q1-K1-H8
gcgccgccgcagcccgcagtcgcttgcgcgcttcagcacttcggaccgccgccccatgccattgccgccagtgtctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctacacttaggaagtctgagattgagtactacgccatgctggccaaagttagtgtgcaccatttccacggaaacaatgttgatcttggcactgactgcggcaagtactacagggtgtgctgcctcagtatcatcgacccatgtgactaggacatcatcagtaccacccttggcacccagtgagccagccccggacccattgca

SEQ ID NO: 76009 - DNA, 313 bp, Zea mays
  Clone ID: LIB3079-032-Q1-K1-H9
cccacgcgtccgcggacgcgtggtgccggagatccatgcctttgtgagctcgagtggagagaaggaattaaggagcagtgaatagcgatacgaccgacatgctggagaagctgtgggacgacgtggtggcctggcctcgctccggagacggtcctcgtgaagctacgcaaggccaccaccgtccgaccgatcgtagtcgtcgacaaagaaatgactacatgcatcttctgatctgctggattgagtacattgaacacttgggggacacatttggcgaagaacacggtcatctttatcttctactttctttaag

SEQ ID NO: 76010 - DNA, 374 bp, Zea mays
  Clone ID: LIB3079-033-Q1-K1-A1
aatcccttgagggactgcaggccaatgtccagaggcttaagacatacaaggccaagctggttatgttcccaaggcgtgcacacaaggttaaggctggtgactctactccagaggagcttgccaccgctacccaggtccagggtgactacatgccatttactcgtggtgagaaacgttcagttgaggttgtgaaggtcacagatgagatgaagtcatttgctgcctatggcaagctccgccttgagcggatgaacaagaaacatcttggtgcccgtcataagaaggcagcttaagcagagaatgaagataagaagtgaagctgttgaagatagtaccctgttttgttctattcaatcattaatgaatgctactac

SEQ ID NO: 76011 - DNA, 350 bp, Zea mays
  Clone ID: LIB3079-033-Q1-K1-A10
ctcctgcgacaccacaaccacacgttcacggtagcgagagcttatcgacatcggcggtgaaaacggagtctatgaagctgcagaagcggctcgccgctagcgtcctcaagtgtgggaaaggcaaagtctggcttgaccccaatgaagtcagcgagatctccatggctaactcccgccagaacatccggaagttggctaaggatgggtttatcatcaggaagcctcagaaggttcactctaggtcccgtgcaagaagggcacatgatgccaagcagaacggaaggcactctggatacggcaagcgcatgggtaccaaggaggctaggctccccaccaagattctgtggatg

SEQ ID NO: 76012 - DNA, 394 bp, Zea mays
  Clone ID: LIB3079-033-Q1-K1-A11
gcactctgcagtcccatttctcaaccataaggttctcacaccatcttcttcttcttggtgattcgattcttccttggtgcactgttcttgtacttgaattcagctcccatctagtgtgttagccacacctcgccccatccgaagtcccacctaaagaagcagagagatagaggcaacaatggcgaaagacgggctgagcaagctccagcgcatgatcaacaggtaacactcgtcgacccgcatcgtctcccacgccccgtctgcatcatcagctccactacggctccacctactgagactcacactgcgcctcgatccacagcgcagacgaggtgtccaactgcctgcacccggtctacgttggtaagtctagccttctgtaccttttcatcta

SEQ ID NO: 76013 - DNA, 389 bp, Zea mays
  Clone ID: LIB3079-033-Q1-K1-A12
cgcaaggctgagcatgcattctacttggactgggctgtccactccttcagaattaccagctgcgagatccaggacaccacccagatccacacccacatgtgctactccaacttcaacgacatcatccactcgatcatcgacatggacgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcc

SEQ ID NO: 76014 - DNA, 375 bp, Zea mays
  Clone ID: LIB3079-033-Q1-K1-A2
ggccgtccgaccgggctctcctccctctttttacccgcacccgccgcaacgccgagaggacgcgggagggatggaggaggtgagccaccggaagcggagacttgagcagtcgaccaaccccgtcgatccggctgcggcccggcgtgctagatcgctaccgatcatggtggtggatgagatcgccgacggggtgaagaacctcaccgttaccggagacgcggcggcttcaggcggagagggtcatacgaggggcggcggctgcagcagcaaccgcatccaggtgtccaacaccaagaaacccctcttcttctacgtcaacctctccaagaggtatatgcaacagcacgaagatgtagagctattcgatcttggaat

SEQ ID NO: 76015 - DNA, 387 bp, Zea mays
  Clone ID: LIB3079-033-Q1-K1-A3
gggtttctctccctcccttgccttcgtctccgcctcccgtctttcctcaagaagtcgattcccgtccccaagaacccaagcccccaccatgacaagctcctcctctccttcccgaaaggcgctgagcaagatcgcttgcaatcggctgcagaaggaactcgccgagtggcaactcagcccccctgctggattcaagcacaaggtctccgataacctacaaaggtgggtaattgaggtcactggagcggcgggcaccctttacgccggcgagacctaccagttgcaggttgacttccctgagcattatcctatggaagcacctcaggtcaattttctcaatccagcgccaatgcatccacacatctacagcaacgggcacatctgctt

SEQ ID NO: 76016 - DNA, 410 bp, Zea mays
  Clone ID: LIB3079-033-Q1-K1-A4
gcgaaaagaactgcatttaaggctaggacttcccttagatcggcctttgttgcgaatggctaatgcattgactttcggtggcatgggaaggaggaagaaaagcatgccaagaagtggttcttcgctgcttcgagacatccacagagaacttccatctagtggtgtatccggaggtgttatgtctttgattgatggttcatatgagtattatcattatcttcacgatggtattgatgacaatggatggagatgcgcatatcggtctctacaaacaattgtctcttggtacagattgcaacaatattcatcaatagatgttccttctcacagggagattcagcaagttcttgttgaaattggtgacaaggatccatcatttattggatcttgtgagtggatccgtaccattg

SEQ ID NO: 76017 - DNA, 365 bp, Zea mays
  Clone ID: LIB3079-033-Q1-K1-A5
ggctcggtcaaggagctggggatgccggtcgatggcactgcactgcgacgtaaacaacgtggacgggctacgcctgtacagaaaccaaggcttcaagtgcatacgagtgccggaaggagctaaatggcccgaacccaagatagctaaaggagcggagtacaacttcatgatgaagctagtgcccaaggcttgagtcttgaaccttataagatctgactagggaaaaaaagggaaaggtttggccgtgtaggttctgcacggatgcacgatttgctctgcattcatgtgtacagcatttggtgtatagtggaagctactttgtaaatggtatatataacagctacgtgttggtccatagtgagtga

SEQ ID NO: 76018 - DNA, 285 bp, Zea mays
  Clone ID: LIB3079-033-Q1-K1-A6
gtactgatcttagacgtatgctcactggcagcacttgcaatgtctcccaggatttctgggccttttctccatgcgcacggcgtatctccttcttcgactgctctcactgtgacggtgagacattcgaaaagtccatggcaactgaaacgtgaacatatggtgtatgtttcttcccctaattcggtcgtatttggatgcttgagtcctgcattgcatgatgaagaacattctcagtctctcgtcgcgtgtaaatattttcattcaagatctatcaggttaccgaag

SEQ ID NO: 76019 - DNA, 373 bp, Zea mays
  Clone ID: LIB3079-033-Q1-K1-A7
aaagccctcctgtatcgctgtcgtctgcacgcctagggactctctgcctcgccgggggagcgatgcagccgctgcaccaaccgtcgatgaacggccaacacggtccgcctcctccgcagggatccggggttcccacggcttcgcagcagcaagcgccaccgacgtcgtactaccagcagcagcagcagcagcagcaggggccaccgtctcagtactaccagcagggtaccgcacaggcgtgggcgcagcagcaacagtacgctccaccgccgccgcagtaccgcgcctcagatgcagcagtacgctctaccaccgcagcagtacgcccttccgcagtagcagcagtacgccgctacgccgtagcagcaatacg

SEQ ID NO: 76020 - DNA, 390 bp, Zea mays
  Clone ID: LIB3079-032-Q1-K1-H2
acgcccaaaccccatcgatatcccaagaaatcctcgcaagaaccaacttttagtgcccaatgcggccaagattgccaacgcctccgaaattccggttcctcgcatccccactagcacttccaaggccgcaatcctggcccggaaggccgcgctttggcgggacgcccttgtccccgttgccgccgccttcgcgtcctgtccgctcccttccctcgcggcggagggcgacgggaaagtgagcctcgagtccatcgtggtggcaatcgacgacttcaacaatcgcaaccctttcttcgtggctggggtcgtgttcgtgtggctagtggtgatcccgctcctgcaggagtacgtcttcaagaagtacaagcccgtgagcgccatcgacgcgtt

SEQ ID NO: 76021 - DNA, 357 bp, Zea mays
  Clone ID: LIB3079-028-Q1-K1-C7
gagggaggaggttggtgcaacaccacgcagagctgctccgagcgcaaaatgaccaacttcggttcatctaagtatatgggagcagtaaacttcactgggatactcagcaatgatcacacagaaaatcctgatttctacaactggaatacagttgtcataaggtactgcgacggagcatcatttgctggggatgcagaggggggagatctggatggaaccaaacttttcttcagaggattacgtatctggaaagcagttgtagatgaactcatgggaaaaggaatggacgctgctaaacaggccttgcttacaagctgttctgctggttctctagctgcgctactgcactgtgataat

SEQ ID NO: 76022 - DNA, 337 bp, Zea mays
  Clone ID: LIB3079-028-Q1-K1-C8
gagggaggaggttcgtgcaacaccattcatagctgctccgagcgcaaaatgaccgggttctgttcatgtaagtatatgggagctgtaaactacactgggatactcaacaatgatcacacagaaaatcctgatttctacaactggaatacagttgtcataaggtactgcgacggatcatcatttgctggggatgcatagggcggagatctggatggaaccaaacttttcttcagaggattacgtatctggaaagcagttgtagatgaactcatgggacaaggaatggacgctgctaaacaggccttgcttacaggctgttctgctggttctctagctg

SEQ ID NO: 76023 - DNA, 285 bp, Zea mays
  Clone ID: LIB3079-028-Q1-K1-D1
cccacgcgttcgcccacgcgttcgcccacgcgttcgcccacgcgttcggtccttcacgcaagccaaagcccctcggatcggatccggtctcctccgtgtcccattcgccacgcagcggcgccacaggagacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttct

SEQ ID NO: 76024 - DNA, 346 bp, Zea mays
  Clone ID: LIB3079-028-Q1-K1-D2
cccacgcgtccggccaatcagagcgtgttcctggtgaagttccagccaacaatatctgggttccaagaagccatgagagtgcatacccatttctccaccagaaaccatggcaaagaagagttccagctgatgaaaggcagcaaaggtaagaaggctgcctccactgatagcctggaagagctgctgtatgcgcatattggggtcgtggaagacctggggctgctggatgagggaacaaagaagagatgcaaggtcatgaggaagaaggaaattgaggcaaatgcagaggcaacactgaatttagaagtttattaggtctagtactaggatccgaaccatttgaagt

SEQ ID NO: 76025 - DNA, 397 bp, Zea mays
  unsure at all n locations
  Clone ID: LIB3079-028-Q1-K1-D3
gccgccggaggaggagccccaggccccgtcgtcgtcggacacagagcctaccgaggcggcgcccggcgaggcggaggatgagccgcaaaccctagagcgggcgcaggagctcttcgacaggggttccaaggccatcgaggatgaggacttcgtcgacgccgtagactgtctcagccgagcgctcgagatcagggcttcacattatggagagctcgcaccggagtgtgccagcacatacttcaaatatggatgtgccctgctatacaaagctcangaggagagtgatgttttgggaaatgttcccaagagcttgccaaatgaagactcagtgaagagtacagctactaaagatgacagtggaacctcaaaggtctctggtaccgatgcggaagatgct

SEQ ID NO: 76026 - DNA, 350 bp, Zea mays
  Clone ID: LIB3079-028-Q1-K1-D4
gcacgctactactcatcactcgccaacgtgcagagatcagggaagcggcactccatgcactgactgaccgctcatggcgaaggtccacctctacgtcgccgcggcctgcgccgtcgtcctcgcgctcgccaccccggccctcgccggtgaccccgacatgctgcaggacgtctgcccggctgactacgcctccccggtgaagctgaacgggttcgcgtgcaaggcgaacttttcggcggacgacttcttcttcgacgggctgaagaacccgggcaacaccaacaacccggcgggctccgtggtgactgcggccaacgtggagaagttcccgggcgtgaacacgctgggcg

SEQ ID NO: 76027 - DNA, 339 bp, Zea mays
  Clone ID: LIB3079-028-Q1-K1-D5
aaacaaagcaagaaatagaataatgttcttgactcaaaggccaaatgtacaacagggggacattcatgagataaaagggtggaagtgttgaatatgctaatgaaagccgctagggaaagactgcactgatttgatcacgatccttctattatcatttctgcactgtgattcattatcttgctgcttgtggtctcatactgcatcaccattatcattatcatgcatgctgatgtggcctataggcatgttatacaaacagcgatcactatgatgccttagcagcttttgctcagtcaatctcgtgattgttgctcgtgcatgtggttataaatcttgatt

SEQ ID NO: 76028 - DNA, 374 bp, Zea mays
  unsure at all n locations
  Clone ID: LIB3079-028-Q1-K1-D6
tcggaaagaggcaccctgatccctttcttgtaaatgttggtgagcatgttggcattggcatcttgatctgtttccataggtaaggtgaagaggattgtgtaagataaaagggacaagctgtatgtaaagacaagccaaagctgagtgaatttcaggcaccttattgtgtggagggtcctgtgtttgttgagtaggcaacgctcgggctggtgtgagatgatgactgcatttgtgttgtgttggtggtattttcactgctgacatgactgttgtatcggatgacatcttttctgttttatgacagtggcagtgtgatactaagctgttaggaggggacggnggaggtcaaacccaacgtacatcatgagtggagc

SEQ ID NO: 76029 - DNA, 365 bp, Zea mays
  Clone ID: LIB3079-028-Q1-K1-D8
gggggatcggtcttgttctcggagagggttgagctgcttgacggttttgactcggatcatggtgtgcagctctatcagatagagagctgacgtgaggtgtgagacgcggatcgtggagtactactcagtaggagatcaagaggaaggaggtggggagggggaagaaggcgatagccggggaggatggtgcttgtgcttgcgctgggggatctgcacatcccgcaccgggcgcccgacctccccgtcaaattcaagtccatgctcgtgcccggcaagatccaacacatcatctgcactggcaatctctgcatcaaagaagtccatgactacctgaaaagcctttgccctgatctccatattaccag

SEQ ID NO: 76030 - DNA, 329 bp, Zea mays
  Clone ID: LIB3079-028-Q1-K1-E1
tccaattctaaccccttcctatcgaccatcattctcccctctgcctgcgtcgtcctcggcgccatggaccttgcggacgggcgagacgacgccctcaatggaggcgtcggcgtcggcgtcggcgtggaggagacaaggaggaggaggaaggtggagctggtgcaggaggccatccgtggcttcctggaggagaagaggagcgatggccagggaggaggagaggagcgcttgacggccaggctcagggaggaggagcaagagctcctgttgtcgttgctctccaagttgggcgagctaaaaaccgaccccgatccagacatcttggaaga

SEQ ID NO: 76031 - DNA, 67 bp, Zea mays
  Clone ID: LIB3079-028-Q1-K1-E2
ggactcgtggggcaaaaaaaaaaaatataaatataaaatataaaataaaaaaaaagggggaaaataa

SEQ ID NO: 76032 - DNA, 336 bp, Zea mays
  Clone ID: LIB3079-028-Q1-K1-E3
ctgggactttctgagaaatatcagaagaaagttggtccactccgatattttgtggctggaatactgaaatgattatgtatgcctaactacttatatgaactggaatatcttccttggccaaaggagatggccgtgaatggaaaaggtacagatcaagacaaggcccacctgtccaatgtctataccgatgtgatgcacagcagatcaaagaaagaaggaattgcaagagccttcagtttgtccagtattgattctattatgactccaagtcggatgtcgcttggggatgttgatacatcaagtaatacagtggcaagcactgaaccatcagactat

SEQ ID NO: 76033 - DNA, 249 bp, Zea mays
  Clone ID: LIB3079-028-Q1-K1-E4
tcgaaaaaaataaatgaaaaatataaaaaatatttaagaaacactaagatattaaataaagggggtactacaatgtttatgtggcgatatcaagtactcttacatgcgaatgtataactttccaaaggagtatagtaaattaaggtaactggccagatcattacaaggtcctgattggcaaaacctatacctatctgatgttaatcagattaaagaaagatcgaatttccccagcttgcagtatatcca

SEQ ID NO: 76034 - DNA, 335 bp, Zea mays
  Clone ID: LIB3079-028-Q1-K1-E5
gcgctatcggcgctgcgccgcagcctcagggaccccggcggcttgctgcacagctgggaccccacgctcgtcaacccctgcacctggttccacgtgacctgcgaccgcgacaaccgcgtcacccgactagatcttggtaatttgaacttatctggtcatctggtgcctgagcttgggaaattggagcatctgcagtacctgcaactttacaagaactgcattcaatgaacaattccttgtgagcttggtaatttgaagaatctaataagcttggacttgtacaagaacaacattatggggacaatacctgctgtccttggaaagttgaaatccct

SEQ ID NO: 76035 - DNA, 319 bp, Zea mays
  Clone ID: LIB3079-028-Q1-K1-E6
cccacgcgtccgcccacgcgtccgggcagcggcgtgcgatcccaagccgctggtggtgtgcgatccggcgttcatggacggagcgaaacccgcggcagcatgctgctccaccctgcgtgcgcaggaggcatgcttgtgcgtgtacgccaaagaccccaagtttgcaaaatacatcaacaaccccaacaccgccaaaacctttacctcgtgcggcatagccatccccaaatgctaagcaagcgctctgcgtcgtcgcttcgcttgctcttgctcttgtgtgtaacatatccagcttatgaataaattatgtggatcagtt

SEQ ID NO: 76036 - DNA, 387 bp, Zea mays
  Clone ID: LIB3079-028-Q1-K1-E8
gcctcttcgctctgctggtgttcttcatacgagtctgccggcagtataaccagtgcgccagttctgaagctgccggcgagcccagcacagctgctgcggatcctgtcctaagacagcggcgaccatcacgccttggcagcttcaaagacctgatccagttcgtcgacaagaaggaggaggagattaagaaaacgatgaaacgaagatcaggcgagaaagatagccaagctgcaggattctcatacgctcagtcagtggcttcagcataggacattgctccaaccatattgaattaggttatctccaaaagcataggacattgctccaaccatattgtaaatagtagtggtgtactgtgatcagaacgaagatcagggttctcatacg

SEQ ID NO: 76037 - DNA, 342 bp, Zea mays
  Clone ID: LIB3079-028-Q1-K1-F1
gagggccccgccccgacgccctccgtcgaggtgccccctgcccccagcgccgtcggcggcgtcttccccggcggcgccaagtggttcgccgccgctgccgccgtggccgccgccgccgtcgccttctactgagagaagggagatctgcactggcccgtgctgtaatttatttgttatccgtgttgagccgttgattccttctttttttttcttttcaccattttttttcttccatccgaatatccatattccattcggcattcgattcagtaggactggcggcatctgttcgttcgtgttgctacagggtaagaccgtggctcggaccagatggttgggctg

SEQ ID NO: 76038 - DNA, 374 bp, Zea mays
  Clone ID: LIB3079-028-Q1-K1-C6
ggatattgtcatgcttgtcatatcatggcacatgaaagccgccacaatgtgtgaatttactcgtcaggaattcattggtggactgcaatcaattggggtagattcaatcgagaagtttcgtggaaaattaccatcattacgagctgagctaaaagatgacaataaattccgtgatatatacaactttgcattcacttgggcaagggaaaagggtcaaaagtctctctcactggagactgctattggaatgtggcagttgctatttgctgaaaggaactggcctcttctggatcattggtgtcagtttttacaggtcagacacaataaagccatatctagagacacatggtcccagctgcttggatttgtgaaga

SEQ ID NO: 76039 - DNA, 338 bp, Zea mays
  Clone ID: LIB3079-028-Q1-K1-F2
gcctaattcaaatagcaaaggaagtgataaacacccagcggttaatgatattactgctgcagtttgcaagcaaaagatggatattcaagaagcagaaacacttgtaaaacagtggcaagacataaaatctgaagctcttggccctgactatcaaactgacatgctacctgagattcttgatggttcaatgctctctaagtgggaagacttagcgttattagcaaaggaccagtcttgctattggagatttgagctgctaaatcttaatgttgttcgagccgagataatcttggatgaaataggtgctggtgaggcagcagatattgatgctgtacttg

SEQ ID NO: 76040 - DNA, 339 bp, Zea mays
  Clone ID: LIB3079-028-Q1-K1-F3
gcttgaactattgacaggacgtagaccatttgacagctctagacccaggtcagagcagtcacttgtgcggtgggcaacaccccagctgcatgacatcgacgcattggacaggatggtcgatcctgcactcaagggtctatacccagccaaatctctatcccgatttgctgatgtccttgccctgtgtgtccagcctgaaccagaattcaggccaccaatgtcagaggtggtgcaagcattggttcgacttgtgcagagggccaacatgacgaagaggatgcttgatggggatacttctcggcgaccagatgacctggaccaagatttcatatgacaagc

SEQ ID NO: 76041 - DNA, 387 bp, Zea mays
  Clone ID: LIB3079-028-Q1-K1-A3
cccgaacccaaacgtggctacgggcgccctggtgggtgggccgttccagaacgacagcttcgtggactcccgtgacaacgccgtgcagacggagtccagcacctacaacagtggcaccctggtcggtctcctctccggcctcgtcaccacttcctccgtggtacagtcgttcacctagagggctcctcctatgttctggcctggagcgatgcgtgtacgagtacgattgcagtttttttgcttggcgtggctgatggtgatgcgcgatctgtgactgtgagagagaaagcttggttgccaaccgttcagttcagacggatggcatatgcaggatgcagcagtagtttagtagtgcccacgcgtttcttctggtgtgtgtgtacaatg

SEQ ID NO: 76042 - DNA, 321 bp, Zea mays
  Clone ID: LIB3079-028-Q1-K1-A4
tcgtcacaaccctctccctcttccatctcatttccgctgcggctgcaacaataaaataatgagtctcgtgcaggcgaaggacgtacgacgacgcggacgcaccgtcaaagtctacaggctgcgcaatccctttctccctcttatccccaaggcgaggagctgagggggggggggggcccttctgctgctgttcttgtttccccgctctccaagatgtcgtccccgagcaagcgccgcgagatggaccttatgaagctgatgatgagcgactacaaggtcgagatggtgaacgatgggatgcaggaattcttcgtcgaattc

SEQ ID NO: 76043 - DNA, 345 bp, Zea mays
  Clone ID: LIB3079-028-Q1-K1-A5
gatatatccaacccccagcaaaccgacctggcactttggttggtgacacaagggtgcagtttcacaatgaccaaacacatcttttggtcgtccatgagagccagttgggaatctatgatgggaatcttgactgtttgcgcttgtggtctccaagagatgcactcccagctccgatatcgagtgcgatatactcgtgcgacggtctcttggtttacgctgggttctgcgatggtgctatcggagtcttcgaagcagaatctcttaggctgcgctgccggattgctccttccgcttacattccaccttcaatactagcctgtgctggacgggtctacccgttggtag

SEQ ID NO: 76044 - DNA, 345 bp, Zea mays
  unsure at all n locations
  Clone ID: LIB3079-028-Q1-K1-A6
cccacgcgtccgctccccgccgtccaccgctcgccgcccccggccgccatccagccgccggtacagggctcatcctgccggtcgcagccgtgtccacttccttcacgaagagaggcgcgtagactggggagctggagcgaggacaaggagacgagggaaaggatgcagcagctgcaaccgaagcagatgcactgggtgagggccgactcctccgacttcgggggcgaccgtcccgccccccgcagcgggcacactgcggttatcattggcaagtccaaggtggtcgtcttcggaggattcgccgacaagcgcttnctcgctgatgtttccgtctacgacgtcgag

SEQ ID NO: 76045 - DNA, 366 bp, Zea mays
  Clone ID: LIB3079-028-Q1-K1-A7
cccgggatcttctccggctataaatttccgccccaattccccaatccagatgcgcagacatcgaatcgtctcgctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagct

SEQ ID NO: 76046 - DNA, 319 bp, Zea mays
  Clone ID: LIB3079-028-Q1-K1-A8
cccacgcgtccgcccacgcgtccgcgactggcgatggcgtgcgtgctggcgtccgaggctgccactgtactcgccggcatgcgccgcaacgtccgctgggcggacgtccgctacggcggcgcgggggacgacgagcaccttgaccacccgctcgtcgcggggctcaaggctctccgccgccgcgctgccgcgtggggccacggtcgctggacgggcgtcgaaccgctcctctaccttcgacccttcctcgatgtcgtccgctccgacgagactggggcgcccatcacgggcgccgcgctctcgtcgttgcacaagatcc

SEQ ID NO: 76047 - DNA, 336 bp, Zea mays
  Clone ID: LIB3079-028-Q1-K1-B1
gtggagacagtcgggtgatgtctaagaggttcaggaattatttcaacttttctcatgccctcattgcaaaaaactttgacccttcagagtgtgcttgggcatatggtatgaatatttttgacctgaaagcatggaggaagacaacaatcaaagatcagtatcatcattgggtcaaggagaacttgaagtcaaacttcacactttggaggcttggaacattgccaccaggccttattgcctttaaaggccatgttcacccaattgatccatcatggcatctgttaggcttgggttatcaagaaaagacagatgtcaataacgtttgaacaagcagca

SEQ ID NO: 76048 - DNA, 358 bp, Zea mays
  Clone ID: LIB3079-028-Q1-K1-B2
cccacgcgtccgcgcctcgactggtagcccgaaccctagctagcaggtcggaggcgagagagcagccatggcgcggtgcctcgcgctcgtctccctccttctcctcggcctcgcctccggcgcctccgctgccgatgcgccctttgtcgtcgcgcacaagaaggtttcgctctcccgccccaagccgggcgtcgagcgcgtcgccgtctccctcgacctctacaaccagggatccgcgactgcctatgatgtgtcacttaatgacgactcttggccaacacaagcatttgagcttgtcactggagagaaatcgaaaacattggaaagggctgaccctggggccactgctacacacaca

SEQ ID NO: 76049 - DNA, 214 bp, Zea mays
  Clone ID: LIB3079-028-Q1-K1-B3
cccacgcgtccgcccacgcgtccgctgtttgttccttggagccgcccccggcgtccgcggcaccggtcggccctggggcggcccctttcggcgcggtcgggaacggccccgaacccagacctggccgaagctttcggttcctctggagaaccacaaagctttggcgcgcgccgggaagcgaaaaccaagagagccaacctagacctggggaaag

SEQ ID NO: 76050 - DNA, 235 bp, Zea mays
  Clone ID: LIB3079-028-Q1-K1-B4
gatcgatcgatctgtggtgattggtgtccctctctgtgtgtttgtgtttagttcccagtcgtttgtgaggaagtcagttatgtttgagtgagggggggggggggggggggtccttcgctcttcggtgaactctgtacttgtcatgaggagagttttcacacccggagtgtagaactctgtactgtactcggatccttcctttttcatccaagtgggttttattttatcaaccctt

SEQ ID NO: 76051 - DNA, 257 bp, Zea mays
  Clone ID: LIB3079-028-Q1-K1-B5
tcgatctactatcaggtgttgatgttgggtacacagcccatgctagcaatggtgatgatgttgatgatgatatattttacactggaggtgggatggaactggagaccgttgaaaataaaaaaagtacagagcctaccatcagtgaataaaaaaaaaaaaaaaaaaatataaacaaatgaaaaaataaaaaaaaaagaaagaacagatagacattaaaaaacagttgcgaaaactgaatggcgaatgagacacataaa

SEQ ID NO: 76052 - DNA, 374 bp, Zea mays
  Clone ID: LIB3079-028-Q1-K1-B6
ggcccgcgcccgcttggtccagcgccggccctgcctgcagccagccaccgttgtccgttccctcccgcgatccactcctctcgagctctaggggacggaaggaatccggcgggggtggggtgcgagcagggggagggagaagagcagccgcccgccccgcgagggggcaacagctgcccaagaacctgaccggaagagttgtgggagcggcggcggaaagatggggcaggccctgcgcaggctcttcgactccttcttctccaccagggagatgagggttgtgatgcttggtctggatgcagctggtaaaacaacaatactgtacaggcttcacatgggagagggtctttcaacagttcctacaagtcggttta

SEQ ID NO: 76053 - DNA, 375 bp, Zea mays
  Clone ID: LIB3079-028-Q1-K1-B7
ggaggagatcggtgtcttcgtggccgaggacgacgtcccgaggctggacaccatcctgacgtccataccgatggaggtgatcctccggaagcagaggctgctcgcgaatccgtccatgaagcaggccatgctgttcccgcagcccgcccaggctggggacgccttccaccagatcctgaacgggctggcgcggaagctgccgcacggtgaggacgtgttcctcaagcccgggcagaaggtgctcaactggaccgagggcccccgcggcgacctgaagccatggtaggtgtactggaaaaaaatgccatggcaccgtcagcgtgtccgctgttcttgtgtacgctacacagcacaaccagatgggaagctgatcga

SEQ ID NO: 76054 - DNA, 413 bp, Zea mays
  unsure at all n locations
  Clone ID: LIB3079-028-Q1-K1-B8
gagccatcgacgctacaccaccggcgatcaccttccggatctagcggcctaggtgggcgctcacagctccaacgccgcagaggttcgccaacgcatcgaccagatccaactctggcaagaaggtagaaaattctacttttgttttcgcacaaacactccaacaaaaaatattgtacctttgtattcgtacaatccctgtcacagtatcatatctacattttttgggtctacctcaatgacaacaaccctctcaatacctttgaaggtgtgatgtcaatacctagaaagctgactgcatttgtttaaaacattggtttcgtagatgtggttatgattttggcacaaacagaagcgtgcccgagaacaagctanggccctttgcgaatcagatgctaattactgcaattggtggt

SEQ ID NO: 76055 - DNA, 275 bp, Zea mays
  Clone ID: LIB3079-028-Q1-K1-C1
tcgaaaaaaaaaaaaaaaaaaaaaaaaaatttttaaaaaaaaaaaaaaaaaaaaaaaaaaaggggaaattaacaaaaaataggggaaaaaaaattaaaaaagggtgcgtgctccttcgtttccatgctttccttccctctaattggacgtcatttctcttcatttaagtccccttaattctgttaaatgcccgacttttcccaacttggtgacccggaaaaccttgccttttcccacctttatcgccttgcacatttgcccttttggacagttcc

SEQ ID NO: 76056 - DNA, 290 bp, Zea mays
  Clone ID: LIB3079-028-Q1-K1-C2
agcgatcccactcccgatcagcagctgatcgctcactcttgcagctcgatcattctggagctgctctagctctagccctagctagtagctagccactcggtcgtgtagtcatcagccttctgatcgtcacccatggccactgccgaggtccagaccccgaccgtcgtggcgaccgaggaagcgccggcggtggagaccccggctccgtccgccgtcgtgcccgaggaggctgcccccgccgccgaggccaaggtggaggagccagctgccccggcggagaccgagccagc

SEQ ID NO: 76057 - DNA, 332 bp, Zea mays
  Clone ID: LIB3079-028-Q1-K1-C3
ggcgatgtggtgcggctcctatttcgtctatgatgactgtgcagcgatggtcgcgtggcccttcagccacccaaatcggaaagcctgctgttcacatggctagcgttgacttgaaaggaaaagcatacgatgtattgaggcagaattcttccaggtttttgttggaagatgtctacaggaacccaggtccgctccagtttgaaggaccaggtgccgattcaaagcctatctcactgtgcgtcgaggatcaagactacatgggcaggataaagaaattgcaagaatacctggagaaggtgaagagcattgtgaagcctgtgtgctcgcaggat

SEQ ID NO: 76058 - DNA, 282 bp, Zea mays
  Clone ID: LIB3079-028-Q1-K1-A2
aaaaaaaaacaaataaaacacaaacattaaaaaaaaaaaaaaaaaaaaagataccgagggggaaatatccagaattaaggggctaaaaatacaacccaaataactcaattaaaagaatagaaaaaaatgggactcggtttcacaggacccgacgtattcttcgtctggcatctcacctatatgttcctctttggtgttacctatgtccatttcactttccttcattttccatatgcttatactgggaaaaccgttattgtccctcatataatctccttgagc

SEQ ID NO: 76059 - DNA, 325 bp, Zea mays
  Clone ID: LIB3079-028-Q1-K1-C4
gcagaatttgtgctgtaatactgctgatgaataggaacgaactatacaagattggggggtcctatacatcagcaatatgagagctggaatactacatggaattggtgaaatatgagggaatatgctacaaagaatagaggcaaaattcttacaagtttatgttggaagatgtctacaggaacccaagtccgctccagtttgaaggaccaggtgccgattcaaagcctatctcactgtgcgtcgaggatcaagactacatgggcaggataaagaaattgcaggaatacctggagaaggtgaagagcattgtgaagcctgggtgctc

SEQ ID NO: 76060 - DNA, 363 bp, Zea mays
  Clone ID: LIB3079-028-Q1-K1-C5
ggcagcagtttggtagcggtgataaaatatttgacggcggcggcagcagcagcaccaggaggcctacgacgaggatgaggacatgccgggcggcgcgcagagggtgcagtgcgcccagcagtaggcagcagtttggtagcggtgataaaatatttgacggcggcggaaaaatttgtgcgactactgttaggtccaaccgtccaattttacacgcgcgtattaatgttatgatcatacttgtctttgtttattatgtatgttttgcgttacgggatctgtgcggattagttctaggcgatgtttagattcaatttggtgttgctactagcagcgatctccaacccatatgacagttggaacgtg

SEQ ID NO: 76061 - DNA, 405 bp, Zea mays
  Clone ID: LIB3079-027-Q1-K1-F6
gcccgccgtcgccgaagaagacgaagcggtttctgaggagaccgagcgccgcaaccgcggcctcaagtccggccttcacgcccttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcattcgttccctctgggaggatcctgcaaaccagaatgggggcaagtggataattagattcaaaaaggcagtttcaggtcgatttttggaggatttggtgctagtggtagtaggcgaccaacttgagttttgccgatg

SEQ ID NO: 76062 - DNA, 364 bp, Zea mays
  Clone ID: LIB3079-027-Q1-K1-F7
gttgtctcggttgtgtgttacattgccacgttctgagtctcgggtctcctatttcactgggtcactccatgtggacatggctgctgactcaacctgtttttcattgtcttcacattgattcttgcacctgcgtatgctattgtaagccctgcaccgcatagatcaatggaagcttgttgcctgcatcagttattggtatgtactgcacatatctgtgctacagtggactctccagtgagccaagggattacgaatgcacagggcttcactatcactaagaagctgtgtcaactggttaccttacattgagactgcttaccactgtactgtctgcggcctattctgctgacctctctggcttctc

SEQ ID NO: 76063 - DNA, 391 bp, Zea mays
  Clone ID: LIB3079-027-Q1-K1-F8
cccacgcgtccgggctatctgcagaactgctcaggatatcgcgaagccaattattgcgtgggaacactgcaaagtataagagagactctgttgagtttgaatcacttactttgggtagcttaccacccacctttcaagggatgaaagtctatgtcacagaggagcaagagctgataatggaaccatctcttaaatgggctgcaaacccaaatattactgttgctgtaaaagcctatggtttgaaagctactatccacattgtggatctacaagtctttgcatcacctcgcattactctgaagccattggtgcctacattttcttgctttgcaaaaatccttgtctcactcatggagaagccacatgttgactttgggctaaaactttttgg

SEQ ID NO: 76064 - DNA, 388 bp, Zea mays
  unsure at all n locations
  Clone ID: LIB3079-027-Q1-K1-G1
gcgtcagaagatacaattcctcgggagctgcttcttgggcaaagtgagagagagatggagtatgaccgtaccggtcgaataattaaaggacaggatgtagctcttcccaagagcaaatacgaagaggatgtattcattaataaccacacgagtgtgtggggttcatggtggaaagatcatcaatggggctacaagtgctgcaagcagactatcaagaatagttactgcacaggcttggctggaatagaagctgccgaggcctcagcagatctaatgaaggccaatatggcccgcaaggaggctgcagaagatgaacctgtacagcatgaagagaagcgactagccacttggggaaccgacgtgcctcaggatctngttcttaatgaga

SEQ ID NO: 76065 - DNA, 432 bp, Zea mays
  unsure at all n locations
  Clone ID: LIB3079-027-Q1-K1-G2
cccacgcgtccgctagcgccggcgcctccacttcgttttcctcactctctcctgcagctcagggtccggcggcgaagggaaggcaagatgtacaccgcgaggaagaagatccagaaggagaagggccttgagccctccgagttcgaggactccgttgcccaggctttctttgatctggagaacgggaaccaggagctcaagagcgacctcaaggacctgtacatcaacaatgctatccagatggatgttaccgggagcaagaaggctgttgtcatccacgtnccataccgnctgcgcaaggccttcaggaagatccatgtcagactcgtcagggagctggagaaggaaatcagcggcaaggatgtggtaattggtgctacaaggaggattgtgaggccacccaagaagggttcagctgttttgcgccctcgc

SEQ ID NO: 76066 - DNA, 394 bp, Zea mays
  Clone ID: LIB3079-027-Q1-K1-G3
ggtgattctcggaacccatcatatggagcacttactgaccaccagttcacaagaccgcgaggccgtggtaagaagctgcaagaggaatgggctgttccactgaaatctgtggaggacattagtgagcgcttcacaaacttctgtcaagggaaactcacaagcagcccatggtcagaattggacggtcttcaaccagagacaaagattatcgatgaccagttggtgaatattaaccagaagggtttccttacaattaacagccaacctgctgtaaatggagagaaatccgactcgcctactgttggttggggtggtcctggaggctacgtttatcagaaggcctacctcgaattcttctgcgcaaaggagaagttggaccaactaattgagaaga

SEQ ID NO: 76067 - DNA, 333 bp, Zea mays
  Clone ID: LIB3079-027-Q1-K1-G4
gaaagtttgcaagcatcaaaacctgttcgatggagcattttcagggagagaactgggatttggggtaaaaatgacttggtccggaatggatttgtggaccatattaatacgacaaaggactccaccgactacctatggtacacaacaggttttagtgtggatggaagttactcctcaaaagggagccatgctgtccttacatatcgactccaatggccatggtgtccatgctttcttgaataatgtgctcataagtagtgcatatggtaatggctcacaatcaaaattcactgtcaaaattgcccattaacctgaggactggaaagtatgaac

SEQ ID NO: 76068 - DNA, 415 bp, Zea mays
  Clone ID: LIB3079-027-Q1-K1-G5
gcttgaaaccaagaagatcttgcttgacatatgtgctaaaataccaggattctagggtctgcagttaagctacctactgggggattgtgtcagcacttcaagtgtgctgcaattgtgatgttattctcaaccatggtaaccagggatgaggaagttgttggactttgatgaacctagaactcttgcaccaacttgtctttttgttggaggtacaaaatacatggtgatccaaggtgaacctagagtggtcatccgaggaaagaagtgagtctgagcagtgacatagtccattggtaccatgggctgtatggatataggtcactgcattgctgatagtgaggagcagaaagttcatgttattgctggtgagttgacccttaccactctccaattttagtccacccctattgaccac

SEQ ID NO: 76069 - DNA, 350 bp, Zea mays
  Clone ID: LIB3079-027-Q1-K1-G6
ctccctacctacttccttccttccccgccactgcgcagcgcgagtgcggcgacaggcgggcacacactcacactccctggaccgctctcggccccgtccgcgtcgccgcagggcgaggaggcaatggcggccggcgggaatggcgccggcggggacaccagggcgggcttcgcgcggatctacaagacgctcaaggaggagctgctcaccgacccggccttcgagttcaccgaggagtcacgccagtggatcgaccgcatgggtgactacaatgtactcggaggcaagtgtaaccgggggctctctggggtcgacagctacaagctggtcaaaggcgctgatgctctggg

SEQ ID NO: 76070 - DNA, 187 bp, Zea mays
  Clone ID: LIB3079-027-Q1-K1-G7
gataaacataaagctcaattgagaatccatactctgagcataagaaaaaagaataaaaggggggcagccgatctaagggatccgggcttccttcctcctgcaatcgacgacatacctctaattatcatggtctcgctaagattgcaattgcacttggcgcgtggcaaatgcaacgtcaaggatcggt

SEQ ID NO: 76071 - DNA, 386 bp, Zea mays
  Clone ID: LIB3079-027-Q1-K1-G8
gcaatgggaactgtcttgaagctcatgcgtttcttcaactcctggcaacctttgggattggtgctgaattcaatgaagatgacttgtgcaaattgcttccatatgtcagtcgtcgtcgtcagacacctgaactttgtcgattgcttgggttgtcgcagaaaatgccaggtgtcattgaagttctggtggaaagtggaagacctattgatgcaattaatttggcttatgtgtttgagcttactgaacaatttgaaccagtacaccttcttaaagcatatctaagggatgttaagaaaatgtcacacgccaggaatgtcaaaacttctcctggagcacagaatgagatgaatgaacgtgagttatctgggctgaaatctggcattaag

SEQ ID NO: 76072 - DNA, 417 bp, Zea mays
  Clone ID: LIB3079-027-Q1-K1-H1
caccaccaccaccagcagcagccgatggtgggggccggcggcgacgcgcccgacggggacctccgctggcccaacgggctgtccttcttcaccgcgctcaccgggcgcgcggacgacgcgaagctgcttttcggcggccccggcgctggcgctggcgctgcggacgacgactacaaggcggcgccggacgcgcacggcggtgccgagaacgtggaggagtacctcagcctggagagccactccaacaaggccaggaaggtggagagccccgcggcccagagcaccaacaagttcaagaggagcttcacgttgcccgcgcggatgagctcgtcctcgtccacgtcagcgttcccgtccgtgtcggcctacacggcgccgtcgcagcagcagcaagcacggatggagtatcgagggccg

SEQ ID NO: 76073 - DNA, 422 bp, Zea mays
  unsure at all n locations
  Clone ID: LIB3079-027-Q1-K1-H3
ggcaggagctctgggcagcgtgcgcacgtggggtacctagctcgctctgctagcctgccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgncatcgcgctggcgctcatggcggccgggttcgtcacctccggcggcctcggcgtccctgcgctgtccgtgttctcctggatgtacaagtacctgacgggcaagcac

SEQ ID NO: 76074 - DNA, 388 bp, Zea mays
  Clone ID: LIB3079-027-Q1-K1-H4
caaactcttcccaataaattacgacccccagccaagctttggagtgcggttcccaagcatggcgggctcccccactggctccctcgccccgccggtggtgcctatggagcttcacgccggcaaccgcgaccgcctcgtcgccgcgctccgcggccacatctccgcctccgcgcgcccgctccacggcctcgtactgcttcagggcggggaggagaagacacggtactgcaccgatcacctcgagctcttcaggcaagagagctacttcgcctatctctttggagtgcaagaaccagggttctacggcgcaattgacatcgcctctggacagtcaattttgttcgctccaagattgccagctgactatgctgtttggatgggtgaaata

SEQ ID NO: 76075 - DNA, 428 bp, Zea mays
  Clone ID: LIB3079-027-Q1-K1-H5
taaaaagacttggaatttggagtacatctcattctaacggacttgttgtccctgatgcgaggttacattcagtcaaatcaagattggatgtgctagagttgatggaaattgggcaaacaaatagagcagttggatcgacagctctgaatgaaaggagcagtcgatctcacagcattctaactgtgcatgttagaggggtggatttgaagaatggatctacttccagaggatgtctacatctgattgatcttgctgggagtgaaagagtttgagcgatctgaagcaattggagatagattaaaagaagcacagtatattaacaaattcctctttgctctgggtgatgtgatttttgctttggcacataaaaatgctcatgttccttatcgaaacagcaagctgactcaagttctacagaactctttaag

SEQ ID NO: 76076 - DNA, 272 bp, Zea mays
  Clone ID: LIB3079-027-Q1-K1-H6
agttggccttgcagcatttggaacgtattatgtatatgctatagatcacaaggaacatgtctgcattatgtttgtctgggggtgcataatgtatcataatttgttttcacggtgtcaaaaggctagcttatctgtcaaaaaaaaaaaaaaaaagaacaaacaaactaacaaaaataataacaaaacataataaaagaaaagatttaaaaaaatggatctaattacaaaagatatatacatataaaaaaaagggcctcccatttaaagaatcc

SEQ ID NO: 76077 - DNA, 354 bp, Zea mays
  Clone ID: LIB3079-028-Q1-K1-A1
aaagcggcgcccatcaaacaccaacattaaaatcggtgctgaagagttgttaccgacgagagacaggcataactaaggtgctggggcggggcccaaatcaccgattaaagctaggtttttgtgtgacttgggaacacaacaccgcggaaccttcgtaaggacgctaagctatctgttcctcgaggaaattacctgtgaccatagaaatatgattaaagatcatatgcttattattatgttgttgttattgtacatcatatagtcgcgtacagttttgaaaggaacattagtcattagtttatattgtatacttgtaaaacttcctcacagggttgttttggttttcatttctac

SEQ ID NO: 76078 - DNA, 365 bp, Zea mays
  Clone ID: LIB3079-027-Q1-K1-F5
cccatctgcggatctgaccgcacataacaaaatcaaacatggaaagacaaaccggaggagcaatcaaacaaaaaaagaaacaagaaacaaacaaacacatcaaaatacgtagaccaaccaaaagacgcaaaaacatgaagagatacacatacacacaagtggacgcccattctaaggagccaacataacgccacggacgcagtgctctaccactacatgaactggcgcagcaaattctactccaaggtcaccctttatcaagtcaaggatctgaaaaacccccaggtgaccaaactaaatgccttaccagacttaccagttcataggcctgagtatggcactcacaagggcacgacacacacctt

SEQ ID NO: 76079 - DNA, 393 bp, Zea mays
  Clone ID: LIB3079-022-Q1-K1-F8
ggggagctcaagtcctggtccttctaccgcgcgggcatcgccgagttcgtggccacgttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccatctgtgactttcgggctgttcttagccaggaagctgtccctgactagggccctcttctacatcatcatgcaatgcctgggtgccatctgtggagctggagtggtgaagggcttccagcagggactttacatgggcaacggtggtggcgccaatgttgtcgcacctggctacacc

SEQ ID NO: 76080 - DNA, 112 bp, Zea mays
  Clone ID: LIB3079-022-Q1-K1-F9
aaaaaaaaaaaaaaaaaaaaaaaaaaaaaaaaaataaaaaaaaaaaaaaggagaaaagaaaaaaataatataaaaaaaaaaaaaaaaaatagggggcggcctttctatatca

SEQ ID NO: 76081 - DNA, 395 bp, Zea mays
  unsure at all n locations
  Clone ID: LIB3079-022-Q1-K1-G10
gtcgtcagcagcttctgcttgctctggggggaaggagagagagagagcgggagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggtcacctcgcctactcccacaccaaccatgcgctccttccgcccaggtcgttcgcggccaaggacgaggtgttctgcctgttcgagggggtgctggacaacctgngtcgtctgagccagcagcacgggctgtcaagcaaggg

SEQ ID NO: 76082 - DNA, 324 bp, Zea mays
  Clone ID: LIB3079-022-Q1-K1-G11
cagaggctgacaatcctcataatgtcaaaaaccctcacatcggatggatgataggggttctcttccttgtcagtttcattggcctatttgctcttgtgcctctgagaaaggttatgatcgtcgactacaaacttacgtatcctagtggcacggcgactgcttatctcatcaacggtttccacacgccagagggtgccaagcttgcaaagaaacaagtgaagactctggggaaattcttcttgatgagcttcctctggggcttcttccagtggttctacactggtggagataattgtggattccagaacttccctacattaggcc

SEQ ID NO: 76083 - DNA, 151 bp, Zea mays
  unsure at all n locations
  Clone ID: LIB3079-022-Q1-K1-G2
gcgaagaaatcttcaagtcattggcccgtgttacgacttttcatcgacccgccggctgtaggccttggcgtctctggagtctggaagctnttttcttctcgccttcgacttcgtcatggccggcggcaacctgttcgggcgggcgctgagc

SEQ ID NO: 76084 - DNA, 225 bp, Zea mays
  Clone ID: LIB3079-022-Q1-K1-G3
cgccacgccttcggccaatcgttcggccacgcgttccgaaagaatgcattctttgcccggtttctgaataccctttgtactcaaccctcataactcttcatgggggaactcttgtcccctattaacttaatgaaaaaaccgggtgggggttggagaactctgatcttaaaaagcaactggaaaatgctcggtcaaaaagcattgatggtaaggccctggtgggta

SEQ ID NO: 76085 - DNA, 392 bp, Zea mays
  unsure at all n locations
  Clone ID: LIB3079-022-Q1-K1-G4
nncggcctaaaggatatgggtttcgtgatttttggagatctgaatgnagcagcacgtgctaggaccgagagaaatgggatggatggtatctacaaagaaaaatgaggattgggctgcagctagcaagaagaatacagatgctcagcagacatatgcaactaatggtgcataccagagttctcaaggcaattgttcagagaatgatcccaacaatacaacagtctttgtgggtgggttagattccaatgtagacgaggagtatctaaggcaaatttttactccgtacggagaaatttcctatgtgaagattcctgtaggcaagcattgtggatttgttcaatttaccagcangtcatgtgctgaggaagccatccaaatgctgaatgggagtc

SEQ ID NO: 76086 - DNA, 326 bp, Zea mays
  unsure at all n locations
  Clone ID: LIB3079-022-Q1-K1-G5
ccaagacgtggccggaggacctgctgccgctccgccccgtggggaggctggtgctggacaggaacgtggacaacttcttcaacgagaacgagcagctggcgttcggcccggngctggtggtgccagtgatctactactcggacgacaagatgctgcagtgccgggtgttcgcctacgccgacacgcagcgctacaggctgggtcccaactacctgatgctgcccgtcaacgcgccgcgctgcgcgcaccacaacaaccactacgacggcgccatgaacttcatgcaccgtgacgaggaggtggactactacccgtccaggcacgcg

SEQ ID NO: 76087 - DNA, 309 bp, Zea mays
  unsure at all n locations
  Clone ID: LIB3079-022-Q1-K1-G6
aggggctgtacatgggcaacggcggcggcgccaacgtcgtggcgcccggctacccggagggcgacggcctatgcgccgagatcgtcngcaccttcatcctcgtctacaccgtcttcttccgcaccgacgccaagaggaacgccagggactcccatgtgccgatcctcggccctcttccaatcgggtttgccgtgttcctcgtccacctggccaccatccctatcaccggcaccggcatcaaccccgcgcggagccttggcgccgncgtaatttacaaccagcaccatgcgtgggctgaccactggatct

SEQ ID NO: 76088 - DNA, 400 bp, Zea mays
  Clone ID: LIB3079-022-Q1-K1-G7
accgcagcggggcctacgtcgcgaggcaggctgccaagagcatcgtcggggccggcgtcgcccgccgcgccattgtccaggtctcctacgccatcggcgtgcccgagcccctttcggtgttcgtggacacgtacggcaccggcgcgatccccgacaaggagatcctgaagatcgtgaaggagaacttcgacttcaggcccggcatgatcatcatcaacctcgacctcaagaaaggcggcaacgggcgctacctcaagacggcggcctacgggcactttgggagggacgaccccgacttcacctgggaggtggtgaagcccctcaaggcggagaagccgtcttctgcatgaggcgcctcctctgttttggaagaagcttttggtctggtctggtctggtct

SEQ ID NO: 76089 - DNA, 320 bp, Zea mays
  Clone ID: LIB3079-022-Q1-K1-G8
tgctacatagggcattcatgtgttccttttcaactcaaaatatgagctggtacttgagcaaatgtccgcgacaaaggttacctttcctttagtttggaccaatacctgctgcagccaccctctgtaccgtgagtctgagcttatccaggagaactaccttggtgtgagaaatgcaacacagaggaagctactggatgagctgggcatcccagcagaagatgccccagttgaccaattcacccctctgggccgaatgctttacaaggcaccatctgacgggaaatggggggagcatgagcttgactacctgctgttcatcg

SEQ ID NO: 76090 - DNA, 102 bp, Zea mays
  Clone ID: LIB3079-022-Q1-K1-H1
gcggccactccttccgcaccccaatttcgcccaaccaccggcgccggcgccccttgcttgggccgtgcgtccggtggacttcaaagtcctcaaaaaaggacc

SEQ ID NO: 76091 - DNA, 371 bp, Zea mays
  Clone ID: LIB3079-022-Q1-K1-H10
cccactcgtccggccccgcgccctcatcgtctcctcccggcctcccctcagacccgccgccgctgcccccacgccacccaccccaccccgcccccgcccctaccgcgcggtgcccgagacccagaggccagacccctttcttcaccttccttcccatcgcaatcgcaagcccccggctccggcgctcggcggtcggccaggttcgggagatcacttcgtcgcggcgaggagggagggggtcgccgctagcgcgcggcacttggatgagaagggcaacggtggaagaggatgcggaaggcgtacagggactccatcaaggtgctcgaagctgacatccaacacgccaacaccctggcctccgagttttcccg

SEQ ID NO: 76092 - DNA, 385 bp, Zea mays
  Clone ID: LIB3079-022-Q1-K1-H11
tcacgtggacccgttcctcgtctaggctctcgacaaccctcgccaccgggggatggggctacggatggaactggatatacaaaactttatgcagaaccctcagctgcaggagtttgaattccagaactttccgacttcttacctccgctgtgctgctcatcgtgttgcacaacattatggcttagagactatagtagcagatagtttagtagaaggctcagttagcaggattgttgcaagaaaaacagcagaaagcaggtatcctgcaatttttttatcagaagttcctagcaatcaagcaagaaatgatcatgaaacagctgagaagcttaagtttgtcatttatcaaaggcccaaagcattccaaaatggaagcgctgattct

SEQ ID NO: 76093 - DNA, 408 bp, Zea mays
  unsure at all n locations
  Clone ID: LIB3079-022-Q1-K1-H12
cccacgcgtccgcccacgcgtccgaatataggaaaagcctaaacttggcagaaaagagagtctgaaggttctcctctcctcnaggtatgtgagggatctagctaccctagtggttgcttatggcattagtatcaatcttgtcgaagtcacgtggaaatcaaaactcaaggcacagttccctagtccaaatgaatattcatctttcatgggtgatttctcgactgcaactggaattgcaactttcacaatgatgctgttaggccgtattatactacggaaatttggctggggtgtggctgcaaagatcacccccaccgttctgttgctgactggtgttggattcttctctctgattttgtttggacagccactgactcctatgcttgccactatgggtatgacccccct

SEQ ID NO: 76094 - DNA, 92 bp, Zea mays
  Clone ID: LIB3079-022-Q1-K1-H2
ccacgcgttcggttggcttcttctcccccttcggttcgggttccggttcctgaaggtgttcggggttccggtttgtgggtgaaccgatccaa

SEQ ID NO: 76095 - DNA, 356 bp, Zea mays
  Clone ID: LIB3079-022-Q1-K1-H4
gccggtgacgctggatctcggtggcaagtcccctttcatcgtcatggacgacgccggcgtcgaccaggccgtcgagctcgcgcaccaggcggtcttcttcaaccagggccaatgctgctgcgccgggtcgcggacgttcgtgcacgagcgcgtgtacgacgagttcgtggagaagtccaaggcccgcgccctgaagcgcgtcgtcggcgaccccttcatggacggtgtcgaacaggggcctcagatcgacggcgagcaattcaacaagatcttgcggtacgtccagtccggcgtcgacagcggtgccaccctcgtcgccggcggcgacagggtaggcgacaggtgcttctacatac

SEQ ID NO: 76096 - DNA, 389 bp, Zea mays
  Clone ID: LIB3079-022-Q1-K1-F7
ctgtgatttccacaatcaaccgatcaatgcgagcatatgccactgcaataggtgcggctgagtatatcctcagatggcttcctagaggcacacatgagtggtccaaactggttaccccggaggagcttgtcctaatgctgcaaaaggcttccgtctccgtcgaagagatggcagggttcgtttacaatccgttgagtggagaatggtccctgtcagatgatatcagtgtgaactacattgcttttggcgtcaagaagggtgaagcatcatcgacaaatggcagagatgcaagtttatcatagctgaagaaaaacacgtgaccttgaattgtcgggcatcattttcagaggaccaattcatgtcactgaaatcttactgctaaggatgca

SEQ ID NO: 76097 - DNA, 367 bp, Zea mays
  Clone ID: LIB3079-022-Q1-K1-H5
gcttaacaaaacagcccctcgaaccatggttgttttgcgtcctctaaaggtggtaagaactaacttggaagaaggaaaagtactagaccttgatgggaaaatgtggccagatgcttctgatactgatgcttcctctcactataagcttccgttctcaagaactgtctacattgagaaaactgattttcgccttaaggactcaaaagactactatgggctggcccctggtaaatctgtcatgctaaggtatgcgttccccataaaatgcacagacgttatctatggtgatactcctgatgatattgttgaaattcgagcagaatatgatcctttgaagacttctaaacttaagggtgttctgcactgg

SEQ ID NO: 76098 - DNA, 396 bp, Zea mays
  Clone ID: LIB3079-022-Q1-K1-H6
ctctgcattttttaagattcaaaaaaacattccttattttatacgcggtaaaacaacgagccttgataattcaccggatcttcttagtattatctctgacaaaaaaatataaagtctgtccccacaaatgcaaattagtttcttgattttcaattggttgttaaatgtctgacatgagcaatcagtttggttagcataaaaggatggtgattttgacaactacacagtttgtaggaacaacaataaaaacacttcattatatattagggctctatgatgttcaccattcatggcttcctaccagatcacacattgcataaatcaagttctacgctattggttacttttcagagattcagacagaacatttatattcttgttcctggattgagcata

SEQ ID NO: 76099 - DNA, 390 bp, Zea mays
  Clone ID: LIB3079-022-Q1-K1-H7
aaaaaaaaaaaaaaaaaaaaaaaaaaaaaaaaaaaaaaaaaaaaaaaaaaggaaaaaagaaaaaaaaaaaaaaaaaaaaaaaaaaaaaaaaataaaaaaaaaaaaaaaaaaaaaaaaacttaaaaaaaaaaaaaaaaaaaaaaaatcttgattttccagtcttaatttaaataaattacaataagcaataacataaaataacataaaaaaaatggatattttaacaaatacacattttgaacgaacaacatttaaaaaactaaaattatataaaaacctacatatgataattcacaattcatgtttttaaacatatatcacacattgtttacattaaaaaatacactattgcctactttttaaacattcacacaaaacatttatatttta

SEQ ID NO: 76100 - DNA, 299 bp, Zea mays
  unsure at all n locations
  Clone ID: LIB3079-022-Q1-K1-D6
ctgatgcactcactcccagaacaagatcatcagctccaggagaacatcaaggtccatggcatcgacggcactttgcacgatgatcatcantactgcggccatttggatcagctcggttcttcttcgtcgtcaaggttccggcggcttccagtgatgtgttcgccacagaacgagcagcacctgctgcaggagcaaacacttaacaacaatgctcgtcctccagagaagaggcagcgggttccgtcggcgtataacagattcatcaaggaagagatacgcangatcaaagcgaacaaccc

SEQ ID NO: 76101 - DNA, 388 bp, Zea mays
  Clone ID: LIB3079-022-Q1-K1-D8
cccacgcgttcgcttctacttcatcagcagccgcccttctagatcaaaggggactagctactccttcatacgacataatatctctattatagcaccaactaaaaacaaactactggccgttttacaacaacgtgactactaaaaaaaccctgtcaccaaacaaattaatcttgtagcacatcatccttttttcagctgctgtcataacaaagaagacgccaccaatgatcgttcttaacaacagctgagcatgcttaatgaataatacgacccgcgctgcagcgcatcattaaccgcgggtgttgtggttactaccagcagaatcaccactatagtcagcagcgtactagcgcccgcttcttctgctttccttcccttctttgtcacc

SEQ ID NO: 76102 - DNA, 377 bp, Zea mays
  Clone ID: LIB3079-022-Q1-K1-D9
cgaacgccggagctcgacatggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaagagggccgaggcaatgaggaccgagtaacactcatcaaggattatcgtggcaagattgagactgagc

SEQ ID NO: 76103 - DNA, 241 bp, Zea mays
  Clone ID: LIB3079-022-Q1-K1-E10
cccacgcgtccggcccatggctcgtgctcgccccgcgacccgcgaaagaggtgtgcgggttcgctcgctcgctcgcgcctcgccgactcgtgggggtgccaattaactgcgcggggcaggccggcgggtggctgctctactacgcgcttgtggaagaggagatccagggctccgagttcatctacatggtcgacgacccggccgtctccagcgtgatactggggtttgatgctcccaggaa

SEQ ID NO: 76104 - DNA, 381 bp, Zea mays
  unsure at all n locations
  Clone ID: LIB3079-022-Q1-K1-E11
gcaacaaggcagcagcacatgcaagaaccacacctcctcccttcgcctgtgatcatgtcntcttgctgcggcggcaagtgcggttgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagctggcccggcccggcgatggcgcacgagagtcgagaggaggaggacgactacgaggcgtataaatataatagcg

SEQ ID NO: 76105 - DNA, 381 bp, Zea mays
  Clone ID: LIB3079-022-Q1-K1-E12
tcccactcgtccgcccacgcttccggtctatgtgggatccccatctccaagaaaggtggtgctttcagaaaatttgttgcatgctgctgtacggaggaagtctgttaacatggttagatttctgctgagatacagaccaaacaaaaactccaaggggactgcacagacatacttatttatacctgatgctctgggcccgtcaatgattacccccctccatatagcagctgccactagtgatgcagaggatgtgttggatgtgctgaccgatgatcctggactgattggaattagtgcttggagcaatgcacgggacggaacatgttttaccccataagattatgctcggcagagaggcaatgatgcttacctgaatctggt

SEQ ID NO: 76106 - DNA, 213 bp, Zea mays
  Clone ID: LIB3079-022-Q1-K1-E2
tcggcatatactgggtggcagccccttaaaagagcctgtcacttccataccatggagggtgattcgatcaaaagctccagtgtgggctctcataatatcacatttttggcataactggggaacatttattctggtaacatggatgcccacatactacaatcaaggtctgaaggtcaatctaaccgaatccgggcttctttttgtcttggcatt

SEQ ID NO: 76107 - DNA, 374 bp, Zea mays
  Clone ID: LIB3079-022-Q1-K1-E4
cccacccgtccgattacctgcctatacagactaacaggagttgttttcgtaaaacgcgtgggaatctacaaagattgtactctgtgctgtattgctgtggaatgctctacccctgtaacagtgtctaaggtaactgcttttgcccatgttttagggcttcaagagataatggtaattccttgtctattgttgtgatgatcctaattttatccttacagtgctcatctttgtcttgcagaaggaggagccctttcccatccccgagaaggcgtgagagctgttctccatctcctaggaggcgcaatagtccacctccatcacggaagcgttacagaagaaagagcagtccgagtgtcattagctctccagttact

SEQ ID NO: 76108 - DNA, 336 bp, Zea mays
  Clone ID: LIB3079-022-Q1-K1-E5
cccacgcgtccgcccacgcgtccgcagtccctgagtgcccgatacctggagaaagtgggaaagaagtcaaacatgacaatactgttacatggttggccttttggaacgatccaattaacccaaaggatttcaagtatgttttcctggcagcaagcagctcactgaaggggcaaagtgacaaagagaagtatgagaagtccagaaaattgaagggtcatatacaaagaattcgtgagaattatacaaaagatttcaaaaacaaagatgtgacgaggaggcaaatagctgtggcaacataccttatcgataaactagcccttatggctggcaatgaaa

SEQ ID NO: 76109 - DNA, 160 bp, Zea mays
  Clone ID: LIB3079-022-Q1-K1-E6
gcgccgcgagccacagctagcaccaccaccttgcaccgcacccgcaccgagacgaacagatcgaccatggctgccggcggcgacgacaccaccatcgcgcaggtccacagcggcatcgacagcagcaacaagacgctgctcaagaagcgaggccctctac

SEQ ID NO: 76110 - DNA, 337 bp, Zea mays
  Clone ID: LIB3079-022-Q1-K1-E7
cgcctacctctgcgggctgggcatcggggacgacggcgtgaaggagataggtgggcgccgcgtcgcctgcgccaagctgaaagccatcaccgaagcggagctcaactacccgtcgctggtggtgaaacttctgtcccatcccatcaccgtccgccgcaccgtgaccaacgtcgggaaagccaactcggtgtacaaggccgtggtggacattcccagggccgtgtccgtggtggtgcggcccccggtgctgcggttcgccagggcgaacgaaaagcagagcttcaccgtgacggtgcggtggaacgggccgccggccgtcgccggcgccgatgggaac

SEQ ID NO: 76111 - DNA, 294 bp, Zea mays
  Clone ID: LIB3079-022-Q1-K1-E8
aatggccccatccacccactcattctctcctacattccacaactctatatacctcactacccacaccctccataagaacagttatttatcctaacccaaacataatccataacactatcactacattactaactctaatccacataaaaacaataactacatcattcacattacgaatctcattaacaaaataacacacacccacttccttctacaaaaccacaacttacatccccactaattaaacacttattcttctacatcctatactaatattttaaacacccaaaaata

SEQ ID NO: 76112 - DNA, 401 bp, Zea mays
  Clone ID: LIB3079-022-Q1-K1-E9
aggatttgttcactgccagaaaaagtgcaatcaatttacttggtgttatagcgctagcaaagggtccaccagttgcatctgcagcatcaaagcgtaagaaaggtgataaaaataaagggaaatctgaaatgagctcaattggggagttattggtcatcccattcctgtcaaagtttcctataccttctcatggtgaggatgcatcatcagtagcagtgcagaattatttcggtgttttgatggcatatggaggcctccaagattttctgactggaaagaaagatttgacaattacattgatcaggaaccggattctcccattatattctttggatccttgcagcatgcagcccatatttgatttcaacggctaattgggttattggtcagcttgcgatatg

SEQ ID NO: 76113 - DNA, 93 bp, Zea mays
  Clone ID: LIB3079-022-Q1-K1-F10
aaaaaaaaaaaaaaaaaaaataaaaaataaaaaaaaaaaaaaaaaaaaaaagaaaaaggaaaaaataaaatataaaaaaaaccaacattacta

SEQ ID NO: 76114 - DNA, 396 bp, Zea mays
  Clone ID: LIB3079-022-Q1-K1-D11
tgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactatgtgggttccaatttgttcttacacatctggacaacaggcagcttctcatcaaatcagaccctggtgaagttgttaaacctgaccaattcaaggcgattaatgatgaggggatgccaatttaccagaggcctttcatgaaggggaagctgtacatccatttcacggtggagttccctgactcgttggcaccagagcagtgcaaggctctcgagacagtact

SEQ ID NO: 76115 - DNA, 249 bp, Zea mays
  unsure at all n locations
  Clone ID: LIB3079-022-Q1-K1-F3
cctatgattcacatccctccctttgtgccctcgtagggacagttttttttttcttgagcatanaggagagctgtctatcattatattaaagaacatggttaggaaactttacacacacatttggttacaagatcacccttgaagccaaagataactaaacgaccttgactaacaggactttggttacttgtggtattagactgttatttggctgggtcataatccatattcttgcangatggattcatt

SEQ ID NO: 76116 - DNA, 72 bp, Zea mays
  Clone ID: LIB3079-022-Q1-K1-F5
aaaaaacatacaataatacaataacacttaaaattactacaaaaaaaaaaaaaaaaaagccaacggaaaaat

SEQ ID NO: 76117 - DNA, 405 bp, Zea mays
  Clone ID: LIB3079-022-Q1-K1-F6
gcgggtcgcgggatcaaggagccagagagcgggacgcagcgagcgttccgccagaggtcgagaccgtagctagggtttgaggcgccgggctgcggtggacgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatggaagcatctgtttggatatcctacagaaccagtggagtcctatatatga

SEQ ID NO: 76118 - DNA, 242 bp, Zea mays
  Clone ID: LIB3079-022-Q1-K1-A7
aaaaaaaaaaaaaaataaatataaaatttaataaaaaaaaaaaaaaaaaagaaaattgttaaatttaaaaaaaaaaaagggcatcccttctctttattccaaatttactttccctttcttgcaacaccataattctttttttttgccacctattttcaatttactttcccttattttacatcctcttcactttaaaaaccctttccttacccttcttattttccttccatttcttccccctt

SEQ ID NO: 76119 - DNA, 241 bp, Zea mays
  unsure at all n locations
  Clone ID: LIB3079-022-Q1-K1-A8
tcccgctcccccacggtactcatccgctagcctgcgattcctccntacgccaccgccacctagcgtggagtaccgcctccncccttctccnatatcttcatcggcgaacaaatcccaccacatcccgccccttccatggagtccgtcgttaaccctaatgcatacccgcttgctgatgcccaacttacaattgatatcctccatatcatccaacaggccccctactacaaacagcttaata

SEQ ID NO: 76120 - DNA, 316 bp, Zea mays
  unsure at all n locations
  Clone ID: LIB3079-022-Q1-K1-B1
atcttctcnaataggngcgtgaattgaaagtctcggagtggggtgaattactacccttgcctgtcaattatgtccctggtcatactgactccatttgctatagctatggaaggccctcaaatgtgggctgctggttggcaaaaggctcttgcagaagttggacccaatgttgtctggtggattgctgcacagagcgtgttctaccacttatataaccaggtgtcctacatgtctctcgatcagatttctccattgacattcagcattggctatacaatgaaacgtatatcacggattgtttcatcaatttatatct

SEQ ID NO: 76121 - DNA, 194 bp, Zea mays
  Clone ID: LIB3079-022-Q1-K1-B10
cccacgcgtccgagaagtttgagggcctctgcaaggtcatcaaggaggtgctgggcgacaaggtggagaaggtggtggtctccgaccgcgtggtggactccccctgctgcctggtgaccggcgagtacggttggaccgccaacatggagcggatcatgaaagcccaggcgctgagggactccagcatgtctggg

SEQ ID NO: 76122 - DNA, 280 bp, Zea mays
  unsure at all n locations
  Clone ID: LIB3079-022-Q1-K1-B12
ccgnttctaattcccgctctacccactcatcctcccacacgtccaantcaaactataatttttaaaattcctgtcnnccacaagaattttgttaattttaaaaaagactagggctccaacaancttaatnacttctcttaattactatctatcaaagaatttctctttaaccgtcatcttcacaaacctaatttaatttcatacaacaaaaaaaaaatttcctccctttttaaatttccaatttatattacccttccttccaacaacaaaaccttttttt

SEQ ID NO: 76123 - DNA, 263 bp, Zea mays
  Clone ID: LIB3079-022-Q1-K1-B2
gtggaatcgacatgatgccacctccgccttcgggcgctggtgctcatcgagagaaagatgacatgtccttcgatgaaaaatttgtgaagagcaaggaggtggatgcctttgaaccatcctcatcaaggaagagacctttcagcgacgtcaaccgaaaaggtgcaggtgctttacctaatggcagtgctacagaccagcatgatgagtccgaggatagtgatcagaagatatgatgctctgctctctgctctaatttttagctc

SEQ ID NO: 76124 - DNA, 301 bp, Zea mays
  unsure at all n locations
  Clone ID: LIB3079-022-Q1-K1-B3
ccccagtcctttaaaaacccttcttgctttttaaaaactacttctatacagtcntaagttatttaaaaagataacttaaacccctgacaaactcttcttccggctcaataaaatctacatgattccacctcctccttctctcactggttctcatctacataaagatgacatctccttctattacaaatttgttaccaccaatgaagtcaattcctttttaccatcctcatctattaacgacctttcatcgacgtcaaccgaaaaggttcatttgctttacctaatttcagtgctacatacc

SEQ ID NO: 76125 - DNA, 375 bp, Zea mays
  Clone ID: LIB3079-022-Q1-K1-B4
gcgcccaaacccaacctcatctctttttcttcggcctctaccgcccccctcgatcggtcgggcgggcagctatgacgccgggaagctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgcatctaccagctgaagttgttctgcgacaaggactaccctgagaagccaccatcagttcgatttcattcaagaataaacttaacatgcgttaatcatgaaactggag

SEQ ID NO: 76126 - DNA, 393 bp, Zea mays
  Clone ID: LIB3079-022-Q1-K1-B5
ttctttccgtccctccccaattccttttcccggtggaatcatatccatctgccccgcggtggggggccaccaaaacaatccggtgtacctgcacagcttcacggaggcggacgacgccctcaagctcaaccacattgtccactgctctctcgacgtcatcgacaagcgagtgagcaatcctaagaggagtgcacctacattgaatgagacatttcttggtcttctatacccaactgagaactacaaagtgtatggctatttgacaaacacaaaggtcaaatttatcatggccacgactgatcttgatgtcaaagatgcagatgccagaaattatttcaggaagttccatgctgcatatgtagatgccgtctcgaacccgctccatgtcccagg

SEQ ID NO: 76127 - DNA, 417 bp, Zea mays
  Clone ID: LIB3079-022-Q1-K1-B6
tcatatttaattgaaccacgaaatgtcaatacattatttgagaattcattatgctggtgcatcggaccagataatatcaactagtgttttgccttagcctgcaattagctttacttgttggtcctcatcatcattcatatttcatttcactaaaggaaatgataaggcagactgggattcctgcaatctttacggacttctgtgaagaagctgcacatctagcatcctgctgcataagctccataactggtcaaccccttaaaattccaatccaggtaaatcctttcaggcagccagttgcagcggaaaacaatgcattatacgtaccatgttattcaaattgctttgtttttgggatgtaaaattgccctgtcaccaggaagtatatttagagattgatttgtcaagaaatggaat

SEQ ID NO: 76128 - DNA, 394 bp, Zea mays
  Clone ID: LIB3079-022-Q1-K1-B8
atgagctacaattacagtccttcaccaccaaggggctacaggagaatgcgtcgcagggcaagtcctgatgatcattatggtattcgcagtatggatctcccaaccagtcttctggtcatgaatctccgtcgggactgcatgccacaatacctgcgtctcccatttggacagtttggtcgagctaaagatatatatcttccaagaaattattacacttgactcatcacaatcctaaaagattattgttgcagagaaggaagaaatagagaaattcaattaaatgatctgcaacttaaaagagttctcattactgctcaagacatgggaaaaaatatagttacaagtttaagagatactcacatcatgaagagtttcaagtctgaatttaaactct

SEQ ID NO: 76129 - DNA, 375 bp, Zea mays
  Clone ID: LIB3079-022-Q1-K1-B9
gcgagcgagggacccggggcggaagaagagagagaagacgtctctctcggctcggggtccccgttccccaacctctcgtctgctgcctgcctgcctgcctgcctgcaaaaaggagtttgtcatggcgtctaagcgcatcctcaaggagctgaaggacctgcagaaggacccccccacatcatgcagtgcaagtcctgctggtgaggacatgtttcattggcaagcaacaattatgggaccacctgacagtccctatgctggtggtgtttttttagtgaacattcatttcccgccagattaccccttcaaacctccaaaggtttctttcaagacaaaggtcttccatcctaatatcaacagcaatggaagtatatg

SEQ ID NO: 76130 - DNA, 207 bp, Zea mays
  unsure at all n locations
  Clone ID: LIB3079-022-Q1-K1-C1
cggccaactaaaatccccattttctcgttttggatcattcccctgtttattggcctgggtgatcgattgtcctcaatagtttcaacattcnagtaactgttgcgggaggtgccatggaagcattggaattcttaaatgcgaacaacagtcatgttgaccttattttgactgactactgcatgcctgatatgactggctatgatttgc

SEQ ID NO: 76131 - DNA, 371 bp, Zea mays
  Clone ID: LIB3079-022-Q1-K1-C11
agcgcatcatcgcagagtaggacagccatggcgacggcggcggcgcagtgccatcgggcatctatggacgcgcgccggtgggacgagtcatcgtaccgccgcggcatcctccgtgcccgcgacctctcgtcccgcaccctcttccgtgccgtcttctttgaccacagcgacgacccggataccgacatcctactcgccgccgcctccagcgacggctccctcgcttccttctccctttcatcctgcatctccgcatgttccgctacctcccaggtggagaccgccgccactctggtagatcctgtctgcatcgtgcaagcgcacagcggacctgcctacgacgtcaggttttaccccgatcaacagcagcc

SEQ ID NO: 76132 - DNA, 348 bp, Zea mays
  Clone ID: LIB3079-022-Q1-K1-C12
tcccactcgtccgaaaaaaaataaaaaattaaaaacaaaaaaaaaaacaagagaaaaaggaaaaaaaaaaaaaaaaaaaaggaaaaaaaaaaaataaaggggggccgcctttttagatcctccattcttaccccccccttcctacgacttaatccttcttttttttccccacctaaaattttactacccgccttcttttaacaacctgacttctaaaaaaatcctttccttccccaaattaatctttttgcaaatcctccttttttcacctattgcaataacaaaaaagccccccccacctttctcccttaccaatttttccccctccctaattaataatgcgccccc

SEQ ID NO: 76133 - DNA, 294 bp, Zea mays
  Clone ID: LIB3079-022-Q1-K1-A5
agtgctgaccagaatcaagttatgcgcgaacctgtacgatcgattgttgcgaaccggctgccccatacgtggatggcaaatgatctcgcggagctggcccagaaattcaggtcgcgagtgtatgctttcatagaggagaaacccttgacaagcgacggtaccaatctgggcgcttctaataagagatgagatacccaggactggcgcagcctgaggtagcttgggtagtaatatggaaagcatattgctagcggctcgacaagtttagtttcttttttttcccttactgacact

SEQ ID NO: 76134 - DNA, 251 bp, Zea mays
  unsure at all n locations
  Clone ID: LIB3079-022-Q1-K1-C5
gctcaaggagatcaggtccttcttctacaacatcacataccgccgccgcatcgcatatgacaatgaagagcgccagaggtttgctgagaagatcattgtcctgctactgacagttgatgcccttgagggaccggactacatggtccgcaacgcaaggaggtccatgctggangagctggaggggatgctggagatcgtggagcctcagccgccggggaagccgaggacgcttagccgcaggaggttcgatc

SEQ ID NO: 76135 - DNA, 88 bp, Zea mays
  Clone ID: LIB3079-022-Q1-K1-C6
cgaatgaattgttattgaatcatgcgtggaagtgtaatattgcaagaaattgtttggagtcgggggatttaaaaaggtgagagggatt

SEQ ID NO: 76136 - DNA, 361 bp, Zea mays
  Clone ID: LIB3079-022-Q1-K1-C8
tggcatccgcagagagcttgttccgtccaggcaaccaaaaagcaagttgggcggcggcgcataggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcatgacttcaagacagacctccggttccagagccacgccgtgctggcgc

SEQ ID NO: 76137 - DNA, 287 bp, Zea mays
  Clone ID: LIB3079-022-Q1-K1-C9
actactcttactcaattgaagctggtgttggtgctggaattgacatgatgatggggccattcagatacacagaattcatcgacgatctgacgacacaagttcagaacaaggtcatccccatgagcagaatcgacgacgccgtctacaggatccttcgtgtcaagttcaccatgggtctgttcgagaacccttaccccgactctagcctcgccggcgagctcgggaagcaagaacaccgggaactggcgcgcgaagccgtcaggaaatcccttgttctcctgaagaac

SEQ ID NO: 76138 - DNA, 152 bp, Zea mays
  Clone ID: LIB3079-022-Q1-K1-D1
aaaaacaaaaaaagcggaatacatagagaggatcgtcggacagaacagcatgaaggtggccagcgttctcgccgtgcgcctggctctgtcagctgccatctcctgtgcaatgcatataccctgcccctgcgcggtgctcaacggcttgtacg

SEQ ID NO: 76139 - DNA, 440 bp, Zea mays
  unsure at all n locations
  Clone ID: LIB3079-013-Q1-K1-D3
cggcaagatccccgacccggagtccaccgacaacgctgagttcaagatcgtgctcaggatgatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctncaggctctgatggagggtcttc

SEQ ID NO: 76140 - DNA, 443 bp, Zea mays
  unsure at all n locations
  Clone ID: LIB3079-013-Q1-K1-D5
cccacgcgtccgcccacgcgtccgatcagaggaagctgcgaaagctctatctgagctgattcctgcaactgagaagcttaaggttctccacttccacaacaacatgacgggagatgaaggtgctatgtatattgctgagatggttaagcgttctccgaatgtagagagtttcaggtgctcagcaacaaggataggatctgatggtggagtcgcattgtctgaggcattagggacatgcactcgcctgaagaaacttgatctcagggacaacttgtttggtgttgatgcagggttagctctcagcaaaacccttccaaagcttcctgatcttgttgagctttatctcagtgatctcaatctagaaaacaagggtactatagcaattgccaaagccctcgaacagtcagcaccacagttggaggtccttgaaatngctggaaatg

SEQ ID NO: 76141 - DNA, 440 bp, Zea mays
  Clone ID: LIB3079-013-Q1-K1-D6
gcaacacttgtgggattccttcggcacattggtggagccacttgctagcaaccggcgttggatggtgacagaaggcaaccatgagaaggagcacattccattttttgagtcaggatttcaatcttataatgcacgatggaaaatgccttatgaagagagcggatctagatcaaatttgtactactcttttgaagttgctggtgcacacatcataatgctaggttcatacacagattatgatgatagctcagatcagtatgcttggctaaaggctgatcttgccaaggttgatagaaagaggacaccctggctcattgtgttgttgcacgtaccatggtacaatagcaattgggctcatcagggtgaaggcgacagtatgatggcttcaatggagcctttgctgtacgctgctcatgtggatatggtaatagcaggtcatg

SEQ ID NO: 76142 - DNA, 441 bp, Zea mays
  Clone ID: LIB3079-013-Q1-K1-D7
gcgacacttgtgggattccttctgcttattggtggagccacttgctagcaacgcgcgttgtattttgacagaaggcaaccatgataaggagcacattccattttttgagtcaggatttcaatcttataatgcacgatggaaaatgccttatgaagagagcggatctagatcaaatttgtactactcttttgaagttgctggtgcacacatcataatgctaggttcatacacagattatgatgatagctcagatcagtatgcttggctaaaggctgatcttgccaaggctgatagaaagaggacaccctggctcattgtgttgttgcacgtaccatggtacaatatcaattggtctcatcaaggtgaaggcgacagtttgatggcttcaatggagcctttgctgtacgctgctcatgtggatatggtaataacatgtcatgt

SEQ ID NO: 76143 - DNA, 443 bp, Zea mays
  Clone ID: LIB3079-013-Q1-K1-D8
caggtgacattaatgttttcgctcagatgattgacgacgcggaaggcctggaaaaagtcgagaacctacagagccatgataataatgaaatctatgaaaaggctgtgaagcttcttgagacttactggatggaggaggaagatgatgcaatggctactgctggggaagctgctcctgctgtttttgactttagccaaggtggcaaccctcctggtggtggtttgaacctcaactgaatacagtatttgaccaaaagggtgttaattccctcatgacaacctagtctggtcgattccatgtgggataatggtttgtggttggtccagtaaattcgagatttcaagggagatgggttagcattattcccaagctgtcatggatatcagtatcgcagggtctgtaacaggaccataatcgtcgaacatgagtctgggtttttgagc

SEQ ID NO: 76144 - DNA, 391 bp, Zea mays
  Clone ID: LIB3079-013-Q1-K1-D9
agaaaacctaaccaatgtccatgcctacaccaaggctcttttcagccgtgaatctttggtcaagactaagccatccgaggagcacgtgattgcgggatgggcgcccaaggtgaatgcataagagccttgtgctttggtgctacctggtggactccatccatttatcttatcagtctttgtcagtggtgtggataggtgtcaagtctgtagcctagatgcatgattcagttggaattatgcagtgccgtgtctcgagtactcagttctggctgttgcggttgtgcatcttaccttctgttgctggttttgtttgaggccatgggcatctcttggtcctatgctgtgagagcgctgtaatgtgggtaccaaataatggagctgcttttatgct

SEQ ID NO: 76145 - DNA, 439 bp, Zea mays
  Clone ID: LIB3079-013-Q1-K1-E1
cccacgcgtccgaaaatgttgtatgaggaattcgttcaacgcttggaattcaacaaggggaaggtggcaggagaggttaagtgccacaagtacagccggcgcaagccagacaatggatggagctacatggtcgaaaagcttggtcctcagggaaagcgtggtggaggagggggctggaagttcatcagcttgcctgatggatcaagccgtccactaaatgatatggagaagatgtatgttaagcgggagactccaaaacggcggcggaggataattgcaccatacaagtgacatggacaacttcagtttgctgaaatgcaaattttctcaactgtcttttgacattgtccagcgaggctgaagcaagaaactgtgaagtagtttggaaccgccagaacagctcctgtttttttcacagcacagtagatggtttgatgtg

SEQ ID NO: 76146 - DNA, 366 bp, Zea mays
  Clone ID: LIB3079-013-Q1-K1-E11
cttcgttggcggcctcgcctgggccaccgacgaccactccctcaacaacgccttcagcgacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaagctacggcggtggtcgtggaggctacggcggcggtgggggatacggtggtgcaaacc

SEQ ID NO: 76147 - DNA, 411 bp, Zea mays
  Clone ID: LIB3079-013-Q1-K1-E2
aaaaatgcttgttggaaacaaagttgacaaggatgatgaaagaatggtcacaaaagaggaaggtcttgcttttgctgaagaatatggatgtctgtttcttgagagcagtgcaaaaacacgagaaaacgttgagaaatgttttgaggaacttgcattgaagattcttgaggtgcctagtctcctagaggaagggtcttcttcggttgtcaagaggaacatcctgaaacagaagcaggaaagtgatgcaaagaacggtagtggatgctgtcaatagatgtatgtgctgatccacaccacacggttggctttcttcgtgtgagctgccctgattgtctgctgtacatgttcttgtgagtaagaagggcgagcataattgatttgtacaaaaaaaaaataaattataattattat

SEQ ID NO: 76148 - DNA, 444 bp, Zea mays
  Clone ID: LIB3079-013-Q1-K1-E3
cgaagccgatgccggtctccgatgagttccgcaggttcgccggcggcgcgcccgagggcggacgctccgaggccatcaagctcatctgggcccacatcaaggcccacggcctccagaacccagccaagaaaacggagatcaactgcgacgccacgctcaaaagcttgtttggcgggagggacaaggttgggatgctggagatcaacaggctactgaacgctcacttcccgaagaactagcaagcagcagtccgtggtgccagtgatcgcgctttggtaaaggactttcttgtggctggcctcttgtggtccatgtgaagtcccaagtcccactaggtggttacacccgaaaaccatgtgatgccattaagacttacagactttgttcagcagttgggtttttgggcgtgatgcatgtaaaaaggatccccagtgtttccgtttc

SEQ ID NO: 76149 - DNA, 449 bp, Zea mays
  Clone ID: LIB3079-013-Q1-K1-E4
cgcacgcgtccgcccacgcgtccgcccacgcgtccgatggcaagcgcctagctacagtgctgctctgataatacaataaagatcattggcgtaagtggaacctcacaccagcagcttgcaactttgagtggacaccagggcccagtatggcaagtcgcatgggctcatcccaagtttggttccatgcttgcatcctgcagctacgacggccgagtgatcatctggaaggaaggaagcaagcctgatgaatgggcactggtacacacctttgctgagcacaagtcctccgtgaattccatcgcgtgggcgcctcatgagctgggtctatgcttggcttgtggttcatcagatgggaacatttcagtcttcactgctcgttctgatggaggttgggataccacgcgtattgatcaggcgcatccggttggtgtgacctcagtttcttgggc

SEQ ID NO: 76150 - DNA, 281 bp, Zea mays
  Clone ID: LIB3079-013-Q1-K1-E5
gcttgtagcagtgatcgtgtaaacgtgtattctgtctgttgttcttggctttgtcagctgcaatatgttttggaattaaaatatactactactactactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaagaaaggcaaacaaaaaggaacccaaatttaatccacacggacttggaaa

SEQ ID NO: 76151 - DNA, 299 bp, Zea mays
  Clone ID: LIB3079-013-Q1-K1-E6
cgcacgcgtccgtttgtcgcgaagggggtggccaggaacttcctccttgagcgatgggacagtttgagggacgaattctacacggtttacttcaacgtcagggtctgagtcctgacgcttacacttgcagtagaagtaatacagaataaataatgtgcgcgacctttttcttctcatacactgtagcttagaacagccaatgaagaagcaattgggttgtttgaacttgttatgcacgcgggagtattcactttgtgtgaaaccacttgttatgcaataccaaacgagtcctggctgct

SEQ ID NO: 76152 - DNA, 444 bp, Zea mays
  Clone ID: LIB3079-013-Q1-K1-E7
cgcaggaggcggcggcggcgggagggtctcggcgctcgagacgggcaccaagctctggatctccaacctggactttggggtttcgaacgacgatatcaaggagctgttctctgagctaggtgatctgaagcgtttttcgataatatatgatcgaagtgggaggtctaagggaacagctgaagttgtatttgcaaggcgttctgatgctgtagcggcggtgaagaaatataacaatgtccaacttgatggtaagcccatgaagatagagatagttgggaccaatactccaactgcatctgctgctcttccagtctccaatggtggccatgctaggaatgctgtgaggagtgcaccgaggggtgctgccccagcaggtgtgccgcagcgaagacctcatcagaggggtgggaggcgtagtggtggatctgggggtggtcgtcgtgg

SEQ ID NO: 76153 - DNA, 445 bp, Zea mays
  unsure at all n locations
  Clone ID: LIB3079-013-Q1-K1-D2
gcccagcttgctctctctgctcttccccctcacacttctccctcgctcatcactcatggtcgcacagtcacactacagagcccagagccctagtgtcctcccctcccctccccatggcccctcaccgcctcctccagcttctactgctcctcgccgccgccatgaccaccgcccggtcccagacccagtcaccagccgccgcgccatccacctcaccctcctctaccgccgccgccgccccaagcccctcatcctgctcctccccgtcgtcctccaaggacacccacatcttcacctcgcccgccgcgtccccgtcctcgtcccacgccggcgccaagctcacctncccggccgncttccccgcgcccacccactcnccgaccccaccgacggcgactgcggcgctggttcttctggccgcgtcgctgacggtgggtccgatggt

SEQ ID NO: 76154 - DNA, 417 bp, Zea mays
  unsure at all n locations
  Clone ID: LIB3079-013-Q1-K1-B9
gctgagaaaagcaagttacaaaggaacgaatggtttggtgttctccttagaataaggagcaatgctatcattgtgctggctatcatctgtcttcagttgccatttgagttggcctatgctcatctatatgagattacagaaactgaggctatgaagtatttgttgactgcagtatatcttgttgcaattcaatattacaccagaattggtggcaaggtgtctgtcaatttgataaagtatgaaaacaaccaaggagaagaatcgagttccgctagtttagtttataaggtctttggtctttactttatgcagtcatatattgggttattttaccatgcttcattgtatcgtgatatactggcccttcgncaagtcctcatccagcgtctcattgtgtcccaggtaatggaaaatctg

SEQ ID NO: 76155 - DNA, 442 bp, Zea mays
  unsure at all n locations
  Clone ID: LIB3079-013-Q1-K1-C1
caagattcgccactccgtccgttaccttcactcgctcactcacaatgcggcgccatggcgaggtacgcgtgatcttagctatggccgccgccgccgccgccgcgctcttggcgtcggcggccgtggccggacgagacggccggcagacctacatcgtccacatgtcccattccgccatgccggacgagttcgcggagcatgaggaatggtacgccgcgtcgcttcaggcggtgtcggatgccgccaccgtgctgtacacctacagcaccctcctncacggctactcggcgcggctgacgcgcgcggaggccgcggcgctggagtcgcagccaggggtgatcgtcgtcaacccggaggtgcggtacgagctgcacaccacccggacgcccgagttcctggggctggacggcacggacgcgctgntcccgcagtcgggcaccgg

SEQ ID NO: 76156 - DNA, 339 bp, Zea mays
  Clone ID: LIB3079-013-Q1-K1-C10
tcgcatctgcgtacacggtctccctcttcctgtcagtagtagagtgagagtgaggcagcgagtaggagacatggggaaatggggaagggagcgcaaggtgagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctcaaggagatgcgcatcgcgcacttcgtggtgaaagaaccgatggtgatcgggcacgagtgcgcgggcgtggt

SEQ ID NO: 76157 - DNA, 369 bp, Zea mays
  Clone ID: LIB3079-013-Q1-K1-C11
cccacgcgtccgcccacgcgtccggcccgtacgagattacctacgccgacgactcgtgcaccgtcggcaacctcgcgcgcgacacgctgactctttcgccgaccgacgcggtcccgggcttcgtcttcgggtgtggccacaacaacgccgggtccttcggcgagatcgacgggctcttgggcctcgggcgcgggaaggcgtcgttgtcgtcgcaggtggcggccaggtacggcgcgggcttctcctactgcctcccgtcgtcgccgagcgccacggggtacctgtccttcagcggagccgcagccgccgcccctaccaacgcgcagttcacggagatggtggccggtcagcacccgtcgttctactacc

SEQ ID NO: 76158 - DNA, 363 bp, Zea mays
  unsure at all n locations
  Clone ID: LIB3079-013-Q1-K1-C12
atcttggttagagtcgagactcgagacttcgagttccctctccgttataaaaccgagcgctcagggcgctccgtgttcaatctccttgcccgttgtgctctctctcttcattcgttcccggcctcaccccgagccagtcgtctcgctagggtttcgccgccgccgccgccatgcctcgccgcagctcaagaaggtctgccccacgcccagctccccgtgctgcttcactgaggaacccgccacagccagcacgccaggctcctnctncagctcctgttcgagatggtggtggctccatgtttggaagaattgggtccaccattgctcaaggtatggcgtttggcacgggtagtgccatggcac

SEQ ID NO: 76159 - DNA, 393 bp, Zea mays
  Clone ID: LIB3079-013-Q1-K1-C2
cagagggttggcagcactccttgatatggatttagatacaagtgtgatgagagagctgaagatcgaagagagttctactcaaagctcgaggtgaagattcatgcacaggaactagataaaagcaacttgcatgcaaaatcaaaggaaactgaagaagctgaactcaaaatgctgacaaagagtttaaatttcaaggcatcaccaatgcccagcttctataaggaaccaactagtcctaaggttgagttgaagaagatacctacaactagagctaggtcaccaaagcttgatcactccaagaacacatcctcaggagggacagaatggaattcaaatccttcagatcgttcatgtcgactgagtctcgatgaaagggtcttccaaaatggtgtc

SEQ ID NO: 76160 - DNA, 79 bp, Zea mays
  unsure at all n locations
  Clone ID: LIB3079-013-Q1-K1-C3
ccgcgggcgccccctccctttccggcgccctnncctctcaaagtaaccnnntccacagnncctctgtcnnngcggcatc

SEQ ID NO: 76161 - DNA, 120 bp, Zea mays
  Clone ID: LIB3079-013-Q1-K1-C4
aaaaaaaaaaaaaaaaaaaaaaaaaattaattaaaaaaaaaaaaaaaaaaaaaacaaagaaaggtttattatccaagcttacaaacacaatcatgcaacatgctatctacttccatatac

SEQ ID NO: 76162 - DNA, 437 bp, Zea mays
  unsure at all n locations
  Clone ID: LIB3079-013-Q1-K1-C5
ctaggatctttctctcctccactaaaagctccatgggagaggtcggctggggcttgagggctgaaaccatggagtttgccgagtgccagggaggagctgctgggagccaagacgacaatgccatggagaggggcaggggcgagcgctagggaggagaggggctcgatgaccagcgagctgggagaggcaccgagttgcaggagggggtagggacggtcggcgcagggagctctggcgagcttggcaagactgcaggcttgggggcgacgacagccatggagagaggagcgcgagcagggaggaatccaaggggaaatcgccatggggggagcagggagatgaggtcgccgacctggcctggtggggtttctgcattcgccacgacagggagaaatcccagaaggaagaccacgtggnggagcagccgtccgtgcggt

SEQ ID NO: 76163 - DNA, 445 bp, Zea mays
  unsure at all n locations
  Clone ID: LIB3079-013-Q1-K1-C6
cggatctccaggccggcagaagttgatcggactgactggtcactgtagttcgagcgagtccgagtagggctgatacagttcgattcggcgggaggcatggcgtccgaaaagcacttcaagtacgtcatcctcggcggcggcatcgcggcggagtacacggcgcgggagttcgccaagcagggagttaagcctggggagcttgcaatcatctccaaggaggctgtggctgcttacgagcgttctgccctaagcaaaggttacctgtttcctacgaatgctgcaagactcccaggattttatgtatgtgtgggaagtggtggagagaagctattgcctgagtggtactcagagaaaggcattgagctgatccttagtacaganaatgtcaaagctgatctatccaccaagactctgactagtgcagctggagcaaactttacatatg

SEQ ID NO: 76164 - DNA, 443 bp, Zea mays
  unsure at all n locations
  Clone ID: LIB3079-013-Q1-K1-C7
ggagaattctttgccagaaaggatcattggtgatgagaagagagtcttccatagtgggctgcacatggtaggcactctaacagaccgatgtaatgctggctgtatctcattatatgtaaatgtccataatgaggttgaagataggcataatcatgactggatgctgcgaagagcaaacttctctgggggctatgtatgtgtgaaatttgagattaggattagaaaatcaaagggctatctgttgagttcatcaagcagtcagataagtcagggatccaaacccaacaattctgagatggggcttagcttcaatatgtgcaagaagattgtgcagatgatgaatggcaatatttggtcagtatcagattctaaaagcatcggagaaactatcatgctagtcctncagttccagttggaacctgtgactccggtctctggagcgt

SEQ ID NO: 76165 - DNA, 439 bp, Zea mays
  Clone ID: LIB3079-013-Q1-K1-C8
ggagaagcagccgccgttgctgctgccgcgtccacagaatggggggtttcgtgaagagtcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggctcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctcttgtga

SEQ ID NO: 76166 - DNA, 417 bp, Zea mays
  Clone ID: LIB3079-013-Q1-K1-C9
accacgcgtacgagcagaacaacgacctttacaatcttactcaacttcgtcagatggggttcagggagccgatgtgctgattctagatctatcaacattgcgagacgctacagatgactttgctgaaagcaaaatgctcggtaaaggagggtatggtatggtttataagggagtcctgcctgatggccaagaaattgcggtaaagaggctttgccagagttctcgacaagggattggagagctgaagagtgagctagtactggtggctaagcttcaccacaagaaccttgtgaggcttattggtgatcgcctgcaagaacaggagaaaatacttgtgtatgagtatatgcccaatcgaagccttgacaccattctgattgactccgagaagaacagagagctggattggggaaagag

SEQ ID NO: 76167 - DNA, 423 bp, Zea mays
  unsure at all n locations
  Clone ID: LIB3079-013-Q1-K1-D1
gccaattttagcagttatcttcccacgtgaaggatccgatccatcaaagtggcgttgttatggcacaacacaggcaagacaatgtttcgcagtgagaggcgtgtaccctttgatggggagtactgatgaggccgaaactggtgggctaacaaaggaagagtatgggataaaacttgcgatgagctatggtcggtcggttggcatagtgaagcctttcgacaggttgataatctttgaaaagattggtgattcttctgttgtcaagatcattgagtgtgaaggttaggcattagatgattgatacctacaacccatgctgtagtttcatgtatcgcatgggagattacctncagttccatctcacttatttaaccaagttccaagtagagtacagcaagagcacaagatatcttgttagggaat

SEQ ID NO: 76168 - DNA, 420 bp, Zea mays
  unsure at all n locations
  Clone ID: LIB3079-013-Q1-K1-D10
cgtgtccgcgtccagtgtgtccgctactccgctccccctcagtcctcagttcctcaggtagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctncgtgccgcgccatggctccaatttttgctgatatggccaagaaggtcccaaatgttngtntcctgaaagttgatgtggatgaaatgaagaccattgctgagcaattcagcgtagaggccatgccaacattcctgttcatgagggagggcgacgttcaggacagggtcgtt

SEQ ID NO: 76169 - DNA, 223 bp, Zea mays
  Clone ID: LIB3079-013-Q1-K1-D11
ggaggatggtgaccaggaggatcggaagaagaagaagaaaaagaacaaggaaagcaaggaggctcctgctggtgaaggtgatggtgagaagaaaaagaaaaagaagtctaaggaggtcgaggaagagcctgttgtggctgctgcttcagaagttaagaagaagaaaaagaagtctgacgctgatggtgaggatgtcgcaatgcaaaccgaagaatcaggtaag

SEQ ID NO: 76170 - DNA, 187 bp, Zea mays
  Clone ID: LIB3079-013-Q1-K1-D12
cccacgcgtccggtcttctgataccattgacaatgtcaaggccaagatccaagacaaggaaggcatccctccggaccagcagcggctcatttttgcccgcaagcaactcgaggaacggccccacgctggccaactccaccatcaaaaagagaaccaccttcaattggtgcttcgtcttaagggtggc

SEQ ID NO: 76171 - DNA, 434 bp, Zea mays
  Clone ID: LIB3079-013-Q1-K1-B7
cttgacattggaagcgttattcggggctgcatttatgaatgagctccactcgagagaggcaccagtttctattcgaggagccacaactggtggtcctactgagtttgcagagatgggtaaaactctgttgtcatctagccatgaaggatactaccctgttgaacagaccgtacacttcaacaatactaaagatgctgctgtccgtagagaaccaggtattgagcattcagcagtacctggtctaagtcaggggagtgctagttctgacaagaaaggaatggaaattcatctgcctgaagaagataatttgtttaccatgagtgattctctgcttggtcaaaattctgatattttggcatcagtaggatccagcagggttgaagggctattgcctgaaaaggcacttgataacctcagctataggtttcaaagtc

SEQ ID NO: 76172 - DNA, 440 bp, Zea mays
  unsure at all n locations
  Clone ID: LIB3079-013-Q1-K1-A12
ccgacgcgtccgcggacgcgtggggcgctggtggcgcgggtgctggagcagctgctcgacgacgcgccgttcccgcgccggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccacccactagcctgcgcttgaagcagctagtagtagatactgtaggttgaccagtgatccacggtgtgtttctcgctttccttttgtctgttgatttctattggctatactacacggtgctgtaaaggatcaattagttctgcctttgaggccctcatttggtggtaatatttttgattacatggaccatggaaaaaacttntccttgac

SEQ ID NO: 76173 - DNA, 392 bp, Zea mays
  Clone ID: LIB3079-013-Q1-K1-A3
ggagtctcggtgtagtgtctccgtctgagtcgattaaggaccgtgtcgatgtgggagtgctgactgaggaccctttaattggtcacatgcctcgtcatgggcaagctttgcctcaggcagactaataccagaaaggccaacatgcaatgggagtggagagatggcgtgagtagcgtgtaccctccgtggcaagaggctggacggtggtgtatctgtgctctcggttggtgtgaacccagtctggtcttaagaaacccggtggagagttgacatatgcaagggttaagtgctacatatgtcgtgtgattggagatcctcagctgagtattaatcgattcggatcgtcgttacttctcagatatgaagacttggtcactgacttacacgtagca

SEQ ID NO: 76174 - DNA, 74 bp, Zea mays
  Clone ID: LIB3079-013-Q1-K1-A4
aaaaaaaaaaaaaaaaaaaaaaaaaattaaaaaaaaaaaaaaaaaaaaaaaaaaaaaagggtgctaaatcgcga

SEQ ID NO: 76175 - DNA, 444 bp, Zea mays
  unsure at all n locations
  Clone ID: LIB3079-013-Q1-K1-A5
gatttccatggcaattggcaacttcgcaaacacattggatacattgatggccgagtgtcggttcaaagcgaagatgaagaaatcaaagggcaaacgggatcttgacacgtgcccctcaccaacaggttcgtcgccgacagattcagcaaccagagcatgaaaaggtcaagagggccagttgcttaccctatgaccattgcccgtgtttaaccagggctggtcaccattgtaaatcattagtgttttctggccatcagcccctaatccttactgtctctgtcagagctcatactcatgtaagcatcaggcaactaggttgctgatggtcctaggctgaaaaaggatactgagaataaacttctggtgtttggttatacctatatcctgaacatggagtggagtagatgagctttaggacttgcagtcttagcanaatttcccagt

SEQ ID NO: 76176 - DNA, 426 bp, Zea mays
  Clone ID: LIB3079-013-Q1-K1-A6
attcagtcaccatggtagcaaccctgattgcctacattgccttcgttgccatattcgatttgccaggtcaatacttccaagatgtgaatagcggcggagacattggtgaggctcaaatagccaagcttactggttttcgtgtcttctgccttctgaatgcaactgctctcttcatttccctcgcggtggtcgtcgtgcagatcaccttggttgcctgggaaactggtgcccagaagcaagttatcaagatcgtaaataagctcatgtggaccgcatgccttaacacaagtgcggcttttatctcactggcatatgttgcagatggcccgcagcatgcctggatggccttcacagtatcagccatcggaggtccgatcatgattggaaccctgctgttcctagcctatctgttgatgcgcccacggt

SEQ ID NO: 76177 - DNA, 446 bp, Zea mays
  unsure at all n locations
  Clone ID: LIB3079-013-Q1-K1-A7
cgtatgttgaccaattctcaagatgcctctatgttgagtacaagagcaagggtattgatgtgcaatgccaggtgcccttatacgtggcgacaaagatggcatccatcaggaagtcttccttcatggtcccatctgctgacacctatgctcgtgctgccgttcgtcacattggatacgagcctaggtgcacaccatactggccacactctgtcgtgtggttcttgatctccattcttcccgagtcccttatcgacagcgtgcgcctgggcatgtgcattaagatccgcaagaaggggctggccaaggacgccaagaagaaggcgctgtgattgatgtttcagaatgcatgttcagattcgcacatttcctcatcacctgtagtagacacgtgccttgctgtagtcactttattagctaccattacctnctgagtctgttaagaatcg

SEQ ID NO: 76178 - DNA, 447 bp, Zea mays
  unsure at all n locations
  Clone ID: LIB3079-013-Q1-K1-A8
ctggatttagtagagttttatctggcataattgcaaatcaatggaaaagaaggcaaggattggaagcgggggaaggattggtacaggcttgatgggagcactccatcttctgatcgtcagaatcttgtggagatgtttaatgaccttgaaaacacaagagtgaaatgcacattgatatcaactcgtgctggatccctgggtatcaaccttcatgctgcaaatcgcgtggttcttcttgatggatcatggaatccaacacatgatctgcaagccatttatcgagtttggaggtatggccagaccaaacctgtatatgcctaccgnctaatggcacatcaaacaatggaagagaaaatatataagcgccaggtgacaaaggaaggccttgcaacaagggtggtggatagacagcaagtttcaagaaccatcttcaaagaagagatgctt

SEQ ID NO: 76179 - DNA, 391 bp, Zea mays
  Clone ID: LIB3079-013-Q1-K1-A9
ctacgaacgggggccgggaaaagatcggctacagacagatgaggctctgtctccggcgagcggcggccaccagctcacccctcgcagctaccctccgcggcaagacttctacgagcaccctcgccccccatggccggctcagcttcagccacaccacgtcgctgcagacggcgcccgggcaccgcgggctccgagcagggtgggcggtgcgcgtgctcccgctgacggaggagaacgtggagaaggtgctggacgaggtgcggccgagcctgatggcggacggcggcaacgtggcgctgcacgagatcgacggcctcgtcgtcgtgctcaagctgcagggcgcgtgcggctcctgccccagctccaccatgacgctcaagatgggcatcga

SEQ ID NO: 76180 - DNA, 415 bp, Zea mays
  Clone ID: LIB3079-013-Q1-K1-B11
gctctggaagtggtgcgagggcgacaaccagcgctggaagatcctcccttggtgaacgaacgaaagaaactactagctggtaccctaataataattctgctggctgcggcgatcccaaaataaaagaggccgggtgcgatgcatctcggacttctcgagtggtgtttgcgtcagacagccagccactgtggggctagtgttccaacatttgtcagcctgcttgcgcgaggaaggggggtcactgactcaagagaagggcctggtcataggctgctgcattatgaatttctgatgatgtcttatgtctgtactctgaatcaactatgtatgagatctcatctcctttctcctactgaatgaatgaatcattattggctttgctttgcttcacctgcttgaaaagcatgcattgtat

SEQ ID NO: 76181 - DNA, 444 bp, Zea mays
  unsure at all n locations
  Clone ID: LIB3079-013-Q1-K1-B2
gtggcggccggcggcgctgctggtagtggctctggcggcggttctatcggcggcgtggcgggcggatgcgctatcggttacggtgaccgacaccgagtgcatccacgagttcgtgccctatgagggcgacaccgtgtccgggaacttcgtcgtcgtcgaccacgacatcttctggagctccgaccacccaggaatcgacctcacggtaacgtcaccaggtggcaacactgtgtacacattgaagggaaaatctggtgagaaatttgagtttaaagctccaagaggtggcatgtataagttctgcttccataacccatatggagcacctgaaactgtttctttctacatccatgttgggcacatacccaatgagcacaatctggcgaaagatgagcacttggaccctatcaacngtnaaatcgncgagctgaaagaagcattaga

SEQ ID NO: 76182 - DNA, 441 bp, Zea mays
  Clone ID: LIB3079-013-Q1-K1-B3
aaagatatcaaagaccacttcccgtcttcctcccgtggctgtctgtcatctggctctgaaacgatggcagtcctgcaagttgctgctgctgcccctccccctgtctctgtgattgggttcgagggatttgagaagcgccttgagatcagcttctctgaggcacctgtcttggctgaccccagcggaaggggactgcgtgcgctctcgcgtgcccagatcgactctgttcttgaccttgctcggtgcaccattgtgtccgagctctcaaacgaggacttcgactcttatgtcttatctgagtcgagcctgtttgtctacccatacaagattgtgatcaagacctgtggaactacaaagcttctgctcgctattccgaggatccttgaacttgctgaagagctcctgttgccactcgctgcagttaaatactcccgtggaacg

SEQ ID NO: 76183 - DNA, 284 bp, Zea mays
  Clone ID: LIB3079-013-Q1-K1-B4
gttcaatgtggtcattgggccaggaatctagtggttgctgtcggtcgctcgttctagatggattatgggctatggaacctggagtgccgtggtgctgcaaacatctcatgtttcattctgaaatctttttagatgtataatacgtagtagttgaattttctgtaaaaaaaaaaaaaaaaaaataaaaaataaacaaaaaaaaaaaaaaataaaaaaaaaaaaatatataataaaaaataaaataaaaaatagtcgttctttttaaaagaaccaaaaattaaaag

SEQ ID NO: 76184 - DNA, 446 bp, Zea mays
  Clone ID: LIB3079-013-Q1-K1-B5
gtgctcagtaatcccaagcagcgtgaagactatgacttacatgggaaacctggtgtgtcaacggaagcgataattgatcctgcagcaatttttgcgatgctgttcggtagcgagctttttgaggactacattggtcagctggcgatggcatccatggcttcacttgatggttttactgaaaacgaacagatcgatccaagaaggttgcaagagcaaatgcgagttgtacaaaaagaaagagaggagaaacttgcagaggcactaaaagataggttgcatctttatgttcaaggaaacaaagaggaatttatccagtatgctgatgctgaggttactagactctctaatgccgcatacggtgttgatatgttgagtactattggttatgtgtattcgagacaagcttctaaggagcttggaaagcaagctaaatatcttggtgttcc

SEQ ID NO: 76185 - DNA, 435 bp, Zea mays
  Clone ID: LIB3079-013-Q1-K1-B6
atgcacatccatcgtacatccgtgctgccaagtgccaactaatgaattaaccagcaacacttaattaagaggtagtgtgcatggtgaaacaaagattattaacatggcttctagctgctactgctactgctactagcaatttttgcctctctggtctggtctgccaaggctaccgctgctgtatgaataacttggagatcgaccgaaaaattacatgcatgtaagtagaaggggttaataaaggtggtatgcagacgaagatgcttttattgaactagggtttaagtagctagaaacggatgggaactgtactttaagtcattatgttctgtgctcttaggggaacatggctcatgcgcttaaccttcaataaagactgtaaagatgagtacgtggatcggaaaaataaagagcttggaaagcaaaagggcggtc

SEQ ID NO: 76186 - DNA, 404 bp, Zea mays
  unsure at all n locations
  Clone ID: LIB3079-013-Q1-K1-A10
tgacctttagcattcttaattcaatgaacatgtcttgttagaattcaagtaaatggagtanccaagattgttatcatagttttacctttacatgactaaccttacacatggttttgtatgactttctttttcagatgtgacctgtttgatgtcatgttggagatggatcgcatactgcgcccagaaggaactgccgttatacgggcctcgccagacgtagtagccaaggcagcacagatcgctcagtcgattcggtggaaggcacaggtgcatgacagtgaaccagaatcaggcagtaccgagaaaatacttgtggctaccaaaacattttggaagctgccactaacaaaacaataggctaatgcgagtttgaactttgaacccttttcacttgcgcttcctta

SEQ ID NO: 76187 - DNA, 422 bp, Zea mays
  unsure at all n locations
  Clone ID: LIB3079-021-Q1-K1-H10
gccgccggaggaggagccccaggccccgccgtcgccggacacagagcctaccgaggcggcgcccggcgaggcggaggatgagccgcaaaccctagagcgggcgcaggagctcttcgacaggggttccaaggccatcgaggatgaggacttcgtcgacgccgtagactgtctcagccgagcgctcgagatcagggcttcacattatggagagctcgcaccggagtgtgccagcacatacttcaaatatggatgtgccctgctatacaaagctcangaggagagtgatgttttgggaaatgttcccaagagcttgccaaatgaagactcagtgaagagtacagctactaaagatgacagtggaacctcaaaggtctctggtaccgatgncgangatgctgcgtcatcagaaaaaagtgatgctg

SEQ ID NO: 76188 - DNA, 393 bp, Zea mays
  Clone ID: LIB3079-021-Q1-K1-H11
cgccgccgcttgctcctcctctccgactcctccctcgggcaccgtggtgttcttcgtggacagggcaggccggaggcgcctgatgctgatcagcctggtcggaatcgtcgtgtggctcgccgtgctcggcggcacgttcctgggcgccgcacaccacgccccacccgtcagcgacctggagacccgactgttggcgaaccagaaccagacccagacccagacgtgtcccgagttcaacccgaacgtccgctggagctgcatggactgcctcaaggccgcgtccacgtgcggcttctgtgctcaccagggagacaagcttcttccgggggcgtgcttggcgctgaacaacgcgtctcggcatgcgtgccgcgcagaccaccgggagttctacac

SEQ ID NO: 76189 - DNA, 297 bp, Zea mays
  Clone ID: LIB3079-021-Q1-K1-H12
tccggtagggttggagacgaatgcacaagcttgtggtgcctgtcagcttgttgagaaggaggtcacataagaatttggtagtgaatatatatacccctgcctgcgtgcaggtgctggccatgaaagatagtagctgctcgggacttacatggctatgcctggtattgctaaagcagtggttgatgttggctaggaagttggtgcggatgcaagttgccatggtttgactcggtaaagcagtgatcacgatcgcttttagcttacatttctatgctttataaacttgacttaaagtgg

SEQ ID NO: 76190 - DNA, 379 bp, Zea mays
  Clone ID: LIB3079-021-Q1-K1-H2
aaccttccggggaaggaggcgtggacatgtcgctggtggagcagtaccgtttcaagtggctggcaacatggtgtgagcaagaccaagaccaagaccaaaggatagttgacttgggaactgtgggaagtgggattgatgttgaagagcagcacggtgtcccggaccaccgtataacgtttcgaagagcaagtctccacatactttctgaggccaaaatttcgattgtgatgcttaatagatttgtgtccatctgtactgatatttataactgatctagttacagccgtataattatgaatcatcttatcatacaccgattatggcttcatgatgacctgactgtgtctgaaattcctgagttggtatttctaacggaaac

SEQ ID NO: 76191 - DNA, 436 bp, Zea mays
  Clone ID: LIB3079-021-Q1-K1-H3
cccacgcgtccgcccacgcgtccgcccacgcgtccgcggacgcgtgggccccaacgtgccggcatattcgggtgggggcaatcctggctaccctggtggcagccctggctaccagggtcaaggaggcaactccaacttccagtgaacatgaccacgagtactaagttggcacccctgtttcagagtagccttctgcaagagatggtgcgccgtagcctagcataaatcgaacccttgttgctatcggattttcatggattgtcgctgtttgcacttaatgttctatatatagtactcaaaactatgcttggtgtctgagtgatgtacgtggaattctgaaactatggatcagctcttgtgtgcacttgctgaaccagatacccagcagtaagcttttgtttgttcgttttgagtggttggttaaccacatacttgg

SEQ ID NO: 76192 - DNA, 410 bp, Zea mays
  Clone ID: LIB3079-021-Q1-K1-H4
gtcagcaccaccaatgccgaggggacagccaggaagaatgcagttgcaacaggtgccgggtgctcagcttggcgctctacaaccaacacaggctacactgaacatgcagtacaggggcatgcatccatcgatgcaaatgaatcatggaatgggcatgtattcccaaccaacgttcggaggatattatggaatgaaccaaacacagctttacggcgttcatatgtctggttatggatatggtcagcaatctgggggctactatattccgaatgctgcatatgcctatactagtgcaaacgaacttgcccagaggatgaatgacctttcagttcaaaacggtgatccaaatggagccgcagcaaataagcagagcagacctgaggatgcactctttggtgatctcttgagca

SEQ ID NO: 76193 - DNA, 403 bp, Zea mays
  Clone ID: LIB3079-021-Q1-K1-H5
gttctgaagctgatagacaagtatgatctgtatggaagcgtagcgtttcctaaggatgacaatcaggctgatgtcccggagatctaccgcctcgcggccaaaatgaagggtgtcttcatcaaccctgctctcgttgagccgttcggtctcaccctgatcgaggctgcagcacacggacttccaatagtcgctaccaagaatggtggtccggtcgacattacaactgcactgagcaacggactgctcgttgacccgcacgaccagaacgccatcgctcaagcactgctgaagctcgtagcagataagaacctgtggcaggaatgccggagaaacgggctgcgaaacatccacctttactcatggccggagcactgccgcacttacctcaccagggttgctgggt

SEQ ID NO: 76194 - DNA, 425 bp, Zea mays
  unsure at all n locations
  Clone ID: LIB3079-021-Q1-K1-H6
cccacgcgtccgccattcctggccgtgcccaggaagtcctgtccgtgggttggggccaaggctttccctggttggcctcgccgtgagcagcacccccgatatctgcgcgcgctgccggctcgctgttttgggaagcccagtggacaacacgacgtcgacgctcaccgggtgtttgctgtttttgcgcagccccatccgcgacgtcgttcacccccgaaggcaagccgctcaacgctcgtcgacgttcggagctatgcacaaatcagaatcgccatcgatcttacaaacgccgattgagtttgtttatggaacgaaagaggatgatcgtgcaagtgatgtggtgccacccacaagatgcagtcggtggacgaaccaaggaaggatggacataacangtggatgctcgccaagcgagtaccctccct

SEQ ID NO: 76195 - DNA, 262 bp, Zea mays
  Clone ID: LIB3079-021-Q1-K1-H7
cccacgcgtccggccgtcgtctaattcgtcctcctgcgctctagctgttatctgggtgtgtcttcgcgtgctgggttcctgaatggacgaataatatatagcatgcatgtacggctagcgaccatgtctgaatgacatcttcgttgctgctgctgctgctactgctacctgtccgtttggtgttctaaaagactctgatgagtggttctgaatgtctgcatttcaagtttgctgtgtgatgttaatgtaccgtgcgtaccat

SEQ ID NO: 76196 - DNA, 409 bp, Zea mays
  Clone ID: LIB3079-021-Q1-K1-H8
cttgccatcaggatgttcagtgtgagatatgtggagaaaagcacctgaagaagggcatcaagcggcatctgcaatcacatgacaaggcgccctctgatggaaggatgaaatgcacttttgatggttgtgaacacttcttttgcaacaaatcaaatctgaccaagcatgtcaaggcatgccatgaccagctgaaacctttcaagtgcggaatcgttggatgtggcaaggcgttcacctacaagcatgtcagggataaccatgagacatctggtgctcatgtatacatggaagtgagttgtgctacctgatctatgttaattccgagtttgcgattgttggcctattaagtcaaactatcagctcctgattttcgtacgtatctctaatttaaacgtatgttcacatctgc

SEQ ID NO: 76197 - DNA, 379 bp, Zea mays
  Clone ID: LIB3079-021-Q1-K1-H9
cacaagtgcggtgccataagtgacagtttcctcagtctctgtctgtggagctctctcgcgcgcgcgttgccatctcgcgggttcttcatctcgtcgctctgttcaggcggcgacaggagatggacggggagcaggcggcgcggtgggcggcggctcacgagggggttcccgtcggggcggaccttgtcgcggcggcgctgcggcagctgcgcttcctcgcggcggtggaccgtcgccggtggctctacgacgagggcccgctgctcgaccgggccatacgcatgtacaaagcatgctggcttccgcttcttgacaagcacactaagggtgtggctgtagattggtccattgggtgttcctcttgattgtgagtggatat

SEQ ID NO: 76198 - DNA, 411 bp, Zea mays
  Clone ID: LIB3079-022-Q1-K1-A10
ccgaagatgacctcaagttcttctacgacgggcaaggcttcatgtccctggagctggaccgtatccaagccaagttcaccttttacgatgtcgacgggaaggcgctgtacagttacacacggtcgagcctgatggaaacaggccaccacctccaagcctccggctacgtcaacgaggaatgaagcatgggcgagtcagcatgcagcgctggagaactgagatcgatgcagttcaagcgtacgtataaattctcgagtgcttgatgtggttcatctgtcaagggcaacaacagttaggtttatatgtgtgcccttgcatctctcgacatctgtcactgccgtccggtactatttggggtcatgccatcgattcgaaaacatgacatggtatgggcagccattgattttccat

SEQ ID NO: 76199 - DNA, 389 bp, Zea mays
  Clone ID: LIB3079-022-Q1-K1-A11
cccacgcgtccgcccacgcgtccggggcggccctaggggagtgcataaagaacccagggtacatggtgggaaccacagcgttgcctggttactgtcggaggagctgcaatgtgtgctagggtcaggacgtgagagtactagtatttgttagtgcataccacttgtatccatagtctgttgttggtctcctacatctcgcataaaagaaatactcctatgctataggttatgccgatggaggtgcatttagaataagcctagtatttgatctattgatttattagattgcttggttctgctagctcataatttgtaccggaaccttagaagatctttgattcgttgtcatctgtaacattttctcgatatatatatggtgtgcatttctg

SEQ ID NO: 76200 - DNA, 293 bp, Zea mays
  Clone ID: LIB3079-022-Q1-K1-A12
tctcactcgtccaaccaaacatacgtcttcagcataaacatttcattaaaggaccaagggtaccttaagtgagccacacatttgtctccttactactttcagaactgaaccttgatctaaggtcagaaactcaaacctactgtcccacttagtgaacaccaataccttatatagtgtattaggacattccctctccccaaatttcaaaaactctattatgctattgaatacgaccttcatgctgattataccataactattttcttaggaaacaattacaacacctacacttt

SEQ ID NO: 76201 - DNA, 207 bp, Zea mays
  Clone ID: LIB3079-022-Q1-K1-A2
cctaatggttacctccaacaattttcctccaatcaaacttaggggttggggaccctgccgggactaccgccaccaaccttggacgctatcttaaggggccaacagttcccaacagatccctcccctgctatggagatcgtgcagaaccctaaagcatacccactggctgatgcgcagctgaccatgggtatcctcaatgtcatccat

SEQ ID NO: 76202 - DNA, 411 bp, Zea mays
  unsure at all n locations
  Clone ID: LIB3079-022-Q1-K1-A3
cgtcactcaacacagcacaggcagctcgagagagagagagagagaaagatgtcntgggtcgggcgccaccaccacaagcagccggctcccccggcgtctggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcatcacccgggtcaaggacgaggaatgcatgccggcgttcgcgctcgtcaacaaggccacggggctcgcaatcaagcactccctcggccagtcccacccggtcaagctcgcgcctttcagcccggaccatgatgacgcgtctgtgctgtggacggatagcaaggacgtgggcaagggc

SEQ ID NO: 76203 - DNA, 273 bp, Zea mays
  unsure at all n locations
  Clone ID: LIB3079-022-Q1-K1-A4
caatntgaaaactgattattacattgactgctagtttttaaaaaaaaaaaaaaaagagaaaaaggaaaaaataaaaaggcagacagataaaaaaaaataaaaaacaaaaacaaaaaatcaaaatctaataaaaaaaaagggcaaccgcctctcgttttcaaagttccaatcttccttcctccgacatccaacgttttatcttttttatcctaaaaccaatttacaatccactgccctacattttacaacctggaaaatccaaaaccttcccat

SEQ ID NO: 76204 - DNA, 419 bp, Zea mays
  Clone ID: LIB3079-021-Q1-K1-G9
gaagaatcacgctcgttcttctataaaaggctacggaggaggatcgcagaagatgttgttgcaaaagaaataaggcagatagtccgtgataaatttacgcaccaattagcaatggagctcatcaaggaatggtaccttgcttctcaagccacaacaggaagcactggatgggatgaccatgatgcttttgctgcctggaaggacagtcctgaaaactacaaggggcatatccaaaagcttagggctcaaaaagtgtctcattcgctctctgatcttgctgactccaggtcagatctgcaagcattctcgcagggtctttctacgctattagataagatggatccctctcagagagcgaagtttgttcatgaagtcaaagaagtccttgattgatgataccaacacatccaacacaatgt

SEQ ID NO: 76205 - DNA, 306 bp, Zea mays
  Clone ID: LIB3079-021-Q1-K1-F4
acgagaactactgcctggccgtccgcgacggcgccgtcgtgctggccccggtcaacgcgggggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacaccc

SEQ ID NO: 76206 - DNA, 409 bp, Zea mays
  Clone ID: LIB3079-021-Q1-K1-F5
atctcttctttgggccacaaggccttcccccgataagaactggaggttcctcatgtggtaattcagttgtcaaggaacagaagccgttctttgattctgttcctggtaccccagtggagaaatccgtctttgattccatcccaggcacgccatttcagaaatccgtctttgattctatcccaggcacgccagttcagaaatccgtgtttgattactctgtccctagcacaccgatgcagaactcagtctttgattattctgtcccaagcacgccgatgcagaagtcactctttgattctgtccctggtacaccggtgcagagatcagttttcgattctgttccgagcacaccaatgcagagatcagtttttgactctgttccgagcacgccgacgcagaaaccattctt

SEQ ID NO: 76207 - DNA, 419 bp, Zea mays
  unsure at all n locations
  Clone ID: LIB3079-021-Q1-K1-F6
cccacgcgtccgataaattttgggctagcctttctgagaaaacggggatttaagccgatgcaaactccctttttcatgagaaaggaaactatggcaaaatgtgcccagttggcccagtttgatgaggagctttacaaagttacaggtgatggtgaagacaaatatctcatagctacatcagagcagcctttatgtgcttatcacttaggtgatagaatataccctgctgaacttccaatcaaatatgctgggtactccacatgcttccggaaggaagctggttcgcatggaagggacacagctggtatcttcagagtccaccagtttgaaaaaatcgaacaattctgcattacaagcccaaatgacaacgattcttgngagatgcatgaagagatgctaaaaaactcagaagattacta

SEQ ID NO: 76208 - DNA, 301 bp, Zea mays
  Clone ID: LIB3079-021-Q1-K1-F7
aacactcatttgggccacaaggccttttcccaataaaaactgcaggtacctaatgcgagtggttacactgtcaacgaacacaaaccaaactttgactctgttcttgcgaccccactagataaatcactctctgattccatccacagcacaccatttgaaaaaaccgtctataactctatcccaggcacttcagtgcacatatccttgtccgaatactctgtccctagcacaccgatgcataactaagcttttgactattctgtcacaaccactccgatgcataacacactctttgactctg

SEQ ID NO: 76209 - DNA, 428 bp, Zea mays
  Clone ID: LIB3079-021-Q1-K1-F8
cccacgcgtccgaaagggtggaagagcaaggcttggccaggcacgatggaggaggtggagctgctgttcgccctgatcgacatcaaggtcgtgtcgcgggtgctccggatggggaagctgagcaaggagcagctgctgtggtgcgaggagaagatgagcaaggtggacctcaccgagaaccggctacgccgtgacgggtcccccatccttttcccctgttaggccgacgcacccttcctgcctgcctctgggggcgtaagcagagaacctcccttactttgttagttcggcatgccatggcggtggtggcggcaccaggggtgtccgctcgtaccattcctttcggctaccttatcagactatatatgtacatgcttttaggttggatctgaattgaaaatgtccatactaaagtaagggcttaaagt

SEQ ID NO: 76210 - DNA, 419 bp, Zea mays
  Clone ID: LIB3079-021-Q1-K1-F9
agctgaactgcaaggttagggttttctgatgcgctcatacatggggcagccagaagaggggatgtctgatggcttgtacacttacaagcatcaccgcgagcgaggagctgatattcacaccatctttgtgaagaagagcaaattcaggattctgctgtcatttatcggcacaacgttccttcttgtgtctgtttgctgcgccctgttatcgaaagatggtttatgtctttggtccctttggagcatttcatttgccagtgtaattgcgaaatgcctgcgatgtgaccctgtgaagaaagagtcattggcgatcatgccgacttttggaattcaattagagcaacacttttggagtggaagagttcatcgcaaatttgtgcccattggcaagattctaagaccagtgctgaatgagcatg

SEQ ID NO: 76211 - DNA, 420 bp, Zea mays
  Clone ID: LIB3079-021-Q1-K1-G10
cccacgcgtccggcggcgagatgaacggcggcggggaggacgggaagcagcagccgcgcctggtactggcgcacaagctgttcctcctgtcgcactccgacgtcgacgacctcgccaaggtcgacctacgcgctgacgtgttcgcggcagtcaaatccgatgacatggcagctctgtacgagtcgttggcggcggacggcgtactggagacggacgcggcgctgctggccgagatgcgcgccaggatcgacgaggagatccggaagctcgacgagaagattgctgatgcagaggagaacttgggtgagagtgaagtgcgtgaggcccatctcgccaaatccttatatttcataagggttggggagaaggagaaagcactggagcagcttaaagttactgaaggaaaaaactgtaactgtg

SEQ ID NO: 76212 - DNA, 96 bp, Zea mays
  Clone ID: LIB3079-021-Q1-K1-G11
cccacgcgtccgaatgacatatttatataacaaaaaaaagaattaaaaaaaaaaaaagggagggaaattaaagggataagggtgaaaaaataaaaa

SEQ ID NO: 76213 - DNA, 421 bp, Zea mays
  unsure at all n locations
  Clone ID: LIB3079-021-Q1-K1-G12
cacaagtgcggtgccataagtgacagccacctcagtctctgtctgtggagctctctcgcgcgcgcgttgccatctcgcaggttcttcatctcgtcgctctgttcaggcggcgacaggagatggacggggagcaggcggcgcggtgggcggcggcgcaggagggggttcccgtcggggcggaccttgtcgcggcggcgctgcggcagctgcgcttcctcgcggcggtggaccgccgccggtggctctacgacgagggcccgctgctcgaccgggccatacgcaggtacaaagcatgctggcttccgcttcttgacaagcacactaagggtgtggttgtagatggtccattggttgttcctcttgattgtgagtggatatggcactgccatcgncttaacccggttcagtacataagggactg

SEQ ID NO: 76214 - DNA, 409 bp, Zea mays
  Clone ID: LIB3079-021-Q1-K1-G2
ggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggc

SEQ ID NO: 76215 - DNA, 404 bp, Zea mays
  Clone ID: LIB3079-021-Q1-K1-G3
agctcctgcaaggcaagccgctctgggtgcagggataccaaacactgttgtttgcacgactgttaacaaagtctgcgcatctggcatgaaagctactatgttcgccgcacagtcaattcagctgggtatcaatgatattgttgtggcaggtggcatggaaagcatgtccaatgccccaaagtacattgctgaagctaggaaagggtctcgttttggacatgacacacttgttgatgccatgcttaaggatggactttgggatgtatacaatgactgtgccatgggaatgtgtgccgaactttgtgctgacaatcatgccctcacaagagaagaccaggatgcttttgctatccaaagcaaccagcgtggaattgctgctcgtgacagtggtgcttttgcatggg

SEQ ID NO: 76216 - DNA, 430 bp, Zea mays
  Clone ID: LIB3079-021-Q1-K1-G4
tgatatggttaataaatactatgatcttgccactagcttctatgagtatggttggggtgaatccttccactttgctcacagatggaatggagaatccttacgtgaaagcatcaagcgacatgagcattttcttgccctgcaacttggtttgaaaccaggaatgaaggttttagatgtgggctgtggaataggtggaccactgagagaaattgcaagatttagctcaacttcagttaccggattgaataacaacgaataccagataaccaggggaaaggagctcaaccgtttagcaggaattagtggaacatgtgattttgtcaaggcggacttcatgaagatgccgttcgatgacaacacttttgatgctgtttacgccattgaggcaacatgtcatgcacctgatccagttggttgctacaaggagata

SEQ ID NO: 76217 - DNA, 434 bp, Zea mays
  Clone ID: LIB3079-021-Q1-K1-G5
accattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctagattcttatgtgcttctagtctccaaatgtggttgatagttattttgctctaaga

SEQ ID NO: 76218 - DNA, 390 bp, Zea mays
  Clone ID: LIB3079-021-Q1-K1-G6
tttatttattttttttttttttttttacttttattttttttttttatttaatcggtgggcattatttaactcttctacatatttacagcatcaacaactactaccattcatccaactatctgattttagccctgctaccttcttgatacaaccacagttgttacctttataacatcactcttaacctaacgctaccaccctcatacaactgcaacaattgctgccattcaacctaacttactttaaacaaacaccagtatcagttctaccaacatcccataattgaacatgccctcaattagaaatcttacaagttatagttcaataataaagttttttgacagatccttgtagcttcccacatataatacagtacatttctagattgtt

SEQ ID NO: 76219 - DNA, 432 bp, Zea mays
  Clone ID: LIB3079-021-Q1-K1-G7
ccactagattaccaccacctccacctcgtcgtctcccaccaccgccgagcgcgagccggagcccgatctagccggcggcaggcaccagatcccgccgcccgcggcgtcccgggacgcgccccgccgaatccgccgctcctcgcactgcaacacgcccggaccacggtgcatttgatccgtcccggccgcctacacgatgtccaagtcgggagcgctggatcttgcttctggcctcggagggaagatcaacaaggtggaagtcaagtcggccgtcgatgagtatgagaaatatcatggatactatggagggaaggaggaagcaaggaagtccaactatactgatatggttaataaatactatgatcttgccactagcttctatgagtatggttggggtgaatccttccactttgctcacagatggaatggaga

SEQ ID NO: 76220 - DNA, 307 bp, Zea mays
  Clone ID: LIB3079-021-Q1-K1-G8
aaaataaaaaaaaataacataatatctataacaaaaaaaaaaattacattaaaccgagctggaaacataaaactctaatgcttaaaaaacaaaaacaacaactactaaaattcaaccactttactagtttcatccctactaccttatccatcaaccaatattctccgttctaccaccacacttcaattaactctccaactttattaaaattgcaacatttgataacattcaaccaactaaatttaactaacttaccaaccttctaccttttgcccattattgcaattgccataaattatatttctta

SEQ ID NO: 76221 - DNA, 390 bp, Zea mays
  unsure at all n locations
  Clone ID: LIB3079-021-Q1-K1-F3
cccacgcgtccgcccacgcgtccggccgggcctgctgtccaccctcgtcacggcagccgggcggcgctctgaactcccgagccggctctccatcagccacgtcgcgcgccgcccaggagaaggagctctttaatctgtgctagcagcggtcccagagaatgcggcagatctcgtcgctgctgcagggcctggcccggtcactctcggtggggagggacagggacagggacagggaccggaaagggaacggcgcaggcgaccgcaagaccgccgtgccggcggtgctgcggacgtcgggcaccctgtggggcgacggctcggacacgttcgccgncgtctgctcgcggcgcggcgagaaaggcatcaaccaggactgctccatcgtctggg

SEQ ID NO: 76222 - DNA, 424 bp, Zea mays
  Clone ID: LIB3079-021-Q1-K1-D9
gaccaactaaaatcgtgacatttgacattcatgtgatgataggcagtggggtgccagagccgtgcagaatgattaaccctagacaaggatccgaggcagaactcagcatggttaacaccactatcttttcaaggggaatggtaataaggagaatgagccgtttattagtgatgtaaccggcatcactgattctgccattctctcaggattaaagaacgacatgcaccaaatacagaggtacagaacctgcaggaatctttatctgatttccaatacgtatgttttgcatacactgaagcgcgcacagaggcagatgcagcactaatctagccagtaaaccaagcacgcacactcacgcgcacgcacacaccaagtgaccataccatcatacaacatgcagtcagggtttttttatcaacagtat

SEQ ID NO: 76223 - DNA, 328 bp, Zea mays
  Clone ID: LIB3079-021-Q1-K1-E1
ccttgccacatctaacaatacaagccatcacaacgcaacagcaacaacagttcctacgaggactgagccacctagccatggtgaaccctgccgcctacttgcaagagcagctgcttgcatccaacccacttgctctggcgaacgtagttgcaaaccagcaacaacaacagctacaacagtttctgccaacgctcagtcaactagccatggtgaaccctgccgcctacgtacaacaacaacaactgctttcatctagcccgctcgctgtgggcaatgcacctacatacctgcaacaacaattgttgcaacagattgtaccagctctgac

SEQ ID NO: 76224 - DNA, 320 bp, Zea mays
  Clone ID: LIB3079-021-Q1-K1-E10
acttatgatactgatgcttcctcccactataaagctccgttctcaaaaactatctacgactgagaacactgctcctgcgtgctatgaacaaagactactacctatctaatactcctatgctaaatctgtcatactaaagtatacgttctccataaaatccacacattttatatctcaagatactcctaatgatattccctaaatacaagctgaatataaacctttacagacttttaaactgaaacgtcttcttcactgaattactcaaccaagactcttattatcaccatttaacgtattaatcacattattccacaaat

SEQ ID NO: 76225 - DNA, 372 bp, Zea mays
  unsure at all n locations
  Clone ID: LIB3079-021-Q1-K1-E11
gggtggggcacgaacgaggcgctcatcatctccatcctcggccaccgcgacgccgcgcggggccgcgccatccgccgcgcttacgccgaggcctacggcgaggagctcctccgctccatcacggacgagatctccggcgacttcgagagggccgtgatcctgtggacgctggacccagcggagcgcgacgcggtgctggccaacgaggcggcgcggaagtggaagcccgggaaccgtgtgctcgtcgagatcgcctgcacgcgcacctncgcgcagatcttcgcgaccaggcaagcttatcacgagcggttcaagcgctcgcttgaggaagacatcgctgcgcacgtcactggggactttcgcaagctattg

SEQ ID NO: 76226 - DNA, 349 bp, Zea mays
  Clone ID: LIB3079-021-Q1-K1-E12
ctacctctcccaaatttattttccactacttttaccactaggacgtgcatattgctcctcctgctatctataacgactacaatctacctaatcttctctgctatacactactaatccccattccattttaacacaaacatctactcctttgattcctaataccatcttctaatatcaatatacttctcaatcacatatactatatcctcacattttcataattttcaataacttattctatcaagcatccaatccattctatattaattaaaatctgtcctctgtaaacatgtcaacttcctatctttccacattctcaatcaatctaaatcattacctattcatctct

SEQ ID NO: 76227 - DNA, 333 bp, Zea mays
  Clone ID: LIB3079-021-Q1-K1-E2
gatcccccacgccatcgagttggataaggcgtaccctcgggatttcttccaggtggggagggtcagggtgcagcttaagaaagatgacggctcccccgtcaatcctgctattaaaacgaagaagcagctgatgatccaagtagcagagctagttcccaagcatcacggaaggacaaagaagcaggagccagcgcccaatcccggtggcagttcaaagaacacaaaaggcgggaaaaagaaaaagtgatgcagtatcattgtgttgttttttattctgttcgtcatcatacactaagcttctgtgaaaaagaaaaagtcttggacgttgttgtt

SEQ ID NO: 76228 - DNA, 423 bp, Zea mays
  unsure at all n locations
  Clone ID: LIB3079-021-Q1-K1-E3
gggacgcacacgtccagcaccgcggcgggcggcgccgtccagggcgccgacctgctgggctacgctgccggcacggccaagggcatggcgccccgcgcccgcgtcgccacgtacaaggtgtgctgggtcggcgggtgcttcagctccgacatcctcaaggccatggaggtcgccgtgacggacggcgtcgacgtgctctcgctctcccttggcggcggcacggcggagtactaccgcgacagcatcgcggtgggcgctttcagcgccatggagaaggggatcttcgtgtcctgctccgcgggcaatgccggcccgggcgccgcgacgctgtccaacggcgcgccgtggatcaccaccgtgggcgccgggaccatcgaccgcgacttccccgnctacgtcacgctcggcaacggcaagaactac

SEQ ID NO: 76229 - DNA, 309 bp, Zea mays
  Clone ID: LIB3079-021-Q1-K1-E4
gggacgcacacgtccagcaccgcggctttctgcgccgtgcaaagcgccgacctgctcgagtgactctaccggcacggtcaagggcatggcgcccctcgcccgcttcgccacgtacaacgtgtgctgagtcgacgggtgcttcagctccgacatcctcaaggccatggatgtcgccgttacatacggcgtctacgtgctctcgctctcccttggcggcggcacgtcggagtactaccgcgacagcatacatgtgggcgctttcagctccatggagaaggggatcttcgtgtcctgctccgcgggcaatgc

SEQ ID NO: 76230 - DNA, 392 bp, Zea mays
  Clone ID: LIB3079-021-Q1-K1-E5
ggagcaggacatacagatgatgctcgcggccgacgtccacctcggcaccaagaactgggatttccagatggagcggtatgtctttaagcgtcgcaccgacggcatctacatcatcaacctgggcaagacatgggataagctccagctcgcggcgagggttattgttgccattgagaacccacaagacatcatcgtccagtcggcccgcccctacggccagcgtgctgtcctcaagttcgcgcagtacactggcgcccatgccatcgctgggaggcacacccctggtaccttcaccaatcagctccagacctctttcagcgagcctcgcctgctcatccttactgacccaaggactgaccatcagccaatcaaggagtctgctctggggaaca

SEQ ID NO: 76231 - DNA, 419 bp, Zea mays
  Clone ID: LIB3079-021-Q1-K1-E6
cccacgcgtccgataaattttgggctagcctttctgagaaaacggggatttaaggcggtgcaaactccctttttcatgagaaaggaaactatggcaaaatgtgcccagttggcccagtttgatgaggagctttacaaagttacaggtgatggtgaagacaaatatctcatagctacatcagagcagcctttatgtgcttatcacttaggtgatagaatataccctgctgaacttccaatcaaatatgctgggtactccacatgcttccggaaggaagctggttcgcatggaagggacacagctggtatcttcagagtccaccagtttgaaaaaatcgaacaattctgcattacaagcccaaatgacaacgattcttgtgagatgcatgaagagatgctaaaaaactcagaagattacta

SEQ ID NO: 76232 - DNA, 397 bp, Zea mays
  Clone ID: LIB3079-021-Q1-K1-E7
cgcatacgtcctactaatgctgtgtatctgttatctggatgtctgttctcgaaagcggggcctgcatggacgaataagagataggatgcatgtgcggaatgcgaccatgtctgaatgacagatgaggatgctgacgaagctgctactgatacctaagccaatggtgttctaaatgaatctgatcagcctttatgaacgtatgacttacgagatagatgagacatggcaaagcaccgaaccaaacatacctggtgctcctcatacaaccggaatgtacctttgtcgtatggaaaggacacagctgctatcctcagagaccaacagtttgaagaaatcgaacactgctgcattacaagcccatatgacaacgattgttgggagattcatgaacagatgc

SEQ ID NO: 76233 - DNA, 410 bp, Zea mays
  Clone ID: LIB3079-021-Q1-K1-E8
cgtcagcctagcaattagctcatcgactccagattggagaactcgacaccatggaggggctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcagcagcgtcggcagcccgttcctgggccagtgcgtcgagttcctgaggcaccagtgcagcccggcggcgacgccctacggctcgacacagtgccaggcgctgcagcagcagtgctgccaccagatcaggcaggtg

SEQ ID NO: 76234 - DNA, 53 bp, Zea mays
  Clone ID: LIB3079-021-Q1-K1-E9
aaacaaagaacaacagacattactaaataaatacagggccaccactctataat

SEQ ID NO: 76235 - DNA, 385 bp, Zea mays
  Clone ID: LIB3079-021-Q1-K1-F1
gttcttcacattgaggctccaaatatgtctatattggagctgaagggttgtggtgtgctggccaaggcttccatcaattgccctcgcttgacttcgttggatgcctctttctgcaggcagcttgtggatgattctctgacttgtatgtcagaggcatgtcctatgattgaacatcttattctgtcatcatgcctatccattggcatcgatggattgtcctcattgcattgccttcataagctgaccttgcttgacctgtcttatacctttttggacaacttgaagcctgttttcaacagttgtctgcagttgaaagtgttaaaactttcagcttgcaagtacctcagtgactcatcattagatgccctctacagagagggtgctc

SEQ ID NO: 76236 - DNA, 391 bp, Zea mays
  Clone ID: LIB3079-021-Q1-K1-F11
cccacgcgtccgcacacagcagcctttttgttctccccgcgagcgctctctttctctatcgactggcgacgactccgccaccgccgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccagagaggccgcgagggagggccccagggaagacagatgaggattgcggagtgcttggttggtgatgaaaccggcatcattgtcttcactgcaagaaacgatcaagtggat

SEQ ID NO: 76237 - DNA, 402 bp, Zea mays
  Clone ID: LIB3079-021-Q1-K1-F12
aaaaacataccacacaacaaaactatttgttctacccacaagcactatatatatctggggactgacaacgactaacggcaccaacaacaatctacacagagaagcccaagtcttcgccaacgactagcatgcgggttagagaggaagaaattgcatccgaaacaatggccgcagattacggcgctcgcagacaaccaagcttcaccaaggtcgaccaactgcgccctgtaacaaacggacacaacctcatactcaaagttgttgactccaagatggtcgtacagagaggccgccagtgacggccccagggaagacagatgaggattgcagagtgcttggttgatgatgaaaccggcatcattgactttactggaggaaacgatcaagtggatgtaattaggc

SEQ ID NO: 76238 - DNA, 390 bp, Zea mays
  Clone ID: LIB3079-021-Q1-K1-F2
gcgcagcatcatgatcaagcgtcccgcggggtacccgtcttcgccgaggagcgcggcaagcgacgccgccggcctctccactagggactaccccgcccatctcgccgtttgccggcgctggtggtcgcttcagaaggaaatcatcatccgacgcatatgagagggcaacccctccagggacgaccagccaccctcctcccttcgaagtgtgaaccggctgcaccctcacacttgttttgctccttgacaagcatctcttcacctataataaggtagaggcagggaggagagaagacgacatcaagaggggaacggggatgagttgcgggtttacctctgctgtgatatattggaagtgccactatgggtattggtcccccctatctacta

SEQ ID NO: 76239 - DNA, 440 bp, Zea mays
  Clone ID: LIB3079-021-Q1-K1-D8
ccgcgacgaaccactcctccgatgtaacacggctgaaggagcaatgtaccttttccctcagatccatctgccacagaagtcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcaggaagataaaatccccgcggtgatcacccgcttcaaggctttccatgaggcgttcatggctgagtaccgtgactgaactgttacagtggctgagtaccaccgtgtagaccgaaacagaataaagctcccccctctctctgtgtctgtgcgtgtgtgtgaactgatctctgaatggacgaacaatgtactctgttggcgcctttaatggcaat

SEQ ID NO: 76240 - DNA, 405 bp, Zea mays
  Clone ID: LIB3079-016-Q1-K1-A7
cttttctacttgggaccatgttcttctaccagactgaagtgctaagactagactcctcggttatcggcttatcgaaggtgtttgggcaagtggctctattggcttggagcatgtcatacaacaagtacttcaagacaatgtccgcccggaagctcctgtcagttctgcagttcgtcacagcgctcgtaatgttgtcagatgtgttgttcgttcagggagtatacaggaaggtgggaattccagactccatatacacgattgtcttctccgggctgctcgagggccttatgtttttcaaggtcctgcccttcagtgttcatgttgcaaaactttgccctgctggctgtgagggatcagtgatggcctttgtcatgtctgcgcttgcccttgcgactatcgtcagtg

SEQ ID NO: 76241 - DNA, 442 bp, Zea mays
  unsure at all n locations
  Clone ID: LIB3079-016-Q1-K1-A8
aacaatttcaggcaaagtaagaaatatccaagataatggcttcatagatgaagttcggactgggcagccatccgtgctcacagctgctactgccaacggagcaagacatgacaaatgtgcaaataataccagacatggttatggtggaaaacaacaggggaggaccactgggacgacatacctttccagaagatgaaccaactttcactgggcgatgatgctgttggaattggaaaccatgcgagtggcgatgatgcggttggggaaaccatacgagtgacgatgctttggcttcgaaatgatggtgaagatgacctggattaaagttattctagattcattttttattttgcactattggtcttcacagagcctgtatggttggnggccttgatttggcaaagctgtactgatatatccctaccccaagaatcagaagcct

SEQ ID NO: 76242 - DNA, 53 bp, Zea mays
  Clone ID: LIB3079-016-Q1-K1-B1
aaaaaaaaataaaaaaaaaaaaaaaaaaaaaaaaaaaaaaaggtcggacgata

SEQ ID NO: 76243 - DNA, 265 bp, Zea mays
  Clone ID: LIB3079-016-Q1-K1-B10
cccacgcgtccggggatgacatgccgtggccaatgcaaacaattgttttgtgggagcggcggccgttaagttgttgtcagtgtgagagtggtgatgcgatcatgatcctttttacctagagtagctcccctttgtgttagcctgaacgatgttttgcaagccgaatgttccgaactctaggattatttggattacaaaacttacatattccatcctcaaaaaaaaaatagaatatgaaaaaataaaacaaacattgggcaatcgt

SEQ ID NO: 76244 - DNA, 430 bp, Zea mays
  unsure at all n locations
  Clone ID: LIB3079-016-Q1-K1-B11
gcgggccgccctttttttttttttgtttgaatgcaaccattttcaagagttgcatacgaaaagctcaaatacatcgaacggcagcgagtttcaagagttgtacacataagatggcaacagagcagttattcaaacagataagaacagtagcaggcaggagtacaattgtacaagtactagtaacaaaaaaaaacgatctgtgacaaagaccaaattgattgattcatcataatttcggtaggccgcaacttattttgagacaccgtcgacatcaagtaggtgcagtaactcttagtcctaactccagcttacttcttcatctccgcagaggctcggctgcataagctgatctttccctcatgcagcagctttcgacgcaatcattcctgtcttccgggcgtaggcaaagatccctcccgnctcaattaca

SEQ ID NO: 76245 - DNA, 433 bp, Zea mays
  Clone ID: LIB3079-016-Q1-K1-B12
cccacacgtactctatattcatcactatctcgaggtaattatggaagcttgagcatcgatccttatggcggcgatgaacagcagcacaatcgaagagcttctcactggctgatgccattctgtcctcactgtctccatgctacaaagccggcggctgcattacgaaacccaagaagttaccgacgacaccgagaaggccatacttatcaccctattccgaggaccaccataactgccgcttgatctgtatctctaagggactcaaggaccgtggctgatgtgacgaaagcgtgaagcacaaagtgtgctgctgctcccattagaaatataatagcgtatgttatgttgatgcatatatatatgcatcattcatctacctgtgaggtgcaaaattctgaataaaacctgaataaaacctgattgagcacaaaaa

SEQ ID NO: 76246 - DNA, 280 bp, Zea mays
  Clone ID: LIB3079-016-Q1-K1-B2
gtcaaatggtcccataatatctgtcccaaagtttggcatacatcggcccatataccttacttggaatgtcgacaaatgcggggattgtgttgctgtcctcgcgcaccatgaagtcaccaactccctaacaatcatcggctattctattcttcaaactgtcaatattcttatagcggctcatgtaccctattctcatcatccatcgatgcatctcagcctcttatgatacattgtactgctcactctgctcttcatggttatgtgacaccaggcctcttac

SEQ ID NO: 76247 - DNA, 315 bp, Zea mays
  Clone ID: LIB3079-016-Q1-K1-B3
gtgaaatcaagcccccaaaactgaagactgaagatccgaacaaatcttatgtgcaaaggccagtaaagcgaaactgagtggaatgtcagcaatcaaagaacatccggtagcggcctttcatctcaccagattagagctgcaacccttcaatgttgtacttgtcctgaatgtggtaaggttcaattacgcccgctgtgaaacagaacggaacagagcagattttacccgtattgctagctagagtgatttggcatgatgtactcatcatacgtctgaagattttactgggaaaaaaagtacaaacttttccggtgg

SEQ ID NO: 76248 - DNA, 443 bp, Zea mays
  Clone ID: LIB3079-016-Q1-K1-B4
atttactggcaagggagaaactcagtctatgaaacaattgtcaggcggacagaagacggtggtcgcactaacactgattttcgctatccaacgatgtgacccagctccattttatctgttcgacgagatcgatgctgctctggatccacaataccgaacagcagttggaagtatccttattgtttgttctagtgtctagctatgcacatgatcaatgcctcttctttgtgtgtcaatagtcctgctgctttccttaagtttcattccagatatgatccgccgtctagctgacatggctgacactcagttcattgcgaccacatttcggccagagattgctaaagtggcttgatagatatatgccgtgagacacaagaatagggtgagcaacatcgacgtggtgtccaaggaggaggccctggacttcatcgagcgtgatcaga

SEQ ID NO: 76249 - DNA, 355 bp, Zea mays
  Clone ID: LIB3079-016-Q1-K1-B5
gccacacgtactctctattcatcactatctctacgtccttatggaagctgggtcaggtaaactcatagctgcgttgaacagcagcacattccacgagctgctcacatctgatggcattctatccttactgtatacatgctacaacaccagcatgtgcatcttcaaaaccccagaatctacctacaacaccgagaaagctatacttatcaccctatttctaggtccatcataactgccgcttgacctaactcatttagagacacaatgaccatcaattatgtgccgaaactcttaatcataactccagctgactttttcattaacaatattatttcgtttcttaagctgatcctta

SEQ ID NO: 76250 - DNA, 347 bp, Zea mays
  Clone ID: LIB3079-016-Q1-K1-B6
cccacgcgtccgcccacgcgtccgaacaacgccatgtccggtggctgtggctctgggtgctgtggtggatgcggcagcggcatgctcatcgaaggctccaaggccaacaaagccatgtccggcggctgtggctctggttgtggtggtggttgcggcagcggcatggtcatcgaatgctccaaggccaacaacaccatgtccggcggatgcggctacgggtgcggcggaggcggcggctgtggtagcggcatggctatcgaaggcttcaaggtcaaccacgccaagtctggtggctgcaactctggctgcggtggtggtggctgcagcaccctgtgcagctccagctc

SEQ ID NO: 76251 - DNA, 164 bp, Zea mays
  Clone ID: LIB3079-016-Q1-K1-B8
aaaaaaaaaaaaaaaaaaaaaaaaaaaaaaaaaaaaaaaaaaaaaaaaaaaaaaaaaagaaaaaaaaaaaaaaaaaaaaaaaaaaaacaaaaaaaataataaaaaaaaaaataaaatcaaaaaaattcaatttaaattgccgttaaattacaacaataatacat

SEQ ID NO: 76252 - DNA, 97 bp, Zea mays
  Clone ID: LIB3079-016-Q1-K1-B9
aaaaaaaaaaaaaataaaaaaaaagaaaaaaaaaaaaaggcaaataatatagggaaaaggaaaattaaatacgcgagcattccacaacatctcgtgc

SEQ ID NO: 76253 - DNA, 429 bp, Zea mays
  Clone ID: LIB3079-016-Q1-K1-C10
aatatgcatatgacaactcgtcccagggggtaacccctaatgcgtaccttggcgtggggtgttgtgggcggggtgctggggctggtttgctgcacatgccagatttcctcacatcaatgacttcaacaccttgtggattcctcacgccaaaatgcgctttgtgcaactggcctacgcctgctattggatcataaagatggcataattattgcagcatgtataatgctgatttggctgtgcatgacgagggctctccacgcacaatgtctgcgatccgtccaagaggcattgatctgaaagatggccccctgtttgatgctcttagtgcaaaagtccattgataaaactttgaggaccgtatatgtgaaggagctgccactgcaaagtcttgatggaatgcacctgaactttttgatatttacatatttt

SEQ ID NO: 76254 - DNA, 415 bp, Zea mays
  Clone ID: LIB3079-016-Q1-K1-C11
cccacgcgtccgcacaggcggactcgcggactcggggctcgtaccaacaggaaaaaaggcccagaggcagtgccgtgaccgattcgagacgcaagagaaggatcgagacgaggcggcggttttccggggcagcatcgtctcggccacgaagatgtcttactcaaggggctcaagtgaaaggtatggatctcgctcaccttactcgagaagcacaaggtaccgaagtcgctctaggagtgtcgactctagtgatgctgaaaaccctgggaacaacctgtatgtgactggtttgtcggctcgtgtaacggatcgagatctggagaagcacttctccactgagggtgaggtgattgatgcaagcgttgtgtatgatccttggacaagggaatcacgggggtttggttttgttaccatg

SEQ ID NO: 76255 - DNA, 441 bp, Zea mays
  Clone ID: LIB3079-016-Q1-K1-C12
cacacgcagttagacaacttgtcatgtcttctacccaatctgactatcatggcttgcgtagctcaagtaaattccttaacaatgttagacttaagactgccttcaagacaagctctatttcatcaaaggtgcactagcttcaatctcaattatagaccactaaacaagataaagatagacttatgcattaaattgaattcttaaaggctacatcacatgaatttatgactactattgctaatcaaacaattgagatcgagaatttaaagacgtcgttagcataaaataatagccttcttcgtcagatactaagcaccaatcgaggcatgtctcctccttaagattgttgcatataatcgaccatgccaatgttacattcaacaacactggactacttttttattagttgtctatatagtctgatcataatgatactataaa

SEQ ID NO: 76256 - DNA, 434 bp, Zea mays
  Clone ID: LIB3079-016-Q1-K1-A6
ctcaagctggactttgtcattagctttccggaccatggatttcacctacgcgttgatccttggtcccagaggctccgtctcgtagagatttatgatgttaagagattgcaattgcgatatgcgacatctttaattggtggcccgtcaacattagccacttttgcggctgtgtatgcactctttggaccaactttccctggcatatatgacaaagagaggggaatttatacgctgttctacccaggtttatccttcgcattccctattcccagccagtatacaaatctattcactaatggagaagtggcagatttgccactggaattcccagatggtacaacccctgttacttgtcgggtttgtatatatgatagctcgacagatagcaaggttggggttggatctttgatggacaaagcaatggtacctgcact

SEQ ID NO: 76257 - DNA, 434 bp, Zea mays
  Clone ID: LIB3079-016-Q1-K1-C3
ggaaaggttgaggatgttgatgagaaggaagagaaagaaaagaagaaaaagaagatgaaggaggtttctcatgagtggtcattggtcaacaagcagaagcccatatggatgaggaagccagaagaaatcacaaaagaagaatatgctgccttctataagagcttgacaaatgactgggaggagcatctggctgtgaagcacttctctgtggagggtcaactggagttcaaggctgttctctttgttcctaagagggccccctttgatctctttgacaccaagaagaagcaaaacaacatcaagctctatgtgcgcagggtgttcatcatggacaactgcgaagagctgatccctgagtggctgagcttcgttaagggtattgttgactctgaggaccttcccctcaatatctctcgtgagactcttcagcagaa

SEQ ID NO: 76258 - DNA, 392 bp, Zea mays
  Clone ID: LIB3079-015-Q1-K1-H10
gcgcggacgcgtgggcggacgcgtgggctgtctccagttgacagcaccatccagacgatggatgcgtgagcttatgggcgtaagacctggctcaaggctcctacataccagacagacaatgtgccgtatgtgtcagatgaacctcaaagcgataagtgggctagggttctatcagatgccacattcgacgtaccaacgaatcctgacatcctacttaatgcgttcgactcagctgcaaacgttcaacccgagaaggtaacagacatatggaatctcaggagaatactcaacacgtcttggcataccatcaaaatccagagatcttcgtgcgtcgaacgatctaagctgtgaaattaagtacgcacttgaccacttggataaagcacacttac

SEQ ID NO: 76259 - DNA, 428 bp, Zea mays
  unsure at all n locations
  Clone ID: LIB3079-015-Q1-K1-H11
cctacgcccgtttctctctcgtcgcgcatcatcagagcacaagcgaggaacccagtcgagtcccgggaatggagtgcgtattgggcgtggttggccgcgacttcgcgctggtggcggccgacacctccgccgtgcagagtattctcgtccacaagaccgacgaggacaaggtgatggtgctcgactcgcaaaagctgatgggcgcttcaggggagcctggtgatcgggtgcaatttacggagttcatacagaagaaccttcacctgtaccagttccggaacaccatcccgctctcaaccgccgccgncgccaacttcacacgcggcgaactcgccacagcccttcgcaagaatccatatatggtcaatattattcttggtggttatgataaggatgttggtgctttcctctactacatcgactacatt

SEQ ID NO: 76260 - DNA, 409 bp, Zea mays
  Clone ID: LIB3079-015-Q1-K1-H12
cgcacgcgtccgcccacgcgtccgcccacgcgtccgcccacgcgtccgcggacgcgtgggggctggatccatactagctacctgaaggatctgtggccagactcgcggtacacttacaggcttggccacaggctaatgaatgggacccgcgtctggagcaaatcatacagcttcagagcatcaccttaccctggacaagattctttgcagcgagttgtcatatttggagacatgggaaaggcagaggcagatggttcaaatgagttcaacaacttccagccaggttcactgaatactacgtaccagatcacgagtgacatagaaaacatcgacatggtggtccacatcggggacatctgctacgcgaacggctacttgtctcagtgggatcagttcactgcacagatcg

SEQ ID NO: 76261 - DNA, 347 bp, Zea mays
  Clone ID: LIB3079-015-Q1-K1-H2
cccacgcgtccgcccacgcgtccgcgtacggcggcatcaagtgcgccatggagacgcagcccatgagcaacaaccggacggggcgactggacatcggcacggattggcgcctgcacggcgtggcgcgcggggtgctggcgcgctacctacgccgcgtgccggtgcacttcgtcgacatcacggggctgtcggagctgcgcaaggacgcgcacaccttcgtgcacacgctgcggcaggggaagctgctcacaccggagcagcaggccgaccccaagacctacgccgactgcatccactggtgcctaccgggactccccgacacctggaaccactttctctacgcgcac

SEQ ID NO: 76262 - DNA, 421 bp, Zea mays
  Clone ID: LIB3079-015-Q1-K1-H3
cgttctcacccccttgcaagcaacaatcgttcaccgatcgatccagtgcgtcctgcatggaaactgccgccgtggccgcctccagtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgttgagaggcacgccaacgcggtctcggcggcggcggtcgacaaggccaagcgcgtctgcgccgaccacccgcacgtcaaggtggagacgacggtggagagcggtgacccgcgggacgtcatctgcgacgcagccaacaagat

SEQ ID NO: 76263 - DNA, 338 bp, Zea mays
  Clone ID: LIB3079-015-Q1-K1-H4
cacactcttgcaccgagctagcagccatagatgtgtgaccaaacacctggctctttgcgctccttgttctctttagcataggcatgggcatggccaccgctgctgcaaaccgcaaactgggttatggccccgggggaggaggtggcggtggtggtagcggtggcggtggaggcggtggttacggaggaccaggctatgggtccggatcagggtatggtgagggcggcggcagcggaggtgctgctggagggtatggacatggtggtggcggacgcctcggtcttggtgagggtgcgggagctggtggctctgggtatgggtccgggcaaggatctggc

SEQ ID NO: 76264 - DNA, 374 bp, Zea mays
  Clone ID: LIB3079-015-Q1-K1-H5
cccacgcgtccgcgagaatgttgcttttaagaaagaggaagaggaatttaggacagggcctctgtcagtactaatgatgagtgttaagaacaacacccaggttctcatcaattgccgcaacaacaagaagctgcttggccgggttcgtgcttttgatcgccactgtaacatggtgctcgagaacgtgcgggagatgtggacagaggtccccaagactggcaagggcaaaaagaaggctctgcctgtgaacaaggatagattcatcagcaagatgttcctcacgggcgactcggtcatcatcgcgctgaggaaccccaagtgacagcccaaccggaagccatgtctatgttgaaaactgtagcttatgatgtatg

SEQ ID NO: 76265 - DNA, 189 bp, Zea mays
  Clone ID: LIB3079-015-Q1-K1-H6
caggagttgctatagaatcatcctgaccttgggacagctggtgtgttcatcatctggtctgatgagtagctcatgtgtcgtattcataggttaagtatatataggtcctagtatataattttgccgcggcggtcacatgtcatgcatggaacttacttaaatgtgtctcgatttatttgtcatctccct

SEQ ID NO: 76266 - DNA, 399 bp, Zea mays
  unsure at all n locations
  Clone ID: LIB3079-015-Q1-K1-H8
cccacgcgtccgcgtgtacacggtgtacgtgcggacggggtccatctggaagggcgggacggactcgaccatcggcgtgacgctgctgggccccgacggcacgggcatccggatccgggacctggcggggtggggcggcctcatgggcgccggccacgactactacgagcgcggcaacctggacatcttcagcggccggggcccctgcatgagccaggcgccctgcgccatgaacctcacctccgacggcaccggcgcgcaccacggctggtactgcaactacctcgaggccacggtcacggggccccacctcgggtgcgcgcagcagctcttcaccgtcgagcagtggctcgccaccgacgcgtcggcctaccgnctgtacgcggtcgtcgacaagtg

SEQ ID NO: 76267 - DNA, 427 bp, Zea mays
  Clone ID: LIB3079-015-Q1-K1-H9
gaggaactccgcaaggttaatgttgactcgccggttcttgactacaaggatacagttgacgagtgtgcaaccctggacgtattcctaaaaacaccacaggcgcaggcctgtgccgaggacattgccatatggatgaagaaatatatatccctcagagggcatgagttctcatattagttgtagcaaaaaccatgcattgtgaaataggccctttgcagggaagcgtcaatgtgttcttttcaactggtggaaagaaggatgttggattgcagtcgggtaaaccagctagcttaatgctgagtactgagtcctttaggccctgttcggtttcaccggaatagaccaagatttattccagctcatcaaaatctatataaattagagaagtaatccggctaggaatcaatccgaggctcaaatccataac

SEQ ID NO: 76268 - DNA, 239 bp, Zea mays
  Clone ID: LIB3079-016-Q1-K1-A1
gtcctgctacaccacatccacacgttcactgtagcgagagcttatcgtcctcggcggggaagatggtgtctatgaagctgcagaagcggatcgccgatagcgtcctcaagtgtgggaaaggcaaggtctggcttgaccccaatgaattcagacagacttccatgggttactaccgacagaacattcatactttagctaaagcttggttcatcatcaggaaacctcaattggatcagttt

SEQ ID NO: 76269 - DNA, 370 bp, Zea mays
  Clone ID: LIB3079-016-Q1-K1-A10
attacctcttcactagctccagagggtatggtaagcttgatcatctttccttatggcgcggatcaatagcatcacaatcaccgcgcttctattgtctgatgccattctgtcctcactgtctacatgctacgaagccggcgtctgcatcacgaaacccaagatgtcaccgccgtctccgagaaggccatacttctcgtcctattccgaggaccaccagaactgcctcttgatctgtacctccacgggtctcaaggacggtagctgatgtaactaaagcgtgtagcacaaaatgagctgctcgatccattagatatataatagcctatgatacgtagatgcatatatatatgcatcgtccatctacatgagt

SEQ ID NO: 76270 - DNA, 255 bp, Zea mays
  Clone ID: LIB3079-016-Q1-K1-A12
tccacacccacatgtgctactacaacttcaacgacatcatccactctatcatctacatgtacgcggacctaatcaccattgacaactcgctgttctacaagaagctgatctccaaattcctcgaggtcctcaagtacatcgctttcatcgaccttcgtgtttacgacattcactcccccactatcccgtccgctgaggagatcgtttaccacatctacaagatgctaacggtgcttgacaccaacattctctggg

SEQ ID NO: 76271 - DNA, 416 bp, Zea mays
  Clone ID: LIB3079-016-Q1-K1-A2
ccctgttaagcaaaccactagctcttcctcacgagagcagtcagatgatgatgacatggaaggcgatgctgagacaaatggaaatggaaaccctgttcaacaaagacaacagagaaggaagcaatccaaccgggaatcagccaggcgttcgagaagcagaaaggcggctcacttgaatgaactggaggcacaggtagcacaattaagagtcgaaaactcttcgctgctaaggcggcttgctgatgttaaccagaagttcaatgaagctgctgttgacaatagggtgctaaaggcagacgtcgaaaccttaagagcaaaggtgaagatggcagaggactcggtgaagcgggtaacaggcatgaacgcattgtaccctgccgtgtcagatatgtcttgcctcagcatgccattcaatg

SEQ ID NO: 76272 - DNA, 447 bp, Zea mays
  Clone ID: LIB3079-016-Q1-K1-A3
gccgaagcgaagtgcatatccaagattggtagagaggacacaaaaattactgcatgggaaaggattcaaaaagcaaaagctgaggcagcaattcagaagttaatgattaagatggagaagaaaggatcatcttcgctggataagattttgaacaccctcaagtctgctcagagaaaagcccaggtgatgcttgagcatgagcttgatgcagtaacagcaaaccaagatggaaaaggctctaggaaggcaaaaaagggagcacagcgtagcaagaatggccaaatcagttccctgagtggctgcttcacttgccatgctttttgatacatgtaattccaaaactgagaatcaggatctgagaaattccttcgtactgtctacatcaccgtcatgttctccacatcgaaatctaggtgaacttcagatatctatcagatgtcagtacat

SEQ ID NO: 76273 - DNA, 411 bp, Zea mays
  Clone ID: LIB3079-016-Q1-K1-A4
gggatcttatcagaagtctaccggcaaactagtcattcccttggagaatggaaacaggcttaccttgcaacttgataaggaagcagacaaggaattcatgtccagcttggcttcccttcttaagactattgaaagggcgatccaggttcatgaagatttctcaggtgtcgtgaaccctgcagagttattagaatgtcacttcacagggttgaacgctctggaaaatgaatatgggtctggtgaaattgttaagcagggaacagaaatagttcagagagctgtcaccaaatcattccagtccctacatgaagcatacaaagggaaacatgttgggctggtaatatccacaaatgacgctccatcatccttaggatccataattgacgcaccatcttcactgcacatttcaag

SEQ ID NO: 76274 - DNA, 273 bp, Zea mays
  Clone ID: LIB3079-016-Q1-K1-A5
cccacgcgtcctaaaaaaaaaaaaaaaaaaaaaaaaaaaaaaaaaaaaaagggaaagggttcctataaggaaaaaaccaagaaaaaaaacacaaacatacaacaacataaatagggccaaagggcctcctaaatccaatttaatgtccgcccccttacaactttatacctttaaaaatccctgacttacttcaaattaactggcttgcattacaccccactttaattggaaaaacccttacctaacccaacttagtcgaccgactttccaaac

SEQ ID NO: 76275 - DNA, 401 bp, Zea mays
  Clone ID: LIB3079-015-Q1-K1-H1
ccaaaatccaaatcaccacatcccgccattaatttaaggggtttttatgtccaccgcggccgccagcgccaactaaacccgcgacgacggtcgaccatggcgtcctcgctgctctcctcccccgctaaacccaccatcaccaccaccaccaaaacgaccccggccccaagacccgcccgctccgcccatgtccatgtcctctccgccgtccgctgcctccgcctccgcctccgcgcgtcgtcgcagcatcctccgccttcgcccaccccgcggtcgcggcggccggattacgtcccgaaccgcatcgacgaccccaactacgtgcgcatcttcgacaccacgctgcgcgacggggagcagtcgccgggcgccaccatgacgagcgctcagaagctcgtcgt

SEQ ID NO: 76276 - DNA, 440 bp, Zea mays
  Clone ID: LIB3079-015-Q1-K1-F3
ctgaaaccgctccacgccctcccccttcgcgcatagccagccaagccaaccagccaggcagaagaggaaccggggagcggcagctgcagcggccgagggcggagcacgcgaggcatggatagataccaaagggtagagaagcctcggaatgacacgccaatcagccagaatgagatcagaatcactactcaggggaggatgaggaactatatcagctatgggatgtcgctgcttgaggaaaatggacatgatgagattagtatcaaggccatgggacgggccataaataagacagttatggttgttgaattgatcaagagaagggttggaggtcttcatcagaacactgctactgaatctgttgatatcacagacacatggggaacctttggaagaagggccttttcccactagagacaactcgccatgtgtcgatgatc

SEQ ID NO: 76277 - DNA, 368 bp, Zea mays
  Clone ID: LIB3079-015-Q1-K1-F4
gttaacgaacttttggagaaatgccacccatttttcatgtttgacagcattgcatcacttgcgagtgctcaaaacatgcgtgagctctatagattggttctagtcgatacaccactggccccttacttctcagagtgcattacatctgaggatttggatgacatgaatattgagattatgaggaacactctctacaaagcatatcttgaggacttctacaaattttgccagaaactaggtggtgcaacagctgatatcatgtgtgatctcctttcatttgaagctgacagaagaactgttaacattacaataaatagtattggtactgacttgacaagagatgaccgcttgaagctgtactccaactt

SEQ ID NO: 76278 - DNA, 437 bp, Zea mays
  Clone ID: LIB3079-015-Q1-K1-F5
cttccccagccagctagggtttgcagatgacgaccgcggcgcgccccacctgggcgggggccaagggcggcaacgagcaggggggcacccgcatcttcggcccctcccagaagttctcctcccgcgacctcgccgcgcacacctccctcaagccaagaaaagacggtcaacagacccaagaggagttacagaagaggaatctcagggaggaacttgaggaacgtgagcgcaagcactactcttccaaggataagtcctatgccgaagaaagagaccggcggaaaagctctagccatctactcttagaaggttcaaagagagagacagaggataagatagttccacgagaaatcgatgctgatgactccgatgtggagcctaaaagcgatgacgagagcgatgaagatgatgatgacgacgacactgaagctctaatg

SEQ ID NO: 76279 - DNA, 398 bp, Zea mays
  Clone ID: LIB3079-015-Q1-K1-F6
cttctgcttgctctggggggaaggagtagagagagagcgagagagagatctagtagaggggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgtgtcgtctgagccagcagcacgggctgtcaagcaagggctccaacgaggtg

SEQ ID NO: 76280 - DNA, 421 bp, Zea mays
  Clone ID: LIB3079-015-Q1-K1-F7
cccacgcgtccgcgggaagcctttccttcgctccgcttcctacctcaaggaggccctgctcctcgcgctcaccgacggccaccaaggctccactcacctatcctcccctctcgacgtcgccctcaagctcggtgcatacaagtccttctccgacctctcgcctgtgctccagttcgccaatttcacggccactcaggcgctcctcgacgagatcgcctcaacaacttcatcttgtatccacattattgatttcgaccttggtgttggcggccagtgggcttccttcttgcaggagtttgcacaccgccgtggaactgggaacgcccccctgccaatgttgaagctcacagccttcgtctcaagtgcttcccaccatccccttgagctgcatcttactcgggagaacctcacgcaatttgct

SEQ ID NO: 76281 - DNA, 414 bp, Zea mays
  unsure at all n locations
  Clone ID: LIB3079-015-Q1-K1-F8
cccacgcgtccgaaaggccaaagcggtacgggagccacagagatagctagcaagaagccacagatggcggcgatagcggcggccacccaggcggcggcgacggtgctactgctcgcggcgctggtgctggcggcgggaccgggcggggcgcgggcgcagtcggcgtcgccgtcgagccagtgcacgtcggcgctggtgagcctgtcgccgtgcctcagctacatctccgggaacgtgtcggcggcgccgccgtcgtgctgcgcgcagctgggcaaggtggtgcagtcggacccgcagtgcctgtgcgtggcgctcagcgcggacccggcgtcgctgggcctcaccgtcaaccgcacccgcgcgctgggcctncccgacgcatgcaaggtcacgacgcccgacgtcagcagctgc

SEQ ID NO: 76282 - DNA, 422 bp, Zea mays
  Clone ID: LIB3079-015-Q1-K1-F9
gtgcaagcagcggagtgggcgttattttctgatcaaataattttgcctatggcacattgtgtggagactttgacggatctttgcctgcttttctatgcgatgtaagctgctgaaacctgcactcatcaaatgttgtgtatgcagatggtaccatgcatttgtttccctgaatggcttcaaatgaaatgaatgttttttttaaaaatataaactgaactatgtggaagtacacatatcacaaacacaagagatgctaaagcatttgcactcttatctgacgagggtattgcaaaaggagttaggaggataacagtcgtgactgctggatgtgccacccaggctatggagttggcataatctatcgattctgatatcaataaagcatcttagttggagggagctttgtttgaaaagaaaattgc

SEQ ID NO: 76283 - DNA, 165 bp, Zea mays
  Clone ID: LIB3079-015-Q1-K1-G1
aaaaaaaaaaaaaaaaaaaaaaaaaatttaaaaataaaaaaaaaaaaaaaaaaaaaaagaaaaaaaaaaaataaaaaaaataaaaaaaaaaaaaaaaaaaaataaaataaaataaaaaaaaatcacaaaaaaaaattataaataacatacaattaaaaaaaaata

SEQ ID NO: 76284 - DNA, 429 bp, Zea mays
  unsure at all n locations
  Clone ID: LIB3079-015-Q1-K1-G10
gatctctctcccccggctccggcgatggcttcgccttacgccggcggcgtgcagcctgcctctcgcgctggggcggtgcagcagcagcagcagaaccactctctggcgttccgcgtgatgcggctgtctcgcccctcactccagccagacctggccgctctgctccgcttcgacccacgcgacgtcttcctccctgaggacgcgctcaccggctccgacccgtccgctgccgccaaattcctncacgggctnctncaccctgcggactccgncactgccgtccctggagacttcaccttccgcgaccgcttcctcctccgcgacccagccgacgcgctcgctctgccgggcctnctcgtcctnccccagntcgtcggtgcgatctatctgggcgagaccttctgcaggtacatcagcatcaacaatagc

SEQ ID NO: 76285 - DNA, 423 bp, Zea mays
  Clone ID: LIB3079-015-Q1-K1-G2
aaatgggagttctcacaggcgaatattaagaatgtcaatgagattctgtctcactatccaagggactacaagcaatctggtattattccgctgcttgatcttgcacagcagcagcatggtggatgggtgccagttgcagcaatggatgctattgctaaaatcgtcgaagttgcaccaatcatggtttatgaagttgcaaccttttataccatgtttaacaagactaaggttggtaaataccaccttctggtgtgtggaactacaccttgtatgattcgtggttcacgtgaaatcgaagagacgacgttggagcaccttggagttaaacgaaatgaggtgaccagtgatggtttatcttctgttggagaaatggaatgcatgggtagctgtgtgaatgctcctatgattgctgaggcttactac

SEQ ID NO: 76286 - DNA, 451 bp, Zea mays
  Clone ID: LIB3079-015-Q1-K1-G3
atcaggtcacctgcaagaaaatatgtttagtcttgggagagaaccgagtagtctgtcgcctgagccagctaaaggaaatgattccttggatttgtggattaccagcaacttcaaggaatctaaaagcaatgatgttgggagaactaatgcctcatctgatggatggcaggattttgccagttttgatcaagctcagagaattactaaagttcatgtggaaggacatgttgtaaaagatccttcaggggctgaaactttggacttatgggcctcaagtcatgttaatgaaaagaaccttgaacagataagtgaacataatgatctattcgatgactggcaggatttccaaaactccaatccacagcatacaaccttacaagtttcttcaaatgcttcattatttgatataaccttggcatcaaagcctgatgcttttggagagcaagaaatt

SEQ ID NO: 76287 - DNA, 282 bp, Zea mays
  Clone ID: LIB3079-015-Q1-K1-G4
gccaggagggcacagtaaggacgagatggcgttttaagaggattcagaaggagctcaaggatcggcaaaaggaccctgccacctcgtgcagcgcatgtcctgttggtgaagacatgttccactggcaggctacaattatgggtccatctgatagcccatattctgtaggagctttactaggcacaatccatattgctcctgattattctttcaaaccaccaaatgtggcattcaacactatagcgttccattcaaactttaactgcatcgggagcatttgac

SEQ ID NO: 76288 - DNA, 445 bp, Zea mays
  Clone ID: LIB3079-015-Q1-K1-G6
cggacgcgtggggccgcggcggggatctccgccgtcatcccgggatggttctccgagatcagccccatgtggcccggtgaggcgcactctttgaaggtggacaaggtgctgttccaagggaagtcagactaccaaagcgttatggtctttcagtcctctacgtacgggaaggtgctcgtcctcgatggagttattcaggtgacggagagggatgagtgtgcgtaccaagagatgatcactcacctgcccctttgctccatcaaagaccccaagaaggtgttggttattggagggggtgacggtggtgttctgcgtgaggtttcacggcattcctctgtggaacaaattgacatctgtgaaattgacaagatggtggtagatgtctccaaacaatttttccctcatttaagctgtggatttgaagaccctcgtgtgtcattacaca

SEQ ID NO: 76289 - DNA, 381 bp, Zea mays
  Clone ID: LIB3079-015-Q1-K1-G7
gccgattgggattaagccattatcctttatctgattccatgggtgcatcaggtataaggtcatcccaagccaggcttctctgctttgtggtgactgctattgcaaaattagcaacatgccacagtgagttgcttccgagggcacgcgtgtcattgggtaaggtcactcgttcccgaacctcatacaggagggtctggcaacgggcctgtgactatttacggctcatgaatgaaccagccatctgtttatctgtactgggaccgtccaccgtccaaggaaatggtcctggtattgtgaattggagtgaatgatgaacatagatggttgctcatgttccttttaccttttagcccagcaaaaaggttcaccgtctcataattt

SEQ ID NO: 76290 - DNA, 326 bp, Zea mays
  Clone ID: LIB3079-015-Q1-K1-G8
gaagatttggaagatctcaatgaggtttagaaaaggaagaaacgagtgggtgtcaaggaagaggcaaagttggccttggccattgtaaagggagagaaggttaagaaagagaggaaagtgtatggtttgccagggcagaagcatgatcctcctgaagaaagggatccattgaggatattctatgaatcactctatgagcaggtccccaccagtgacatggctgcaacctggttgatggaatggggtttgctcccggtggatgtggctagaaaatgttttgagaagaaacaaggtcagaaagttaagtcaccagtcaaagcaattgt

SEQ ID NO: 76291 - DNA, 425 bp, Zea mays
  Clone ID: LIB3079-015-Q1-K1-G9
ctgacaagtcccgcttcaccgctaagtgtgctgcctagagctgcccgtggcgcatacgtgcagcaaggctccccggtgtgcccaccttctccattagaaccatacatgacaaccacagctgtgtcgggatcaaccatcttggccatcagcaggcatctgttcagtgggttgcgaacactgtcgaagagaggctacgtgagaacccagaatacaagcctaaggaaattttggaagaaattcacaaggcccatggcatcaccctatactacaagcaagcttggagaggtaaggagcggatcatggctgcggttcgagggtcttttgaggaaggataccgtctcctgcctgagtactgtaggcaggtggaaagaacaaatgcaggaagtatagctcgagtgtatggaaacccagatgacaattgcttt

SEQ ID NO: 76292 - DNA, 399 bp, Zea mays
  Clone ID: LIB3079-015-Q1-K1-F2
tggagttgagagctctgacaccatctacacgtgaaggctaagatccaggacaaggagggggttcccccagaccagcagcgtctgatcttcgccggcaagcagctggaggatggtcgcacccttgcagactacaatatccagaaggagagcaccctccacctggtgctccgtcttcgcggtggttattaagccatcagtcgttgaagctgctgctgtatctgggttatctagtgtctctgccattgcccatggatggtgctgtctttcaaagtatttgtatggtttgtgtcgtgagtcgtgactgagctggtttcatggaccagttgtgttctcgttacccaaaactatcgtgcgaccgcatatggcttaatcatgaataaatgttgtttgaatttaaac

SEQ ID NO: 76293 - DNA, 105 bp, Zea mays
  Clone ID: LIB3079-029-Q1-K1-H2
cccacgcgtccgaaaaaaaaaaaaaataaaaaaaaaaaaaaaacaaaaagacaaccggcttggtaatattcaaaaaaacagaacgcattcatacaacactataga

SEQ ID NO: 76294 - DNA, 429 bp, Zea mays
  Clone ID: LIB3079-029-Q1-K1-H3
cccacgcgtccggccatttgggtaacctaccttacaaagtttgtacatagatacaagagaagcaagttagaacgagcaagagaacttttccatgaagctgtccaacaggctcctccagaggaaaagaagcccctatatttacaatgggcaaaactggaagaggactatggtcttgcaaaacgtgctatgaatgtatatgatgaatctgtaagagctgttcctggcagtgaaaaaatggccatgtatgaaatctatatagcacgtgctgccgaactctttggtgttccaaggacatgacaaatatacgagcaagcaattgaatccggccctccagacaaagatgttctgacaatgtgcatgaagttcgcttagctagagagaacccttggggaaattgatcgttcgagtgccatctatgtgcatgcattc

SEQ ID NO: 76295 - DNA, 69 bp, Zea mays
  Clone ID: LIB3079-029-Q1-K1-H4
aaaaaaaaaaaaaaaaaaaaaaaaaattaaattaaaaaaataaaaacaaaaatacagggagggtttaat

SEQ ID NO: 76296 - DNA, 291 bp, Zea mays
  Clone ID: LIB3079-029-Q1-K1-H5
ccaagcctggaaaggggaccaggatgaattggctgcggcctactgcgccggcggcactgggttgaacgatggtggatcgatggagaccaagaacgatctctccgccgacagcggcatgacgatggagacgacgaaccgcggagcgcagaagcgccactggggacactacgcggacgagagcctgcacacgcgcatgaaggcccacgcgcagctcgactacatctacacggacgacgccggcgagcgcggatactaagccaccaggatggagtatgccggggctgaggacaa

SEQ ID NO: 76297 - DNA, 391 bp, Zea mays
  Clone ID: LIB3079-029-Q1-K1-H6
gaaaattcctggtatgccatcagattttatactcatcccttgtgtgccactgagtgacatataggtatattttttggtgtctatgacatgtggggccagtggcatacaaatggttatcttcctggctttacaggttacagacaaaccggtagctgttggtttcggtgtatcgactccagagcatgtgaaacagatcgtgggctggggagcgtacggtgtgattgctggcagtgcgattgtgaggcagttgtgtgaggctgctactcctgaagagggtctggaaaggctcgaggagtacgccaggagtatgaaggctgctatgccgtgagctgatctcacttctcgtcacaggcatcgtaaatagaacatggttttagcaatattctgggca

SEQ ID NO: 76298 - DNA, 458 bp, Zea mays
  Clone ID: LIB3079-029-Q1-K1-H7
cttgctttgaagggtggggggctagggcgggccgcactgcgcaccgagcgggcgccgggcggacgacgaagcggcgaggcagtgactggggagagatgtcgggcggcaggaggagggggcttgtgtggagcctccccgtggcgaggtcggatgcgctcggcaaactgggccctgccttcggcatcggcgctggctgcggcgtgggtcttggcttcggcctcatcggaggtgcaggcatcggagctggattccctggtttacaattggggtttggagctggagctggatgtggaataggaataggttttggttacggctttggaaaaggcgttgcatatgatgaaagtggaaagtattcgaacatcaggagaccggtccagagctccagaagcattgctttcgatgagaggttcgatatcatgtttgacgaactgatggagagcaccaggaaactggtc

SEQ ID NO: 76299 - DNA, 228 bp, Zea mays
  Clone ID: LIB3079-029-Q1-K1-H8
gcggtcaaacttaaaattggtttattgtgctccaaggtgtcactcttgtgagtagagggagaacacggtaatattgcaccatgttggagttattttgtgtgagttgaacttgaaaaacaattcttcaaaacatggataacccatactttattgcaatggtgtgacatgagtacatgacatgacatgacatgctaacgcagataattatgatgcaacagtggtatatgt

SEQ ID NO: 76300 - DNA, 395 bp, Zea mays
  unsure at all n locations
  Clone ID: LIB3079-029-Q1-K1-H9
cttctgatccctgcagtggatgaggacaccagtgtttacgacattgacctgattcttagcattgttgaagaatttatcagacaggatagtaagaatgcccagagacataatggtggcgaagtgaatgaccatgtatcagctcctagtgcatcaatgattacagtggcaaagattgttgatgggtatctggcagaggttgcgaaggacccaaatataccggtctacaagtttttcagtctcgctgagacagtctcggccaattcaaggccagtccatgacgggctctatcgcgccattgatatgtatctgaaagagcacccaagcttgggcaagagcgacaagaagaggctctgtgccctcatggactgcangaagttgtcgcccgatgcatgcgc

SEQ ID NO: 76301 - DNA, 244 bp, Zea mays
  Clone ID: LIB3079-030-Q1-K1-A1
cccacgcgttcgggccgagaaggcggtcaaggagcccaagaaggccgctaagtcccggaagaaggcgtagagtgatctcctgtcttagaacaatattaccattagcaatcgtgcagttagactagatcatgtttagtgtagatccgcaatgttcttgtccctgcagccatctggaacggtgtatctagtacatccgtgcactttccttgctaattgcaaaaaaagcggtctaatcttttgtttc

SEQ ID NO: 76302 - DNA, 364 bp, Zea mays
  unsure at all n locations
  Clone ID: LIB3079-030-Q1-K1-A10
gaagaagggcctgctgtatcctctgacttccctcagtcctcgtccgtctgctccctcgtctctctacctagctctagctagccttcctgtagcgcggcagagatggctgcccctgcctccaccacggcggcggcggcggcagcgctgctgctgctgctcctcctgtcgctcgccgcggcagcggacatgtcgatcgtgtcctacggggagcgcagcgacgaggaggcgcggcggatgtacgcggagtggatggcggcgcacggccggacctacaacgccgtcggcgaagaagagccgcggtaccaggtgttccgggacaacctncgctacatcgacgcgcacaacgccgncgncgacgcgggcg

SEQ ID NO: 76303 - DNA, 366 bp, Zea mays
  Clone ID: LIB3079-030-Q1-K1-A12
cccacgcgtgcgcccacgcgtccggttacgcgtggggtcgcccgtcaccgcaggtgcgagatccatgttgggatccagcataaggacactaaggaagactccatgaagtggttccaggtcaagttccagggtgtgatcctcaacaaggcctaatccaacacctcctaagcataagcattaccataagatattagactctttaggtctctagtagagctactagttaatggagtatatctggcagtaggatgtgtattagaagataatcagatgcgtcatcattgttgcctgtactggtcctactggaactagttggatccatgttgtagagagtgtcgaatacattgatgttactactgagctacc

SEQ ID NO: 76304 - DNA, 62 bp, Zea mays
  Clone ID: LIB3079-030-Q1-K1-A3
acgaacacgcgtacgcaaaaaaaaacacatttacattataaaaagggcggacgatctaaagg

SEQ ID NO: 76305 - DNA, 248 bp, Zea mays
  unsure at all n locations
  Clone ID: LIB3079-030-Q1-K1-A4
gcggatcttactagacacaacgagttctagcatcttggtcattcagcaataatgatggtcggccggttgataaattatgngggcagaaatataatgccacccttcatgctgatggttcgattcttgggccgcttacaaatcttcactatgctgggcttaacttgccagtttggcttataccatctttagttcacgctatagagttatcaaccacagactcaattcattttctgaagcaatggttgact

SEQ ID NO: 76306 - DNA, 347 bp, Zea mays
  Clone ID: LIB3079-030-Q1-K1-A5
gttgcactacatgcttcttctagcattctttgttgctcatgcacgcacaacaggtgggctgacctaagaggacagcaatgctaggaacatgactatgaccaagaccaggtcattgggcgacatacttgtcagccagattgacgacgggccatgctatatagattacggtcttaatgagtacgtgtgcataaagactaataagtgctataagatctacatgctcttcgttgcgagtagtcaacgatcatgatgaatccattatacttcggagacataattatactgccgagacagactgttagagatgacgctagttagatgctggttcactaaaatattatgtaaca

SEQ ID NO: 76307 - DNA, 391 bp, Zea mays
  unsure at all n locations
  Clone ID: LIB3079-030-Q1-K1-A6
cgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgnccccggtgtgctctccatggccaacgccgggcccaacaccaac

SEQ ID NO: 76308 - DNA, 381 bp, Zea mays
  Clone ID: LIB3079-030-Q1-K1-A7
acgcccacgcgtccgctgacgcgtgggcaggtgtagctcttttcttttctgtgcagctcaactttgctgtccctggtataattcatgttacttggtcatactcaagtaactcaactctccattttgattggaaacaggtttcttatttttatagttgaatataatactttggtctgttcttaaacaatagtcttattacaggtagaccccctaggcaaggttgaccctgaagtggaggatttacttctagaaatcgccgatgacttcattgactcggtgactgcatttgcgtgtaccttggcaaagcacaggaaatcatcaggtgtcgaagccaaggatgtgttgctgcacttagaaagaaattggcatttatctgtttct

SEQ ID NO: 76309 - DNA, 355 bp, Zea mays
  Clone ID: LIB3079-029-Q1-K1-H12
cggacgcgtgggcggacgcgtgggctgacgcgtgggtgacattgcacttattcaagctcagattcggaatttagcgcaagaagtcagagatttgacattgtcaaagcccattaccatactgaatggcaaatctgactcgggaggcagtttatcatcctacatactgccagcagcagcagttggagcaatgggttattgctacatgtggtggaaggggttgtctctctcagatgtcatgtgtgtcacaaaacacaacatggcaaatgctgttcagagcatgtcaaagcagttggagcaagtctcatcagcactagctgcaacaaaaagacatctaactcaacggcttgagaatttg

SEQ ID NO: 76310 - DNA, 398 bp, Zea mays
  Clone ID: LIB3079-030-Q1-K1-A8
cccacgcgtccggtctccagtctccactgcatctaaaaaaaaacgtaaaacgggcaggacgccgtagcggagagaagagaagagaggagcgcgcgatcgatgtcgggctccggcgatcgtcgcggctgcagtcctccgggttcccatagtggctgggaaaccatggggaagaagtcgaagaaacccgggcaagccggggggagacagtgggcaccatggagttccacaaatgtgacacctaacacatcaaggccagcatggcgtggcagtggttcctcgcacccttctggaaccagctgggctcaagctccagatcatggtgctgctaccataggcaatcctagaccggcatcacaaacatcgcgctctgatctggcttcagctctggcaaatggttg

SEQ ID NO: 76311 - DNA, 113 bp, Zea mays
  Clone ID: LIB3079-030-Q1-K1-A9
gcagggtctgcggcggctagatgattttcggaagggcattggaggactacgcgtaggcggttatgaggaagtgccaattgcataggcaaaagttttagctagctttaaaaatg

SEQ ID NO: 76312 - DNA, 314 bp, Zea mays
  Clone ID: LIB3079-030-Q1-K1-B10
cccacgcgtgcgtaacgacgacatctgccggtagtgctcctgctcctcctactcctgcttcgcggccgacgcgcgagcttggagggttagtgtctcttctttgcggagacctgtgataggagccatcatcatgtacgtcgctgagactgttgtcctcaaggttgctatgtcatgcgagggttgcgtctgggcggtcagaagagtgctcttcaagatggaaggagttgaaaccttcgacatatacctcaacgagcagtacgagacagtcaaaggcaatgtctagcctgaggacgtctttcatacggtctccaagt

SEQ ID NO: 76313 - DNA, 359 bp, Zea mays
  Clone ID: LIB3079-029-Q1-K1-F12
cccacgcgtccgaactaacaacagcttaggctgaaacagcgatgacgacgacgacgacaacgctgccgacggggcgcgccgtggccctgctgctgctcctgctggccacgacggcgacggaggccgcgaacccgtgcaacccggcgcagctgacgccgtgcgcggggccggcgctgttcggcggcgcggtgccgccggcgtgctgcgcgcagctgcgggcgcagcaggggtgcctgtgcgggtacgcgcgcagccccaactacgggagctacatccgcagccccaacgcggcgaggctcttcgccatctgcaacctgcccatgccgcgcttgccgtattagcgggcaatagtatatata

SEQ ID NO: 76314 - DNA, 375 bp, Zea mays
  Clone ID: LIB3079-029-Q1-K1-F5
aaaaaaactccctagaggtcgaccgatacccctgcggacctgcgcttcggccgttgcggaccgtaggagtgacgattccatggcggacgagatggcgcaggcgcaaccgagactcacggcgccacgttcggtccgctgtattgtcaagctaggtggagcggcgattaccaacaagggcgagctggagagcatcaacgaggagaacctacggtcggcatgtgcgcagctgcggcatgccatgtccgaatctgacggcgatggcgccatggagaaggttctgggaatggactggagtaggaagcccggagatcctgtcgacccggccgttgacgcggagtggatcgcggggatagctagggctgggctcgacactaa

SEQ ID NO: 76315 - DNA, 408 bp, Zea mays
  Clone ID: LIB3079-029-Q1-K1-F6
cacagattgtgtgagggatgtcgcctgtgcaccagttttgggattgtccaagtcgaccattgccagtggttcacaagacgggaaggttgtcatctggaccaagggaaaggatggagacaagtgggagggaaagctcatgcgtgacttcggttcccctgtctggagggtgtcgtggtccttgactggcaacatattatgcatagctgctggcgagaacaacataaccctctggaaggaagggtcagatgggcagtgtgaggaggcgatgaaggttgaaccatacgatgaccggcaaggtttctgaatttcttgtagatccatgtttcgacacggacaaagcttgctactgctttactagtgtttcgacaaagcttaagtttgccattgtgttttactagtgtttactgc

SEQ ID NO: 76316 - DNA, 406 bp, Zea mays
  unsure at all n locations
  Clone ID: LIB3079-029-Q1-K1-F9
tacggctgtataatggctgagctccttgccttagaaccattatttaatggaaaaacagagtgtgggcggctagataagatttgttaggacacttggcacacctagcgagaagatttggcctggctatgctaaattaccaggcgtgaaagtaaattttgtcaaacaaccgtataataggctaagggataagttcccagctgcatctttttctgggcgaccaatcctgtctgaagctggttttgatctattgaatagactgctaacttatgatcctgataagcgcatatcagcagacgatgctctgaaacacanatggttctctgaagtttctctgcctaaatcaaaagacttcatgccaacatttcctgctcttaatgaacttgacaggcgtaccaaacgttatctg

SEQ ID NO: 76317 - DNA, 443 bp, Zea mays
  Clone ID: LIB3079-029-Q1-K1-G1
aacaaaaacgactcgaggccaaacgcttgcaaggacagctcaaaactgtacaacgagtggagtcatgtacaacgagaactgcaccgaactgctgaaccgcatgtagtgggccgtggtctacgtcaagatgcggctctttgacggactgcacgacgtgctccggtagcagctcttcgaggggtcaccgcacgcctagaacgcttactgctccttctccaacgtgcgccagtggatcatactcccaattgcatatgcttattagtatatagtacaagctccagtcccaattctccttctgtgctcctaccaccaccgagcttgcatgccgctcatgtcacggtcgacaacctgaatgtgcatctgatattgcgaacatggcagcttggccgttggatttgtgctatggtgatgtatggaatgattaaggcggttgtctttgtgca

SEQ ID NO: 76318 - DNA, 342 bp, Zea mays
  Clone ID: LIB3079-029-Q1-K1-G10
ctttgctgtagatagaaaccacatgttcacggcatctctgctgtgtccattggagcaggagagaggtgcctgctgctgtttgttgagtaaattaaaagttttaaagttatacagtgatgcacattccagtgcccagtgtattccctttttacagtctgtatattagcgacaaaggacatattggttaggagtttgattcttttgtagcaatgtgtcccgcccccccactgttgttgtaaaatccgcccattcgcccagaaccgcggtgggcggcgctgctagctttgtgatcatatagaaaacgacttggttgtttttggacattttgaattgaaagaaaga

SEQ ID NO: 76319 - DNA, 274 bp, Zea mays
  Clone ID: LIB3079-029-Q1-K1-G11
caagaccatccaaactcggatttaaattcttttggaaacctttcgtaaaggtgcagggtcgactgtacaggcagcagggtttcttacaatactctaagctgtgacaaacttgtttggcaactcatgcttgcaccagtggcttatgacccacttttctgagatcattgattctgtgtcaaacttcaagtcttcttttagcaagaatgcacaattggcatatgtcacgcttctactgaactactctgctctttccattgaatcaaatgaagaacat

SEQ ID NO: 76320 - DNA, 318 bp, Zea mays
  Clone ID: LIB3079-029-Q1-K1-G12
cccacgcgtccgtgccacctacctggcacgctgtgcatgtggactgactgcactacctgcttcgaaggctgtgctaccacagccggcgagtgcggtggttgcttgggaggggctggggaagccgggctaccgcttctcctcatcatgggggtcattgtgctggggcttttcacggtcatcggcatattctacagtgtcctggtcgcgaccatggttggccagcggatctggcagcgccactaccacattcttgccaaacggttgctaaccaaggagtatgttgtagaggacgtcgatggcgagcgcacagactggtgt

SEQ ID NO: 76321 - DNA, 160 bp, Zea mays
  Clone ID: LIB3079-029-Q1-K1-G2
aaaaaaaaaaaataaaaaaaaaaaaattaaataaacaaaaaaaaaaaaaacataaaagtagggataaacaacaaaaacgtgaagaaaaataaaaaaacaaaaataataaatcataacaccaggccaacaaaaaactatataaaaggcactacaaaacctg

SEQ ID NO: 76322 - DNA, 453 bp, Zea mays
  unsure at all n locations
  Clone ID: LIB3079-029-Q1-K1-G3
ggtaaaacaggaagtactgtcagtttccgagctacaaacaagctataagtttagaaaaataatttagaaatgtacatcaaagtctagtaatacattgttaaagataaatcaatactcaataagttcctcatgctttggatttggggataacatacctgttttatttacatgctaatatttggaccaacaaaaaataccttaggaacagccatttgagaaaaaaacaaagccttttagtcctaagcaagttagcatagcttagagttgcaacttctacatgagcacaataaacagaaaagaaagagaaaaggaaaataaatatatatggcaccaaaagctattaccatgttataatataaatntaatgaccgaattataaacattnttacaatcttagcanacctctcaacgtgtagtctgaatcgacagaacatcagtagagtaatttttgtt

SEQ ID NO: 76323 - DNA, 312 bp, Zea mays
  Clone ID: LIB3079-029-Q1-K1-G5
cacacacaccgatcaggtagctgtcactgtagcacgatcgtactaaaaccagcggcaccaatagatcgacgacacgcgcgcgatccaggtgaggagcgaaagacacggtggccttttcgaatccgacggacggcgcgtagcgctagctagctctctaggcctgagaggaggatcgtgggacgaggatcatatacggacttctagtgcactgctgtcacagtggtagctacggtggcttcgctgcctcagcagttgaatgtgctgatctacgacacgctgtgctcgacggtcgcgatcatggcacacgatgat

SEQ ID NO: 76324 - DNA, 444 bp, Zea mays
  unsure at all n locations
  Clone ID: LIB3079-029-Q1-K1-G8
tgaagagtacaagaatttctgtgaccgtcaaaaggatcagaggccacaggcagaagaagtaattgcagatatcgcagagcatctgaccaccatacacttgtcacgatgcggacgaggaaagcgttgcttatacgaaggatctaccccacctgaaggttttcccaacaactggagcggcgcgtcgtactgtacgtcggatctgtccatccacaaaaacggcgaagtacatatctgggacaaaggttttgacgacgaagggaaccaggtttgggggaccaaggctggcccctacgagttcaagcctgctcccaaatccaaatatgacgacatgttctcgccgttaaatttctcggctcctttgtcgctagagaagaagctggataaaacatatgtaattgatgaccagtanggcctgccctaaatttttgttcataggaatggaat

SEQ ID NO: 76325 - DNA, 76 bp, Zea mays
  Clone ID: LIB3079-029-Q1-K1-G9
aaaaaaaaaaaaaaataaaaaaaaaatttaaattaaaaaaaaaaaaaaataaaaataaggaaaaggacaaaaaaaa

SEQ ID NO: 76326 - DNA, 381 bp, Zea mays
  Clone ID: LIB3079-029-Q1-K1-F11
gggagagacattggatttaggagcttttgctagatgtgttgagccacttgcctctttgtggaggaactagctttgatttcagcttttgtgctgattttgttttgttggctggctagtggtgttgagccctactttttcctctttgtgaggacaaaccgttttatacttggtcgtgttgagtcgttgcccatttctttggagaccaagttttgcttactttggatgacttgtttggccattttctggcttttggtcatttgagtgagtttctcttcttcttcttcttcctctttctgcttatatatgttcatgtggtggtgttgacattgcactcattaaatgggagattgcgaacacaagattgagttgctccttgtggtt

SEQ ID NO: 76327 - DNA, 314 bp, Zea mays
  Clone ID: LIB3079-029-Q1-K1-H1
gccacgcatgctgggcaccagactgtacggtggtgcaccgtacagcgtacgatggtgcacgggacagtgatctgagcgccagggcgtcttgtgccaagaggccgctctcgggactgtctactgcgacttcgggtaaaattcaccggactgtccggagtgcaccggactgtccggtgagccaactgtctgtcaggccaactgacggacgggtgatctgcgcgcgacacgtggccatgccaacggtcagagggaagcaccggactgttcagtgtgcaccggactggccggtgcgccagatctgcaacggtcgggaa

SEQ ID NO: 76328 - DNA, 268 bp, Zea mays
  Clone ID: LIB3079-029-Q1-K1-H11
ctctgtttcaaggtggattgtttgggtcaaaagaatgaaattttgctgctgaaggtcggtcaaagcgatatggtggtgggatccatgggaggaacagacttcaatcacgccggtcaacaagtctggaaactgcacatatactggtggggactcgctcgggaaaacaacgctgactacacttctggcttgcatatacaattatgagagctggcagaggtacaagaaaaagatggtggcttgcgagagttgattgttgcgaaagctgatt

SEQ ID NO: 76329 - DNA, 322 bp, Zea mays
  Clone ID: LIB3079-029-Q1-K1-D5
ctcacacgttcgctctacttcagctgctgaccgtgtgcaactcgacagggcaaggtgggaggctcgctcgagggtctgaagctagggtaagctagtgaagctacacgctgtagcgcagtgtctcctgcgagacagctaatgccttctgttaatgtacctacgctactaagtctgccggattatggatactgcgtgcatacgtctcatgtgtaactaagaatgtcgtgctttgaggcgctcgcaactgctgtgcctagatttatctttatggatgtcaagtaacatcatgtaccattgacattgttgaaaactttgctttttc

SEQ ID NO: 76330 - DNA, 403 bp, Zea mays
  Clone ID: LIB3079-029-Q1-K1-D6
ctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctccttgccatccgcaacgacgaggagctcgg

SEQ ID NO: 76331 - DNA, 416 bp, Zea mays
  Clone ID: LIB3079-029-Q1-K1-D7
cccacgcgtccggcgatgcacgcggacgtgatgcgcaacgtgctgccgcaggtggagtcgctgctgcggagcacggcccgcgtgctgctgtaccagggcgtccgcgacctccgggacggcgtcgtgtccaccgaggcgtggctgggcggggtgcgctgggacggcctgcgcgcgttcctggacgcggagcgcgccgtgtggcggacggccgcggagggcggggagctcgcgggctacgtgcagcggtcgggctcgctgacgcacgtggtggtgtacgccgcggggcacctagtgccggcggacaacgggcgcgcggcgcatgagatgatcgagggatgggtgctggggacagggatgttcggccgcggttgtggtgatcgtggtcgctactgcttcaggagcgccgccacatgatg

SEQ ID NO: 76332 - DNA, 447 bp, Zea mays
  Clone ID: LIB3079-029-Q1-K1-D8
caagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagttaactgatcttagaagaagtagcaaatg

SEQ ID NO: 76333 - DNA, 268 bp, Zea mays
  Clone ID: LIB3079-029-Q1-K1-D9
tcgctccgggccggcggcggcgtttccggttagcgcatgaaggccgactcgagcgggctggtcaagctccctcgggtgcttgggcttcgtcttcatgtctgtatttaggcaggagtaccacgtgcatcactcttgcaacaatagcgttgctgcctttagcaagggagctggtgaaaagtcgctctttatgtctgagcatgagaagcaaccctatgtggaccaatctgggcagtataagcatgactatgatgaagactaccgcaaattt

SEQ ID NO: 76334 - DNA, 424 bp, Zea mays
  Clone ID: LIB3079-029-Q1-K1-E1
gttggagaaaggcaccttactgggaccactgcacactcctgcttcaaaagagaactttttgaaaggcattcagactatcaaatctcagggagggaaaatcctttttggaggatctgccattgaatcagaaggaaactttgtgcaaccaacaattgtggaaattacaccttctgcaccagttgtgaaagaagaactctttggtcctgtcctttatgttatgaaatttcagtccttgaaagaagcaattgaaatcaataactctgttcctcaaggattgagcagttctatatttacaaagaggccagatattatttttaagtggctcgggccccatggtagtgattgtggtatagtgaatgtgaacatacctactaatggtgcttgaattgggtgaacattttgtggagaaaaacaacttgtggtg

SEQ ID NO: 76335 - DNA, 417 bp, Zea mays
  Clone ID: LIB3079-029-Q1-K1-E11
acggcaagaagccgagctgcatgcccagattgatcaggaacggaaagccctcattgacatgaggagcactgcggacaccactatctgacagcatcgagaagagtcttggagagtacagggacaagatcccggcagaggttgcatctgagatcgaggcagccatcgctgacctccgccaggagatggcctcggatgacatcgagaagatcaaggccaagcttgaggctgccaacaaggctgtctcgaagattggtcagcacatgtcaggtggtggctctggcgactcacagtcgggatctggacctcagggtggcggtgactcaggcgccggaggcagagtatgaagagggtaaaaagtgaggctgcggtaagttgaagcgaaattgtagtgacctgtttagaagtagctactctttt

SEQ ID NO: 76336 - DNA, 334 bp, Zea mays
  Clone ID: LIB3079-029-Q1-K1-E12
tacgcccacgcgtccgaccacgcgtccgcttgaaaccagctgtgacgggcgtcttagtggtgcgctccactccagatccaattggcaacaagtactatcttggccctgctcctctgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccatgaaatcacatgcccctcttgtgcacct

SEQ ID NO: 76337 - DNA, 259 bp, Zea mays
  Clone ID: LIB3079-029-Q1-K1-E2
ctgacgcactcggatctgcacctggatattatcagaatgtgtatcataatatacagggtgggctacctatgatggcacctgagattacgatggatcacatggtggatcagattcagcctgcgacacaggctgtggcacaggctatgcaccatgagattcaccgtgattctcaatctaatgtgacacatatggagcatcatatgcatcggcctggggatgggcaatgggaccctgacggacacattgcgcgacatcttat

SEQ ID NO: 76338 - DNA, 446 bp, Zea mays
  unsure at all n locations
  Clone ID: LIB3079-029-Q1-K1-E3
gtggaaggaaaaaatgaagatatatcgacaattgaactctctggtggagcaaggatccattacattttccagtctatctttgtcaaaagtttagaggaggttgatccttgtgaggatgttacagatgaagatatccgcatggctattcaaaatgcaactggtcctagaagtgctctgtttgtacctgaagttccatttgaagtccttgtacgtaggcagatcagcagattgcttgatccaagtcttcagtgtgcacaattcatatatgatgaacttgtaaagatgagccatcgctgccttgcaatggagttgcagcagtttcctatactccgcagaagcatggatgaagtcattgggaagttttgcgggatggacttaaaccagcagaaaatatgatagcacacattattgagatggaagaagattacataaacacgtnacaccca

SEQ ID NO: 76339 - DNA, 414 bp, Zea mays
  Clone ID: LIB3079-029-Q1-K1-E4
tcggtggaaggaaaaaatgaagatatatcgacaattgaactctctggtggagcaaggatccatgacattttccagtctatctttgtcaaaagtttagaggaggttgatccttgtgaggatgttacagatgaagatatccgcatggctattcaaaatgcaactggtcctagaagtgctctgtttgtacctgaagttccatttgaagtccttgtacgtaggcagatcagcagattgcttgatccaagtcttcagtgtgcacaattcatatatgatgaacttgtaaagatgagccatcgctgccttgcaatggagttgcagcagtgtcctatacttcgcacaagcattgatgaagtcattgagaagtatttgcgggatggacttaatcccatgagaaaatattgatgcacacattat

SEQ ID NO: 76340 - DNA, 441 bp, Zea mays
  unsure at all n locations
  Clone ID: LIB3079-029-Q1-K1-E5
aaagaaagccaaccgccccaatctcgcgtcccgccggcggccaccaccaccaccgtcatgatcagcatcctcgcgcaggagcgcctcctcgggttcgccctgggctccgtctctatgggaggtttcgtcctccaccagcgccgcgccatctaccgctcaatcgctgaagccgatgggtcgtcctacttctaccagcctggtgaaattgccggtcgtagaagttcaactgaactggctcatgtatggaacaaggcggtggacgagactcttgggaaacttgttgtgtaccttagctctcgtggatggtgatccaagcaccatgtcgaacatggcaactgangaggcacgggtggaggaagaactctttttgaagccactgatgtgctcatatttctctgtatccggattgaacatgttttggtttaaaagaaaagatgctcc

SEQ ID NO: 76341 - DNA, 428 bp, Zea mays
  unsure at all n locations
  Clone ID: LIB3079-029-Q1-K1-E6
gccgaagaagaggagaagcgaagcaagcaggcttcgagaacaagggggagggggaggaccaagcgaaagggggaactagagcaagatgggcggcgaactgctgcttgcgctcctcctcgtctctgctgctgccgcccctcaggtacttggagttggcaatggagacaatcacatgagaatcatccaggaggacatcattgagacagtcaacaaccatcccagtgctgggtggacagcctcacgtaatccttacttttcaaactataccattgcgcaatttaagcacatacttggagtgaaaccagcaccacagaatgcactaagcaatgttcctgtcaaaacttattcaagatcactggaacttccaaaagagnttgacgctagatctgcatggtcccgttgcagcacaattgggaacatacttgatc

SEQ ID NO: 76342 - DNA, 425 bp, Zea mays
  Clone ID: LIB3079-029-Q1-K1-E8
gtagtcgagaaccgtacctgcacagcatttccggctgttaaaccagttttggttgctgctggtgccaagtgggaagagcctgacacaatggcaaaatgcactgttgatggcaatctcatcacagcagcgacttataattctcatcccgaattcatcagcctatttgtcaaagcactcggaggttcagtggcaggctcagataagagaatactgttcctatgtggggactacatggaggattatgaggtcatggtcccattccaggctctccaagctcttggctgccatgtcgatgccgtttgccccgacaagggagctggggagacgtgcccgacagccattcatgatttcgaaggtgaccagacctacagcgagaagcctggccacgattttactctgacaagcgtcgttggaagtgtggatgc

SEQ ID NO: 76343 - DNA, 305 bp, Zea mays
  Clone ID: LIB3079-029-Q1-K1-E9
gtggtccgcgtgcggcggtgagcgcattatcgttttcaccaccaaccacgtggagaagctggggccggcgctcatccggcggggccgtatggacaagcacatcaagatgtcctactgctgcatacaggccttcaagttcctggccaaggtgtacctcgacatggactaccactcgagcttcgactccgaggctgagctccagctggaggaggacatgacgcctgcggacataacctacaactggacgcccaaggcacatcgagaggacgccgactcgtgcctagtcaagctagtctaggcacttg

SEQ ID NO: 76344 - DNA, 356 bp, Zea mays
  Clone ID: LIB3079-029-Q1-K1-F1
gcttctgcttgctctggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgtctccgagccggccgtgttcgtgcagctcggcgaccacggccacctagcctactcccacaccaaccaggcgctcctccgccccaggtcgttcgcggccaatgacgatgtgttctgccttgtcgaggtggtgctggacaacctgggtcgtctg

SEQ ID NO: 76345 - DNA, 333 bp, Zea mays
  Clone ID: LIB3079-029-Q1-K1-F10
ctgcccgaccccgacgccagctgcccagttcttcgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagttctttcatgcataggaactgcagttcttgctgtttgcctccgcattcaagtgaacaaagacaacaaagaattc

SEQ ID NO: 76346 - DNA, 122 bp, Zea mays
  Clone ID: LIB3079-029-Q1-K1-D4
aaaattttagatctgcaaaggaatgcatgtgtaacaaggccttccattgagccgatgttcggtccatcatgcatgcactcggccattgaacctatcagaagggacgctcacatgcattcact

SEQ ID NO: 76347 - DNA, 375 bp, Zea mays
  Clone ID: LIB3079-031-Q1-K1-C8
agacaactagcaacatagaaagcacaatactgtaccaacaatggctgccaaggtatggtgcctccttatgctccttggtctctctgcaagtgctgctacggcgaccattttcctacaatgctcacaagcatctatagcatcccttcttcccccgtacctctcaccagcggcgtcttcggtatgtgaaaacccaattcttcaaccctatacgatccaacaggcaatcagcagctggcatcttacctttatcacccttgttactgcaacaatcatcagccctattacagcaggtacctttgatgcatttattggcacataacatcagggcacaacaactacaacaacttgtgctagcaaaccttgctggctactctc

SEQ ID NO: 76348 - DNA, 307 bp, Zea mays
  Clone ID: LIB3079-031-Q1-K1-C9
gtggattacagctgttactgcattggatatgactccgtgataagggctgcactggaatgctgcctcaaaggcttgggaacctccatcatcttctgcgtcaccgtctctggccaggagatctccacacgaccattccacctcgtagactggtcgtatctctaacggaaccgctttcagtggcttcaatagcccgacccaggtcccatgtcttgttaacaagtacatgaaaaaggacattaaggtggacgagtacattacgcacaacatgaacctggctgacatcaacgactccttgcacctgctgcac

SEQ ID NO: 76349 - DNA, 398 bp, Zea mays
  Clone ID: LIB3079-031-Q1-K1-D1
accgcaccctttcatcagcctgcctgtccactgttggcttggtgacttcctgggctcggctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtcttcggcccggcggcggtggaccccaagctggccgctggtggcgcgccggacgccggcgcggatgctgcacgaggcacggtgct

SEQ ID NO: 76350 - DNA, 342 bp, Zea mays
  Clone ID: LIB3079-031-Q1-K1-D10
agccatcttagcaccggttgaagattaacatgttagcttctggagttacaccgaccttggcgagatgtggttttgtgcatccccaggttatttttgccagcacaacccagatccagttttctgcagtttttttggaggctcatcagctgtgatcagttagatgtgaaaatgtctcaccaagaaccagtatacagtttgtatgtagggagagaagaaaatgctcggtttggttttggttttagagctttcagttttttttcttttcttttcaatcctagtctttgttgtttgaaggacaggtcctagatttgacatagcctctttacatcggttattctttcc

SEQ ID NO: 76351 - DNA, 411 bp, Zea mays
  unsure at all n locations
  Clone ID: LIB3079-031-Q1-K1-D11
gctagcgcgctcctcgagcccagcagagaaaggccggcctacccactctctctctctcggtctccagtctccaccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccggcgaccccgccgccgcggcggccatggtggaccgcatgctccgnctgctcgcctnctacgacgtcgtccggtgccagatggaagaccgggaccgccggtacgagcg

SEQ ID NO: 76352 - DNA, 435 bp, Zea mays
  Clone ID: LIB3079-031-Q1-K1-D12
ccgacgagggtggcggcgtcgaggcgtgggacgccgtggacctcatgttggcgtagggcgtacgccttagcaggggggcccagcgccagcgccagccccagccccagcgcgcgcgtgccgcgtgccgtcgctgtgaacggccgccgcagctgttttggatcgagtaataatattattagtagtataatgtttctccaagcagctaagataattgcaagccttgctgggtggtattactagcactgctatctaagagtatgtactagcaggatgggtttatctagcttgttgctaaacagaaaattaatctaagaaaacagagatatggtctgttaattgccggctctaactaatggccggcgataatctgttaagctacctcagattgaccatctctatttcttattataaactcattttcctcgtctattattt

SEQ ID NO: 76353 - DNA, 425 bp, Zea mays
  Clone ID: LIB3079-031-Q1-K1-D3
cgctgtgcctgcgcgtgctgcttcaccgaatcgagtcagatcctgtccgaatgcgagcgaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacaactatggcgttgacaagtatgacattggaacgggctttgggcatttcgcaattgctaatgatgatgtgtacaagttagctgagaatatcaaatccaagggtggtaagatcacccgcg

SEQ ID NO: 76354 - DNA, 437 bp, Zea mays
  Clone ID: LIB3079-031-Q1-K1-D4
cccacgcgtccggtcgcgctccctggccttatccggacgctcaagatgtgcggcacctgctgggccaccttcgccaccatcgggggcctctacatcggcgtcgagcagctcgtgcagagccagcgcaagaagcgcgacttcgtcaacggggccgtcggcgcgttcgttgccggagcctctgtctgcggctacagaggaaagagtattcagtcagccctcatcggaggctcctgtctggctttcacatctgctgtgctggacattggcggcaatacgaccagagttgacaacggcaaagagtactatgcctacacaactgagaagaagcctgcaaattgattccaagtctgcacttctagcaaacaatcttgcacgccatcaactcagtgaatttgaagctgatgtgcagttttatgtttgttttgctgatgcaatta

SEQ ID NO: 76355 - DNA, 416 bp, Zea mays
  Clone ID: LIB3079-031-Q1-K1-D5
acgcccacgcgtccgcttgaaatggaaatgaagctcctggaagctctcgactattatttgggtgttgtccatccatatcgtcctctcttacagttgttgcaggatgctggcataacagacctgacacaatttgcctggggccttgttaatgatacatacaagatggaccttatcctcatataccctgcctacatgattgcactggcctgcatatacatagcgagtgtattgaaagataaggacaccacagcatggtttgaatagcttcgggttgacatgaacataattcaagaatatctctatggaaatattagacttctatgacacctacaagattgatcctcaaaggggcatccctgaggattagataagccccgtgatgaacaatttgccggcaaaggcttaactcacatttg

SEQ ID NO: 76356 - DNA, 334 bp, Zea mays
  Clone ID: LIB3079-031-Q1-K1-D6
aaaaaaaaaaaaaaaaaaaaaaaaaaaataaaaaaaaaaaaaaaaaaaaaaaaaagaaaataacaataaaacaacatgaatggactattcacaatcaaacaaacacttaaatacacatccaacacaaccaacataaatttatataaaccaaccatacacaaccttccttcaccaaccactctatatacaactacataactatcaccattcacaacaatcctattaataaactcctatttcactatcacatctcctgcaattgccattcttaccaatactcctacacattacatcctcaacatataactatgcatacaaatctcataaataacct

SEQ ID NO: 76357 - DNA, 265 bp, Zea mays
  Clone ID: LIB3079-031-Q1-K1-D7
acgcccacgcgtccgattgaatctggcgtgttccctcgccttgtggaacttctgatgcatcgttcaggctctgtactgattccagctcttgcgcacggtgggtaacatcgtaactggggacaacatgcagactcagtggtgtcattgacaatcaagcactttcatgccttttgaacctactgaccaccaaccacaagaaaagcatcaagaaagaagcatgctggacaatcttaaacatcacagctggtaacagggaacagattca

SEQ ID NO: 76358 - DNA, 241 bp, Zea mays
  Clone ID: LIB3079-031-Q1-K1-D8
ggtacgactcacgcgttcggcatgctcaacttggtgctgcgttttagggtggcatgcagatcttcttgaacgctatgtctagcaagacgagtagtcttgacgtgtaatcttcagacaccattgacaacgttaaggccaagatccatgacaaggttggcattccaccaaaccaacagcaggtgatcatcttcggctagcagctagatgaaagtcgcaacttttctgactacaacatccataa

SEQ ID NO: 76359 - DNA, 73 bp, Zea mays
  Clone ID: LIB3079-031-Q1-K1-D9
aaaaaaaaaaaaaaaaaaaaaaaaaaataaaaaaaaaagaacaaacaatataaaaatggcgggttactacact

SEQ ID NO: 76360 - DNA, 68 bp, Zea mays
  Clone ID: LIB3079-031-Q1-K1-E1
tcccaattcgacccacgcctcacgcgtccataccatatatattaagattttagtctagcacaaaactc

SEQ ID NO: 76361 - DNA, 84 bp, Zea mays
  Clone ID: LIB3079-031-Q1-K1-E10
ggttagctaccatggatgtttcatctacacaccagcttggtttgttatttatactaaggaagaacaaattctagtcttatgatc

SEQ ID NO: 76362 - DNA, 315 bp, Zea mays
  unsure at all n locations
  Clone ID: LIB3079-031-Q1-K1-E12
catgaagggcttctcgggggacctggaggccgtgcacgccagggccacgcagatcgcgggcgaggccgtggccaacctgcgcaccgtggccgcgttcaacgcggagcgcaagatcacggggctgttcgaggccaacctgcgcggcccgctccggcgctgcttctggaaggggcagatcgccggcagcggctacggcgtggcgcagttcctgctgtacgcgtnctacgcgctggggctgtggtacgcggcgtggctggtgaagcacggcgtgtccgacttctcgcgcaccatccgcgtgttcatggtgctgatggt

SEQ ID NO: 76363 - DNA, 370 bp, Zea mays
  unsure at all n locations
  Clone ID: LIB3079-031-Q1-K1-E2
acgttgtcctgcccaccgncagcccctcctctgccccccgccggccgtccacctncaggcccgcctctacccgccgncctgctctggccgnctnccctcctctggccgncgcccaggcacccaccgncagccgtcgaggcctgcaccgncctctaatcaccgnccaggcgtccacctctgactgccgcccacctncagccgtcgaggcttctggtggaaactcgtttgctaagatggaaagaggcaatgactactatgttgntaggaaaagtgatgtggtggcaagttacaaaactctaagtgattgccaaggtcagatttgctcttcggtatctggtcctgctgcaagtgcctacaagggtcactcttg

SEQ ID NO: 76364 - DNA, 397 bp, Zea mays
  Clone ID: LIB3079-031-Q1-K1-E3
gagccatccctccgtagttagcttcttagagggacaagatcacaacggactgcagagagttcatcaagctgaaaggccccgtcacagccccgtcgtacaccgacgactgctgcgtcgccataagagcggggcccaatctcgacatggagtgcatcattcgcctgctctccaataaacagaagaagaagtacgacgtggacaagatccggcggctcggcagcgtcctctgcaatccacatccggtgatgacgtaaaatggggtgtggcagtagtttctgatggagtgcatcgcgtcaacaatatggagcttgaaccatacaaaccctactgataatgtgtcaccatttcatatgtatatgtactccattcattaacaaaaaaaagtgtcttatatatc

SEQ ID NO: 76365 - DNA, 412 bp, Zea mays
  Clone ID: LIB3079-031-Q1-K1-C7
cacacgcgtccgcccacgcatccgcccactcgtccactcacgcgttcgcgaactcctcgtctcgctatgtgctactgtatattacaccaggacaaccttttatgagctatattcatccttccgaaggagatgagagctgtaacatcctgggaagacgtttagaacctggtctgggcagatctcaaccgataccaggactctgcagttcgctcagcataacttaacaccagcaagttcaccacaaaaaaactttctgaacatacgattatgttgctgttcctcccacaaatgtaacttacaaatctaaaaaagaactgtaagtaaaataacgaaggctcgacacggcatgcccgtattttcctatggctggtgataatattgaaatccctgaaatggctctatgaaatgaacc

SEQ ID NO: 76366 - DNA, 414 bp, Zea mays
  Clone ID: LIB3079-031-Q1-K1-B2
gtaccctgtggatccacttcagaaaagggttttgcagctagagaaagcaaaggcagacgggaggattgctgttgaagcagcaaagccgcagtccaagaggcctcgtgccaatggatcggcctttgcaacccgtgctacaagctttgctgacaagagcttctactcagcaaccccagagaggcatccattcaatccttgcgagaggcagtttgtgtatggcgctgaagtcattcttctccatgatgacctcagcgtcttacacgatgcaacctgcccatggaccttattacggtaatggctacccagttcagtaccaggtctcgtatatccactaatggagacagccaggtgcaggtgctctttcctaacaatctagcttaacctgctgctctttgctgtagtcgtatcagttac

SEQ ID NO: 76367 - DNA, 90 bp, Zea mays
  Clone ID: LIB3079-031-Q1-K1-B3
aacaaacacacatactgtcgcctttaattcaaacactctaaaatcttcaagaggtaaaggcccgaacctcgctagcgttcaacctcttta

SEQ ID NO: 76368 - DNA, 294 bp, Zea mays
  Clone ID: LIB3079-031-Q1-K1-B4
gtgatctttacaatgtacctgccacatgctgatcacatgctgaattctatcttcaaacggattgctggcctgtccactatccccataatgaggctctatgcatatctcatcactgttagatgagcataccatacttcaccaacaaagactcaattcaattgccgcactgacccatctacattaactggtgtctcacactggattacaataccatattctcttcatgcgtgagctacctctatagatgcgattaaaccatttcccattatagcatcatcattacatactatcaaa

SEQ ID NO: 76369 - DNA, 395 bp, Zea mays
  Clone ID: LIB3079-031-Q1-K1-B5
acgctcacgcgtccgggacatcaacgcaactagtgttacgagcatgaacatgactaggtcgggatggtacagcttcaacatgtgcttgaagttgcttacaacttaacatatgttctttcgtcataagaacttgaatttacttgtgcacgatcatatgctatctgacatgaacaaagttcttgataaactgctaattgtaatgctctggattatacatttggaataaaggggtttttgataattggtccaatattaattgcccttcttaacatttgctcattctgaattgattattgttcttgccctgtttctgctcattaatctcacttctttttttttttactttcatttggtttatttcacttgcttgtgtatttttgtccgttttttttatt

SEQ ID NO: 76370 - DNA, 433 bp, Zea mays
  unsure at all n locations
  Clone ID: LIB3079-031-Q1-K1-B6
gagctactacgggcagcagccccccgtcggcgtcccgccgcagcaaggctacgcggggggaggacggctacccgccagcggggtacccgacggccggctaccccccgccggcgcagggctaccctccgcatggctacccgccgcagtacgcgcagccgccgcctccacagcagcagcagagcagcgggccttccttcatggagggatgcttggctgccctctgctgctgctgcctnctggacgcctgcttctgagagtgagaggggccgaccgacggattcgacacggcgacaagtgaaactactagctttctatgcgagggagagagagagagagctggaactggattgagcctggaatgctatcgtgctattctagctttgtcagagcataatatgtcgccctagttttttatttctctctgtcaatgttg

SEQ ID NO: 76371 - DNA, 413 bp, Zea mays
  Clone ID: LIB3079-031-Q1-K1-B7
ggtaaatcccgaagtgacatgacagttgaagagaggattgcagctgcagacaggagagagattgatggcaatgcatatttcaaagaaaagaagcttgaggaggccatgcagcaatatgaaatggcgattgcatacatgggagatgatttcatgtatcaattatttggaaagtacagagacatggccttggctgtgaaaaatccatgccatctcaatatggctgcatgcctgatcaaactaaagagattcgatgaagctattgcgcagtgtagcattgctttgacagaagatgaaagtaatgtcaaagcgctagtcacgcgaggaaaagctaaatctgaacttggccagacagaatcagccagggaagatttcctcaaagcgaagaagtactccccagaagacaaggagatcat

SEQ ID NO: 76372 - DNA, 306 bp, Zea mays
  Clone ID: LIB3079-031-Q1-K1-B8
cccacgcgtccggtaaaggtggactctaaatggccatgcttagttcttctctctgagcgtaaaatgccatgtgttggcaacttagattgttcatgtactgaacctgttgaagttctaccaaaatttgttgtcgaacggctgaacagttgtcctaatgttatgctataaacagagcttatttccccccgtgccatcgctgtatgattgcagtattttttctctcgccaaattttatagacatattttacaaaaaaaaaaaaaaaaaaaaaaaaaaaaaaaaaaaaaaaaaaaaaaaaaagggagaac

SEQ ID NO: 76373 - DNA, 375 bp, Zea mays
  Clone ID: LIB3079-031-Q1-K1-B9
acggccacgcgttcgcccacgcgtccgtttttttttttttttttttttttccttcaagcttggttggtggctcctttccatgcattgacagggggcagtgacagacaggccctcctatatataaagtgatgttctgatacacttcgttcctttcatatggaactataaataagagcaggtaaagaatcacttctaaggaaatacagatagagcaagaagcatggagcctccgagtgagacaacaggagccaagtactaactgataaaaaagaggatgccgaaagggcactctctggatctttctaaaatatggctgctttgcggtatttgaacaaatggaaataccaaaattttcgaagatgaaaatcaggaaca

SEQ ID NO: 76374 - DNA, 432 bp, Zea mays
  Clone ID: LIB3079-031-Q1-K1-C10
cttccgccgcgcttcgccctctcgctccagccgcttcacagcgccgccgctcgcctctgcgggtgccgcgagaatgccgttcaagaggttcgtggagatcgggcgcgtggcccttgtgaactacggcaaagactacggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaaccctgatcaaggctatggaggaagctgatgtgaagacgaagtgggaaaacagctcatggggcaagaagctgattgttcaaaagaggagggctgcgctcagtgactctgacaggttcaaggtcatgctggcaaggatcaagaagggtggtgc

SEQ ID NO: 76375 - DNA, 436 bp, Zea mays
  Clone ID: LIB3079-031-Q1-K1-C11
ctctggcattattggcacgctgcacaatactagttagcttggcataggcccagcagtctgaagatggatgctctgcctctgctgcggtagtttctcgggggcaaaccttccacgcggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacgcagtgcatgtataattgtatgggttaatgacgcagtgcatgccttgcggagtgggccggtagacaaacatttcggcggctggtcacttggtcagtgacccgttgatattattattattattggatctaatgcaacaaccaattctggttaaaaaaaaaaaaaagggcgg

SEQ ID NO: 76376 - DNA, 351 bp, Zea mays
  Clone ID: LIB3079-031-Q1-K1-C12
ggtcatcttaataggatggttgatgaactctgcccgtaagtcactgatgcatacttaggggcatcatactctggatacttgacttgctcagatgctagggttatgtggcaccagatatcaagactatccacatgctttcgttttgattctatcacgaaccagcaggatgctcaaagtgcgataaatgacttgaatgggaagtgacttcggaaccactgaattcactgcaattgtgcaacgaaaggtgctaatgctggtcaagagaaacagattctgtacactaatgttgacctgtccaatggctcatgagaatctggacaagagaatacacatgaagatggatctgaaaat

SEQ ID NO: 76377 - DNA, 432 bp, Zea mays
  unsure at all n locations
  Clone ID: LIB3079-031-Q1-K1-C2
cccacgcgtccgcccacgcgtccgcccacgcgtccgcccacgcgtccgcggacgcgtgggcccgcgatgtgctactgtatattacacgaagacaacgtcttgggagctatattcagcctggggaaagagatgagggctgcaacgtcctgngaggacgttgagaacctggtctggggagagctgaaccggtaccaggactctgcagttcgctcagcataactaaacaccagcaaaaaaaaaaaaaaaaactttctgaacatacgtgtatgttgttgttcctccgacgaatgtaacttccaaatataaaaaaaaagtgtagggaaaataacgaaagctcgacacggcatgcccgtattttcctatggctggtgataatattgagatccctgaaatggttctatgaaatgaaccgcagaccgttgaaatcgtttc

SEQ ID NO: 76378 - DNA, 411 bp, Zea mays
  Clone ID: LIB3079-031-Q1-K1-C3
cccacgcgtccgaaggcatgccatcatggtcgtgagggatatgaggctttgggggaaggtcaagttgccctgtctgatcgagcgcagggattcatgctaccccgaggagcattacttccccacactactggatatgcaggattctgaggggtgtactaagtataccctaacaagggtaaattggacggattcggttgcaggccacccacacttgtatgggcctggagaggtatctgcgagcttgatcagggagctgaggaagtcgaacatgacacactcttacatgttcgcccgcaagttttctcctgagtgccttgagcctttgatggagattgcagactcagtcatcctacgtgactagtctgaagcagacaccatttgacggtcggagtttgtacactgaaatgaatg

SEQ ID NO: 76379 - DNA, 57 bp, Zea mays
  Clone ID: LIB3079-031-Q1-K1-C4
acgcatactcttacgattacgcatccgtccaatcatatcgctcacgctttccacgac

SEQ ID NO: 76380 - DNA, 212 bp, Zea mays
  Clone ID: LIB3079-031-Q1-K1-C5
gagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatc

SEQ ID NO: 76381 - DNA, 427 bp, Zea mays
  Clone ID: LIB3079-031-Q1-K1-C6
gtgaacattgagcaggagtgccctgatattgctcagggtgtgcacggtcacttggccgggcgccccgaggagattggagctgctgaccagtggcacatgtttgggtatgcgactgacgagacccctgagctgatgcccctcagccatgtccttgccaccaagcttggtgctcgtctcacggaggttcgcaagaatggaacctgaccctggctcatgcccgatgggaagacccaggtgacagtggagtaccgcaacgagggtggcgccatggatcccatccgtgtgcacacagtcctcatctctacccagcacgacgagacagtcaccaacgacgagattgctgctgacctgaaggagcacgtcatcaagccagtcattcccgagcagtacctcgacgagaagacaatcttccacctcaacccgtctg

SEQ ID NO: 76382 - DNA, 430 bp, Zea mays
  Clone ID: LIB3079-031-Q1-K1-B11
gcagaacaagaactcctcctacttcgtggagtggatccccaacaacgtcaagtcgacggggtgcgacatcccgcccacggggctgaagatggcgtccaccttcatcggcaactccacctacatccaggagatgttccggcgcgtgagcgagcagttcaccgtcatgttccgcaggaaggccttcttgcactggtacacggtggagggcatggacgagatggagttcaccgaggccgagagcaacatgaacgacctcgtgtccgagtaccagcagtaccaggacgccaccgtcgactaggagggcgagtacgatgacgaggaggagggagatctccaggactagaataggctgcttcacattcagtcaccgccagtctatgaaaaactaatcatttgctgcttttcgtcgtcgtcgtagtagtagtaggtc

SEQ ID NO: 76383 - DNA, 241 bp, Zea mays
  Clone ID: LIB3079-030-Q1-K1-H2
gttcatgacgatcatgatgactttcctgagcttgtccctggatagacattttacggggccgtttaagagaaaatggagtccgcattattatgctacatgcctgctcgcgttaaaccattccattacaagggacctgttgagaactctgacctaccttatttgtccctgtggaacatggtgctgtcatgatcgatatttttgtatggccagctcgtgggattatacatgaagcatgcctgtt

SEQ ID NO: 76384 - DNA, 341 bp, Zea mays
  Clone ID: LIB3079-030-Q1-K1-H3
cccacgcgtccggccagagcgtcaagtctggttcgccgcacggcgtcgcgacgccgggggtcatgtcggggaagacgaggccgacgaaggcgacgctgagccggccatgcgttctggtcataggtaatttaactgattaataatgcataccggccgcgactgtcttttgaaagtaatgctagctgccgttgtggtgtgtgggcagtgatggcgggcgtggagaggttcgcgaacaagggggtggggtcgaacctggtgacgtacctcaccagcgtcgtgggcatgagcacggcggcagctgccaagagcgtcatcgcctggaacggcgtcagcttcatgct

SEQ ID NO: 76385 - DNA, 249 bp, Zea mays
  Clone ID: LIB3079-030-Q1-K1-H4
ggtaaacgtgccggcccagcgatcgttatcatctgactaaccagtcaagtaccccgtctgaattgacttttgaggaccattgtgccctgttgaacttatgtcttaccttctgaagtccgatgtgtctggtatctacctgaccgtgcatctatctgatgctggtcttttaatagaaaagcaagcttccgttgaaatttattgtcaatgatggcttacgtataaaggttaaaaaaacggcggcctttttac

SEQ ID NO: 76386 - DNA, 287 bp, Zea mays
  Clone ID: LIB3079-030-Q1-K1-H5
cctcatcctctcatgatcttactacgacattcggatagagatcttgatctgtggccatgaaccagatcgacatgtgggcggatcccttccgcgactgcgtctaggacagcgtccgtctcttgaagctctgctacatgtcttaccggatggaatccactaacgtgtctatgccaacgatattcaggactatattctatggctaacaaggtttttcatctagatcatgggattgtcatcaacatcctcatcaatgccaatcgtccaggttaccatgtctacaatgctac

SEQ ID NO: 76387 - DNA, 333 bp, Zea mays
  Clone ID: LIB3079-030-Q1-K1-H6
cggggattcccaagcggctcaaagaggatgaggagaaagaacagcttgcagaagagctcgcaaaagattggaatgctgtgtttgaaaggagcatcaatacattgttcttgactgaaatggtccgaggcttgatgctaactctcaagtacttctttgatagaaatgtcacaattaactatccgtttgagaagggtcctctcagcccccgcttccgtggtgagcacactctcagacgttatgaatctgtgtaagagcgctgcattgattgtaaactatgcgaatctatatgcctagcgcaggcaattactatcgatgctgcaaaacgtgaatatg

SEQ ID NO: 76388 - DNA, 327 bp, Zea mays
  Clone ID: LIB3079-030-Q1-K1-H7
aagaggtggaagagacattccaacgagctctgggtggcggcgttaatcgagataatgggatactagagattaatggcctaaggttagcctacagccttcaacatgcagattgtgctggagctgtgttctattctgtcatgaagagtgcattactggctgcacaatctagtaatgatactcttttgaagacaactgctgatgcacttggcaagtggaaggatcttttgcgcaattacaccaagacagttgatgaagagatggagatacttttaaagtttgatgatatgtgtcaagagaccaaagtagattttgcatcggtgtttccaa

SEQ ID NO: 76389 - DNA, 364 bp, Zea mays
  Clone ID: LIB3079-030-Q1-K1-H8
gccacccggtcaagctggtgccctacaaccccggctaccaggacgagtcggtgctgtggacggagagccgcgacgtcggccacggcttccgctgcgtccgcatggtcaacaacatctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtgggcagcagctgctgccgtgttgctagaataaaggtggtggcgatcgatcgatcgatct

SEQ ID NO: 76390 - DNA, 344 bp, Zea mays
  Clone ID: LIB3079-030-Q1-K1-H9
agaaaaacttggaaaatgctaaggccagcttagaagtccttgttgctgatcttcagtgtcttgcgagaccagcaaaccatcactcaggttacaattgctcgggtattcaactgggatgtacaccaccggagaagcaaacaggctgtaaaggaaccttaatcagttagatcacgaggtcaaccaatgtgattgggacaaattttttcgtaccttttggtacctctggcagattagtccatcatagcgagctctttgtttgttgatggtttctttgctgtgtaacaatgtatcggtttattctctttaatggtgtgggaacattagtagaagatggaacattttac

SEQ ID NO: 76391 - DNA, 247 bp, Zea mays
  Clone ID: LIB3079-031-Q1-K1-A1
atacgcggacgcgtgggttattcaccaaaatgatgtaatcctaactctaggtcgttctagaacggtcaaggagttcctgtgtgccgcgaaagaaaagaaacgatcttttcgtgtatttgttgctgaaagtgctccaagatatcagggccatgttctcgcaaaagagctggttgagaaaagtgtacaaactacagttataacaaattcagcagtttttgctatgatatctctagttaacacaatcata

SEQ ID NO: 76392 - DNA, 417 bp, Zea mays
  Clone ID: LIB3079-031-Q1-K1-A10
cggcatatttctcctatgactggtgaaagtggtatcagtaccgcgctagacagcaccagaaaggctctgagcagtagtggctgcgatagcattttcaaccagatcactgcccctactgaatcatccaatgtatataaggatgttcctgaaaccccaagcgccgaagggtcacggcatctgagccagcgtgaggctgcactgaacaagttccggctaaagaagaaagataggtgctttgagaagaaggttcgataccagagccggaaattactctcagagcagcgttcacgggtcaagggccagtttgttcgtcaagatcatagcatccaatgaagctaaggtccagttactgagctggaactctattctattatctaaaaaaagtcactgcaagtgactccactgcggtctgcgggt

SEQ ID NO: 76393 - DNA, 418 bp, Zea mays
  Clone ID: LIB3079-031-Q1-K1-A12
cccacgcgtccgggacgctttacggtcagcgccatcgcagcatgcttcgcagagatatgtaccatcccgctcgacacgggcaaggtcaggctccagctgcagaagaacgtcgtcgccgtcgtcgactccggggacgccgcgccagcgcttcccaagtaccgcggcctgctcggaactgccgccaccatcgctagggaggaaggggccgcagcgctctggaagggcatcgtcccgggcctccaccgacagtgcatctacggggggctccgcattggcctctacgagcctgtcaaatccttctacgtcggcaaagaccacgttggggatgtccctttgtccaagaagatagccggcggcttcacaactggtgccatcgctatcagcatcggcaaccctactgaccttgtcaaggtcaggc

SEQ ID NO: 76394 - DNA, 425 bp, Zea mays
  Clone ID: LIB3079-031-Q1-K1-A2
gcgacggctagtccgaccgcactgctcctgtccgtgcggagatctctcgcgtgctgggaggcgcgtactggtgactgggacacgggagaagagaccttggtgggtggcatcggcaggccatggatgcgctgcttgtgacggtgcttcttctcctactatactgtaccctcgccgcagcacaatggtgcgtgtgcaagcaggacgcgttgcaggccgcgcttcagaagaccatcgactacgcgtgcggatccagggcggactgcaacttcatccatgagaccggagcgtgctacaaccccaacaccgtacctgcgcactgatgctgtgccgtcaacagctactaccagaacaacaaggccaaaggcgccacctgcgacttcgacggcaccgacaccctgaccaccagcgacccgagctcttcgggc

SEQ ID NO: 76395 - DNA, 343 bp, Zea mays
  Clone ID: LIB3079-031-Q1-K1-A3
ctcacgctttcaaacagactcagggccttctgctattcaaaactgcaccaggggcaaggtcaccagccagtgaatgactgagtgcagaactagcccaaaccctagaccccgcatccaaatatcccaccaatccaccagatgctatccaagaaaggactctatacaaccaaactccgacttcgagctacatcgatccatagatggtcccggactcgaataccacgcttgctatccatgacgacgaacccatcgtctcctatgtagatcgatcgatggccacagacacataatcaccgacgccgacgacggtgacgactcttgtgatccgcaactaggtataacc

SEQ ID NO: 76396 - DNA, 321 bp, Zea mays
  Clone ID: LIB3079-031-Q1-K1-A4
cggacgcgtgggcggacgcgtgggtgcttatatcactgcaatattatactactagtaggggtgcttgatagcagtgtgtggctgtgctaataccagtataatactggttctactataatacagtcgtatcatgcatggcgtgcatcaggactggttgtgatagtagcaacgtgatgctcgtgcctgtaataagaacaagcaagcgatgtgtgcctgtgatgtaccggtgtcgtcagtgttataagtacttgggtcaaaaaaaaaaaaaaaaaagttaaaaataaaccaaaaactgataaataaataaaaaaaaagggcggc

SEQ ID NO: 76397 - DNA, 409 bp, Zea mays
  Clone ID: LIB3079-031-Q1-K1-A5
cggacgcgtgggttattcaccaaaatgaggtaatcctaactctagggcggtctaaaacgcgtaaaggatttctgggttgccgcaaaggaaagaaaccatcttttccgggatttggtgcttgaaggtgctccaagatttcagggccatgttctcgcaaaagagctggttgagaaaggtgtacaaactacagttataacagattcagcagtttttgctatgatatctcgagttaacatggtcatcgttggagcgcatgctatcatggcaaatggtggagtcattgcaccagtagggatgaacatggttgcacttgctgctcaaaggcatgctgtgccttttgttgtggttgctggtagtcacaagctgtgtccgttgtatccacacaatccaaaaagtgttgtgaatgaac

SEQ ID NO: 76398 - DNA, 434 bp, Zea mays
  Clone ID: LIB3079-031-Q1-K1-A8
ctctctttgcccagttgtcggtcgcccgcgccgtcgtctccgctccgccggggggcctgcgaaaccctagcgaggcgagcgagagagaaactagcggccatgttcggctacaggaaggctgacccggacctcgaggccggcgggtcctcgctgctgtacccgggaatgacggagagccccgagctgcggtgggcgttcgtccgcaagatctacgtcatcctagccgtccagctcgccatgacggccgcggtctccgccttcgtcgtcaaggtgcccgccgtctccaacttcttcgtctcctccaacgccggggtcgcactctacatcttcctcatcatcctgcctttcctcgtgctgtgccctctgcgctactaccaccagaagcatccggtcaatctgctgctgctcggcctcttcaccgtcgccatcagctt

SEQ ID NO: 76399 - DNA, 382 bp, Zea mays
  Clone ID: LIB3079-031-Q1-K1-A9
cgcaggcgccgtcggcgtaggggagaggggcacgggcacggcacggggacggaaatggcggaggggaacggcggcagtcgcgccgaggctggcgtccgcgagtactgcgagccctctccgaagcgcttctcgatccccgccatgccgcacgaagaatgcgttgagggcatccagtatgcgctcaaacatgccacggtgcggttcctgcaggagctgatggagagtgccggatgcctggtgcggccgcgccttatactggcggcgacctgctcctacgtcggctgctaccctagccatcgagggatacaagttcgctgccatcacatgacctgtctagatgagattgctcatgtcatgatgcatgaactggttcatgcttatc

SEQ ID NO: 76400 - DNA, 329 bp, Zea mays
  Clone ID: LIB3079-031-Q1-K1-B10
gttctagatccgacggccttccctttctataacttctatatcctatcactggctggttcatatttggaggattgacaattatcaatgacaacaaattctctatatataaagtaacattttcatacacttactaattaatatataactatactttatatcaataaaaaaacacttctaataaatacacatatacccataaaaatactacctaaaactgacacaacaagaatcaattactaactatataaaaatagcattcataaaggacactatcaacatttttctaaacaatggatcctacgctaactttgaaaaaatgcaaataccaa

SEQ ID NO: 76401 - DNA, 365 bp, Zea mays
  Clone ID: LIB3079-030-Q1-K1-H12
gtgcaccgctaagggtgcggttcactgcaccaaaacccaattttccaggccttacggagaagattggcggatggaatgctaccataatttcaaaggatgaattgagcactcagccttctattgtatgcgagatcgagccatctcttctgcgctcatgtgaggagcggttgaaggatgtccaagggagggtcgaagtgctgtctgtctccacgcacgtagaaagtggcccatctgtggaacaacacaacagtgtggaagtgccacacgcggctcctgtaaaggaacctgatgctgttgctcagataagtgagaccatgcagaaacagagcatttctactgaaagccagggcaatgcacaaggcaag

SEQ ID NO: 76402 - DNA, 433 bp, Zea mays
  Clone ID: LIB3079-026-Q1-K1-A8
aattcccgatcgacgcactcgtactcgtcccattggctattcactagctcggtctagtaagggaacctaggtcatccttccttatatcggggatgaagagcagcacaatcgtcgcgcttctattggctgctgccatactgtcctcactgtctccatgctacgaagcctgctgctgcatcacgaaacccataaagtcaccgtcgtcgccgagaaggccatacttctcgtcctattccgaggaccaccagaactgcctcttgatctgtacctccaagggtttcaaggactgtggctggtgtgactaaagcgtgtagcacaaagtgtgctgctgctcccattagaaatataatagcgtatgttatgttgatgcatatatatatgcatcgtccatctacctgtgtggtgcaaaattctgaataaaatcttgcttttt

SEQ ID NO: 76403 - DNA, 404 bp, Zea mays
  Clone ID: LIB3079-026-Q1-K1-A9
gggatttgattattgattgggtacaagaaggttttcaagagtttttccagaaacttggtggacattttcatgtgctttctgggagaagcaaaacaaatttacaagagccaactatggattctatgcaaactgataagaccccaacagtcttggtacttatgcttgcacaactctgtgtttacattgaacaaacaacagtccctaaagttacagaggagttagcttctttttttggaggtggtgcacatagctacgaatatggaccaccttttgtgcctggagaaatatgtcggctatatcgatcatctggagagaaattcttgcaccattacataaatatgaagacccagaagatctccaaacttcttaacaagcgatttacaacaccagtttggattaagcac

SEQ ID NO: 76404 - DNA, 328 bp, Zea mays
  Clone ID: LIB3079-026-Q1-K1-B1
tggttcgctatctgcatccatgtattgggcacacccagtgtccgcgccacagcacacctgtggcgctccggctcgagatgctttgcacggcgtagctggcaagaagccaggaaccttccctgttccctaccgggcgcaaaggggctcacttttaatttcctcgagaggggactgcctcctttattcggcggcaagcctatttctgccttgttgcctgccactcgggctgtccttcttctatgattcttggcaccgtcagtttaatttcgagaaatggccgcaggggtgatactcaagattgccagcttatgcgtcatctgggcgctat

SEQ ID NO: 76405 - DNA, 399 bp, Zea mays
  Clone ID: LIB3079-026-Q1-K1-B10
acgtgtaaccgtgctttagtctagcaagtttttgctattttactgtatatatactcgctggatcctgatgcatgggggtaggtgtcctgagtcaaaaaccattgtgaaaatagtaccaacacacctgccacatcaagaggtaaactatacaaaaaatcacatttcataatctcttgctgacctgctattttcatccacacttgttaccgtctggtttcgctctaaaagcgaagcttatgtccatctgcatgtattgatgtgggttttttatttaatatattatgagtgctaccagcatgatctgttccattctgatgattggatggatatcgcataaccttagagtgctgaatttactaggtggtcgattcagatagaaatcatcgtacgacgcatact

SEQ ID NO: 76406 - DNA, 394 bp, Zea mays
  Clone ID: LIB3079-026-Q1-K1-B11
ggatgatcttgtctgtgtgaggcagcatcgttcatcaagttaagaccgtggccgcctaagcctaattgtttgggcccctgaattgatttcatggtggatctgaaaggatcctaaacagcaagacccagaaaatccgttaaacagctctgctgtacccacttgtaaaattacatgagccatcgggttcaaagcgaggcagccctctaccttgaatatggaattcttttattggttgttttgggacttgtgaccttctaggaatagctacttaagctgtctaagggttgttatgcgcacaccacattacatggttttcacttcttttaacacacatttaactgatgcaaataggtcttgccattttttaaaaaaaaaaaaatcttttttattttat

SEQ ID NO: 76407 - DNA, 425 bp, Zea mays
  unsure at all n locations
  Clone ID: LIB3079-026-Q1-K1-B12
ctgtcacggccgcttccagcacgcatcattctcgtctcccgtctcgagagattgcagggggcggcgctcgaagctggaggaagcggacgggttcgcgatggggtccgagggatcctcgggtccggtcgtcgttcccagaaactttaggctgctagaagaactagaacgtggtgagaagggcattggtgatggaactgtgagctatgggatggatgatgctgatgacatatatatgcggtcctggacaggaactatcattggtcctcccaatactgttcacgagggacgaatctaccaattaaagctgttttgtgatacggattatccagataaaccaccgacagtccgattccagactcggatcaatatgacatgcgtgaaccaagaaactggattggttgaaccaagtctatntcctatgcttg

SEQ ID NO: 76408 - DNA, 304 bp, Zea mays
  Clone ID: LIB3079-026-Q1-K1-B2
cagattctccgcactctcttcatcggctagtcttgtatccttcaccgcgacatgagaacactaggttgcaaccagatgttgctctgacttcgccgcttggtagctaaagctagatgatggagttgctagcttcacttgcggatgcacgcacgaaggcatcttgttaccttctgtgtatgcataacccctgttgtcaaagtctgatattaatagctgaccgtttgaagacaaagggacgtattggattcatgcaatagcgtaatcttgaaaacaaaattctgaataaaaattggcttttttccgg

SEQ ID NO: 76409 - DNA, 393 bp, Zea mays
  Clone ID: LIB3079-026-Q1-K1-B3
cccactcgttcgcccactcgtccggtgattgttactggcatcatgtctggtcttgatgaacgggttgctggtatgggtgatgtggcagttgttaaccctccttatgtgccaactcctgtggaagaagtcggatgtagaggcattgcttcgtcctgggcaggcggtttgaatggccgccaagtgattgacaggatccttcctgctgtgcgtgagatgctatcagaaagggggtggctgtacatggtggccctcgaagataatgatccttcagacatatgccatctgatgagcgagatggggtatgcattccgcgttatcttgaagaggtgtactgaagaggagagcctttatgttctcaagttctggcgagacccacacgctgttacaagtgtg

SEQ ID NO: 76410 - DNA, 421 bp, Zea mays
  Clone ID: LIB3079-026-Q1-K1-B5
cccacgcgtccgcaagcgcgtcacgcgagcaccgtcgctgccgccgttcactgtcccgctgaacaccagccgccgccgccgccgccgccgtcgccgccgcatgcacgcacgctgcctctgcacgagcggcaagcggcgatccggcgatcctcgtcgatccccgccctaacgcgctgcggtggtccgtgcagcagacaagatgaagttcggcgccacatatgaggagtatctccgggcagagcgggacaaattcctagggcaatgctcccatgtagaatacaaacgcctcaaaaaggtattgaagaaatgtagagttggtcgctcactgcaagcagatggcacaaatggtgatgagcagcaggaggggagagacgaatcttcaaacatttgtgaatgcaactcatgcacatgtatgcccata

SEQ ID NO: 76411 - DNA, 387 bp, Zea mays
  unsure at all n locations
  Clone ID: LIB3079-026-Q1-K1-B6
gcgggccgtgactgaggagcggcggatgctcatgtgggagcagctggagcgaagtgcggctcgcgggtacgaccagccgacgacgatcgctgccgatgcgagcagcttccccgcgccctcttcatcggctcgtcttgtatccctcaccgtgacatgagaacacgaggttgcaaccagatgttgctctgttttcgccgcttggtagctaaagctagatgatggagttgcttgcttcgctgggggatgcacgcacgaaggcattttgttaccttctgtgtatgcataaccccccttgtcaaagtctgtaattaatagctgacggtttgaggacaaagggaccgttttggatttttgcaatggcgtattcttgaaaaaaaaaannnnnna

SEQ ID NO: 76412 - DNA, 386 bp, Zea mays
  Clone ID: LIB3079-026-Q1-K1-B7
cgtgctccccgacgacgcgcccatgcgcaagtacatccgcttctaccgcgacttcgggctcgtcctcaacaaggcgctcgccgccgacgaccgcgtcgagatctgccagctccccgtcggcgacggcgtcaccctctgccgccgcgtcaagtgaaaacatggcctggcctggcctgccccaccaccgccaccgacggcgccgccggccgcatcctcattccaatcataatagacgacccgcagcattaattatccaccggcttttttttggctctttcttgcccctgtaatctttctcctcctcttccttcttgggaattgtcgccgccgtttcgatacgtaaatcacgagatcggtaatacagtaatgctcctcaattttacaat

SEQ ID NO: 76413 - DNA, 401 bp, Zea mays
  Clone ID: LIB3079-026-Q1-K1-B8
cccactcgtccggatggccacagcgcgcctgctccgttgcgcctcctccaccgtcctgttcagcacctgcaccaccaatccgttgcgctcgtgctcccctctcgtccgccgccagcacccccgcgccgccatggccacggactcctccgccgcctcgttccagaagatccagatccagcgcgaggacaccacttttgatgcttatgttgttggcaaagaaaatgctcctggaattgtggttttgcaagagtggtggggagttgactatgagataaagaaccatgcgatccacatttcccaacttggtggaggatacagagcactcattccagatttataccgtggaaaagttgctctcgatgttgctgaggcacaacatctgatggagggtctcgactggc

SEQ ID NO: 76414 - DNA, 436 bp, Zea mays
  Clone ID: LIB3079-026-Q1-K1-B9
gaatgttaacagatcctgtagtctgaagtaacaatttttttttgtcagaattagcaggacatcaagtatgtaggaatactctgctgtgcttctaaggtgaagcgtcttatgttagatgactatcatgctgttacatagcagaaaaacaaaaccacaatgagagcacttggcaggtaccgaattctgagaaatagggaaagaaataacaataataaataaaaaacagctccttttaactgcaaaataggatcaacggaaagcaagccaatctgcatacacgtaacttgtaaaaattggggggtaaaaaaaaaactgtttgcaggcacaagatttcaggcagcagggcaccaaggtgcggcggaagatgtggctccaaaacatgaagatcaagctgatcgtgctgggcatcatcatcgcgctcatcctcatcatcatc

SEQ ID NO: 76415 - DNA, 369 bp, Zea mays
  Clone ID: LIB3079-026-Q1-K1-C1
attaacatggttgatcattcttagatcaaggttcatgtccttggttgttctgcagtggacaagccacttgactaaggctgtattcgcgaattcatcatactttgaagtaattaaattcccaggaggaataacaattatccctccacaaactgcttttcttctacataatcctcatgcctcatttaatattactctgaactatccgatctacaaattacaagacaggacttatgagtcaaaggatcaaatggatgctggactactactcaatccatatgagaatctgtatatcaaattgacaaattcttaatgttcgacgattcttcctccaacaatcgttcataccttcatagacctctaagtctgaaa

SEQ ID NO: 76416 - DNA, 392 bp, Zea mays
  Clone ID: LIB3079-026-Q1-K1-C10
ctcaactcacaccttcaaggtcttgttcaaggacggcggctgtggtactttcgttccgctgttcctcaacgggactgcatctgtgcggcgctacaaccagtttgaaacccagtctgctgctagcatggcacctcgtgtggaccctctgcaagctgtgcatactcctgttgatgacatgatgcgtcatgcgtatgttgacccaaacgatcctaccaagatctttcttcatcaacctgcgccagaatcgcagcttaggaggaggaactaccactgcccagctgatgcaaattagcgcttggctggattggcacaactcatgctcaattaagtgctgagtccatttgagcattttacctatccttgtcctctaccacatctgacttcaatattcg

SEQ ID NO: 76417 - DNA, 351 bp, Zea mays
  Clone ID: LIB3079-026-Q1-K1-C11
caacttcttccatttaaccaattggccgcactgaaccccgctgcttatttgcagcaggaaatactactaccatttagccagctagctgcagcaaaccgtgcttccttcttgacacagcaacagttgctgcctttctaccagcagtttgcggctaaccccgcaaccctcttacaactacaacaattgttgccctttgtccaacttgctttgacagacccagcggcctcctaccaacaacacatcattggtggtgccctcttttagattgcttattagttgtaattcaataataaagttttttggatgatgtatgtggccaaccagaaataagaagttacatttccagattct

SEQ ID NO: 76418 - DNA, 403 bp, Zea mays
  Clone ID: LIB3079-026-Q1-K1-A7
cggtctccctcttcctgtcagtagtagagtgagagtgaggcagcgagtaggagacagggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctcagggagatgcgcatcgcgcacttcgtggtgaaggagccgatggtgatcgggcacgagtgcgcgggcgtggtcgaggaggtgggcgccggcgtgatgcacctgtccgtgggcgaccgcgtggcgctggagccgggcgtcagctgctggcgct

SEQ ID NO: 76419 - DNA, 310 bp, Zea mays
  Clone ID: LIB3079-025-Q1-K1-H1
acgcgttcggcaagggcttcggatcccacaccgaggaaaggagaagagagcgagggtcggaataatggcggccgaagagggtgccgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtaccctttcgcggtcttcctcgaggtctacgtggacgaactgctggaagtcgcgaagatctacggcgtccatgtgatg

SEQ ID NO: 76420 - DNA, 365 bp, Zea mays
  Clone ID: LIB3079-025-Q1-K1-H10
acctgccccagcgcgccgccgccgcagccaccatgggtcgcgtccgcaccaagaccgggaagagagacctccaggcaggtgatcgagaagtactactcccgcatgaccctcgacttccacaccaacaagaaggtgctcgaggaggtctcgattctgccctcgaagcgcctccgcaacaaggtggctggcttcagtacccacctgatgcgccgcatccagcgcggcccagtccgcggcatctcgctcaagctgcaggaggaggagcgcgagcgccgcatggacttcgtgccggagaagtccgcgctcgaggtcgaagagatccgcgtcgacaaggagaccatggagatgctcgctgcccttggcat

SEQ ID NO: 76421 - DNA, 207 bp, Zea mays
  Clone ID: LIB3079-025-Q1-K1-H12
ttcatactttatgacaaaaaaaacaaaaaaaattaaaataaaaaaaaaaaaaaaaaaggaaaagttaaaattaaaacggtgtaacggttccccattatacaacctcaaccatgcgaccttatactcgctctatagttcctatctaccatctctatgttaagcctcaacccttcaagctgccctacttcaaatacccttaactccccc

SEQ ID NO: 76422 - DNA, 299 bp, Zea mays
  Clone ID: LIB3079-025-Q1-K1-H2
tcgccaacgtttcagacggacgcccttgttatcatgtcgttgatgctcatgagagtcaggggagggcttgcaaagattgaggaactatgcgccattaacctcacaagcttctggaaagatcccttattgctagagctgggatgagggcatcgactgctgacatctactttaaaggtgaatactcttaatcatcatgttaaacttgataaagctcgccatcaagcttatgcaactggacttctgggtaagaatgcttgtggctctggttatgatcttgatgtgcatattcattttggtgc

SEQ ID NO: 76423 - DNA, 231 bp, Zea mays
  Clone ID: LIB3079-025-Q1-K1-H3
gtccgaattccctgtggaccgacgcgttcgccatgcttcagataggcgctcttgatatcacgccgtggaagctggttaaagtcaagggtcggcttgcatacatagagagatgatgccccatgaccctcacaagcttctggaaggatgccttattgctggagttggtttgagggcattagctgcttacatctacattagaggtgaatacttgaatgagcgtgttaaccttga

SEQ ID NO: 76424 - DNA, 425 bp, Zea mays
  Clone ID: LIB3079-025-Q1-K1-H5
gaccaatagctttatctacgccagagcgcagaagaacccgaacgacaccatgagggtgacactcgttgccctcgctctgctggctctcgctgcgagcgccacctacacgcatacaagcagccgatcgagctgccagccaccgtcaccagctcatgtacacgacgtcgctgcatctgccagctccgattcacctgccacctacagtgcatctcccaccgccagtccacctgccgccgaccgtccacctgccaacgacggtccatgtgccgccgcccgttcatctaccgccgacaccatgccactaccctactcaaccaccacagactcaggccttcattcccagccacactcatgcccgtgccaacaaccggattcagacccgtgccagctgcacggaacctgccgcgttggcaacaccccgatcc

SEQ ID NO: 76425 - DNA, 430 bp, Zea mays
  Clone ID: LIB3079-025-Q1-K1-H6
caagaaggcagagcaagtcgccggcacgctccggacatgcgaggctgagtccccagaggctcatgcctgcgccacctccgagcaggcggcggccgacttcgctgcctcctcgctcggggtcagggccagcaagctggtcgcgctcgtcaccaccgtccatggggggaaggacgccactagatacgtggtggcgcccaacggcatcacacgcatcggcaaggcggcaggggccgcggccgtagtgccgtgccacccgatgccgtacccgtacatggtccactactgccaccagccggcggacgtggaggcgctccgtgttgagctgaccgggctgccggagacggtggcgtgacaaccgcgatcgccatgtgccacgccaacaccatgaactgggacgatcgctacttccaaatgctgaacgtgacgcgcg

SEQ ID NO: 76426 - DNA, 430 bp, Zea mays
  Clone ID: LIB3079-025-Q1-K1-H7
gaccaaggcagagcaagtagccggcgcactaccgacacgcgaggctgagctgcgacaggctcatgcctgcggcacctgccagcaggcgacgaacgacttcgctgcctactcgctcggggtcagggccagcaagctggtcgcgctcgtcaccaccgtccatggggggaaggacgccactacatacgtggaggcgcccaacggcatcacacgcatagggaaggccgcaggggccgcggccgtagtgccgtgccacccgatgccgtacccgtacatggtccactactgccaccagccggcggacgtggaggcgctccgtgttgagctgaccgggtgctcggagacggtggcgtgacaaccgcgatcgccatgtgccacgccaacaccatgaactgggacgatcgctactttcaaatgctgaacgtgacgcgcg

SEQ ID NO: 76427 - DNA, 425 bp, Zea mays
  Clone ID: LIB3079-025-Q1-K1-H8
ggggacttctccggctgcacgacgcccactggcgggctggacggctggttcccctgggatctgcaccagctcggcggcaggatgctgcagcactcgagcagcgccaacgagctgctcctacgccgaaagctggaggaacagcagcaggccattgagctccagagccgtcgcctcatgggtcttcagcttctcgaccttaaggctcgcgctgctgctgcagcagcatcgccactgccgacaccaattggcgatgccttcgcgtccagccaacctgtgagcaccaccgcagtcgagtcgccatcgccgccagagtccgggcagcagctgctcaagctttgaggagcggatttgctctggaggggaaggtcaacggtggtgataaggaggaatctggtcgcgaggcgagcccaaacgccgatgatagc

SEQ ID NO: 76428 - DNA, 412 bp, Zea mays
  Clone ID: LIB3079-026-Q1-K1-A1
gcaaaatatgacatcatgatatggtcagcaactagtatgaaatgggtggagttgaaaatggaacaacttggagttcttagcaaccctgacttcaaaattactgctcttatggatcacttggctatgataactgtgcaatctgaaaatcaaagtagaaagaagacttttgactgcaagcctcttggtgtcatttgggctcagttccctgagtactacaacgaaaagaacaccataatgtttgatgatctaagaaggaatttcgtcatgaatccacagaacggtctcgtgatcaagccattcaggaaagcgcactcgaacaggcatgatgatcacgagctggtaaagcttacacactacctgctttcgatcggagacctagaagatctcagcaagcttgaccacggttaatggg

SEQ ID NO: 76429 - DNA, 219 bp, Zea mays
  Clone ID: LIB3079-026-Q1-K1-A10
aacaaaacaaatttacaagaaccaactatgtattctatgcaaactcataataccccaacagtctttgtacttattcttgcacaactctgtgtttacatttaacatacaataatccctaaagttacacattatttatcttctaaacttttagtttcctcacataactaccaatatttaccaccttttttacctctataaatattttcgctatatccatca

SEQ ID NO: 76430 - DNA, 424 bp, Zea mays
  unsure at all n locations
  Clone ID: LIB3079-026-Q1-K1-A11
acgtgacgtctggctcgtcagcgctgtgcctcttcctctacgccacgttctacttgttcagcaagctggaaataacgaagaccgtctccggcgtcctatactttggctacatgctcattgcctcctacgccttctttgtgctcaccggcaccattggcttctacgcctgcttctggctcaccaggctcatctactcttcggttaagatcgactagagagtaacagctgcaacactgctccgtgggttttcgaaatcagagatcaagagagaatactaggtaacgaaccatcagaatttgagaaggtagtgtgcgttatttttataaggtggaacttcaaacgtanggtgcttattcagtgctttagggtttttacagtttgattctggaacactaagtcagtttacttcgaagtcagtattttc

SEQ ID NO: 76431 - DNA, 432 bp, Zea mays
  Clone ID: LIB3079-026-Q1-K1-A12
acgcccacgcgtccgcgaggaccgcccgtttgcgccacactacttcggccgagggaaaaggaagcgcgtttagggaccaccaccagatccttgttgctggattctttctttgctactagctaggtgtcccttctcctatcagacagactataagggcaggcccgtcctcaccgttccgccgccgcctcgaactggaggagcgagcatgtatcccgcaccgaaacacacacgcaaacggcaccaccaccaccaccaccgtccggcgaggtagggaggcagcggcgccatgggttgctatcctcccctggccaagatcgtgtctagagcgctcggaaaatgcaacggcgggcgcgagagatggcttgaaaggaggctggagctggactttgatcacgccttgggctgtcagcccacggagacccactacatgcg

SEQ ID NO: 76432 - DNA, 396 bp, Zea mays
  Clone ID: LIB3079-026-Q1-K1-A2
cgaggcgacaccgtggatgaggaggacagcgacgatgagtttaagggtttcgacgaggatggcgacctgtgtctgccattcgtcgtctcctgggatccgccaccagtactagtttgcacggcaggagcaagttttacgatggaggaagcagaagaaatagttgactctgtcaatgaaaggaacgatgacctgctctcagcatggtgtgaaatggttaacaacaaagtgactcctttgcctgcaacgcctctacatattcttccagccataaccacattctgtgtttctggatatgagtgctaccacctgcgatattggactgaaattacttctgaaactgatccagatcatccatatttcaaaccctgtgagatgatgcaagtgttctccttggga

SEQ ID NO: 76433 - DNA, 390 bp, Zea mays
  Clone ID: LIB3079-026-Q1-K1-A3
tgtcactactaccatacaggttagtgcacggtccttacctttatgttctacatgtcggtgtgggtctctttttttcaagggcgttctattattgtttatatgtccaccttcacactgattagctgttccttgttcctacacaggtattatctgtcatgtacatttttatacctttccaaattagcttattatctttaaaaaattgtattttcttggctactttacatttgcatgaccagtggcaacatattgaaacactcatagctaacttagaggaaagaaaacataatctttaaattgctcataagagagaatgtcatttttcagaaaaaaagacaaacagtattgatgccttataaaatcttaaactgatgcatgttaatattatca

SEQ ID NO: 76434 - DNA, 363 bp, Zea mays
  Clone ID: LIB3079-026-Q1-K1-A5
actgaagaagccactctatagcgggttctactactagtagctagcctgctgatctgggctgttgatcagttcgctaagccttctgtttctgcgaccatggtggatgagaggaacacccagcatcaccagtgcggtcaggtccagcaggacaccgatcgatcaggtggacgtgaatgatatggagctcctgaacagccttctcggcaggaataaccacgactacgaccagcacaagaagaagctcacggataaactggcgaccagcatggacaaggtcactgtgtccgagcccgataagcacggtcacaaggatgatgagcacgatgtcatcggcgataataatgagggccttattgacaatct

SEQ ID NO: 76435 - DNA, 271 bp, Zea mays
  Clone ID: LIB3079-025-Q1-K1-G9
aaaaaaaaaaaaaaacaaataaaataaaaaaaaacataaaataaaacacctataaaacaaggcaaggaaaaactcgagcaggcactatcttaaatttttctctgcttccacacccttccatgcatcaccatccttttctctatctgatctggcttatctccagcgccacccaacttaaccccctttcactacatgccccttttgattactgccttcatagcgattactccctatccccttttcgttcttcccagtatcaattactcttatc

SEQ ID NO: 76436 - DNA, 399 bp, Zea mays
  Clone ID: LIB3079-026-Q1-K1-A6
tcgacgtagaccaaaaaacggtatcagtgggacaatcttcgtgtacgaaggtcgaatccttgagggcgaggttttgacaagtacaacatcaacacatgatcctttagtaaccgtttcaataggcgtacccccaagaactagtaaacatggcaaaactgttgagcctgttcttagccctctcctttgtagcagctatgtttgccataggctctcatgctgatggagactgtgagaatgacctgcaaagcctgataagtgactgcaagacatacgtgatgttcccagctaatccaaaggtccctccttcggatgcttgctgtggtgtcatcaagaaggcatacgtttcttgcttgtgctccaaggtcaccaaagaaactgaaaaagttgtgtgcatggaga

SEQ ID NO: 76437 - DNA, 158 bp, Zea mays
  Clone ID: LIB3079-025-Q1-K1-F3
gtcattgcaacctggactctacttagctccttgttcgagatccgccgctccttccgggggggcgaatccccttctttggggtcattgagcttcgtcaaggcgcagctcatccgcctctctgtattcgccataggagagcctacaagcatgggaggcct

SEQ ID NO: 76438 - DNA, 405 bp, Zea mays
  Clone ID: LIB3079-025-Q1-K1-F4
gcaattagctcatcgactccagattggagaactcgacaccatgaaggtgctgatcgttgccgttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccccctacggctcgccacagtgccaggcgcttcagcagcaatgctgccaccagatcaggcaggttgag

SEQ ID NO: 76439 - DNA, 425 bp, Zea mays
  unsure at all n locations
  Clone ID: LIB3079-025-Q1-K1-F5
ctttccccgtgcttctccgccgtcgaggccgcgtcccagtgcgaagagactccgactgagatggccagccgctgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcaattgttgattggcatactactactactacttgctactggggattntacactttgctggcaactcaatcatgtggggacatccatgacctctaaaagt

SEQ ID NO: 76440 - DNA, 434 bp, Zea mays
  Clone ID: LIB3079-025-Q1-K1-F6
cccacgcgtccggagagacgcacatctatctgtcaagcgacgccgcggcctcgatcagagtcggaggcgaacacccgcatggcggcggctggcggcggcgcatgagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagtgcaggcaacgtgtttctgaaacatggttcggagctgcgtctcatccccctcgcgatagagttggagctgtagtcatgtcttccggttagaggatatatacagtccaatgcataatgagcataacttgagagaaataaagctttgat

SEQ ID NO: 76441 - DNA, 226 bp, Zea mays
  Clone ID: LIB3079-025-Q1-K1-F7
aaaaaaaaaaaaaaaaaacacaaaaaaaaaaaaacaaaaaaaaaaaaaaaaaaagagaagagaaaaaaacaaacactgtaaaaagaacaaaaatacaaaaaaaacaaaaacaaaaaaataaataaaaaaaaagggtcacctattttcaaaaacctggccttactttctacagcttgctctctgtgaaaccctttaccttgcccctctaattcactttgttagccca

SEQ ID NO: 76442 - DNA, 438 bp, Zea mays
  unsure at all n locations
  Clone ID: LIB3079-025-Q1-K1-F8
ggccggtgacatggcagttctttatttccagagggttacaaactatgctcagacaaggtcttatgaaatcttgcagtatattgcctcacagtcaccgactcaaagacaggcacatcagcagcagcaacgcccaccaccgccacggactcggcaggtcaaccctgcacctccacctattcccgcaccctccgcgcctccgatgccaccacagcctgcccaagcccaagttcctcccactccaccaaggcccctagttccagtggttcctcctggcgcagtgcctcctgccccgccaccaactgctcctgaagccaccgncaccaacggtcttcaggaaccaccgaaaccatgcaagtcgacccacctcgtgcttcactgagcggcccaccactaccacctgaagagacgctcatcgaggaggcgatccggctgacccgg

SEQ ID NO: 76443 - DNA, 363 bp, Zea mays
  Clone ID: LIB3079-025-Q1-K1-F9
ttcgaattccctatcgacccacgcgtaccaaaaaaaataaaaaaaacaaaaaaaacaaagggttaaaactaagaaaaaaaaataataaggaacgtacacttacaaagtgggaggtggttaaagaaatctgtaacttatgctgaaagtcatgatcaagcattaatcggtcatcagactattgcgttttggttgattgaacaatgatatgtattatttcattgccctccatagacctttaacttctaccattgatccatcgatagcattacataagaagatttcacttatcacaatgggtttaagatgataaggctatcttaatttcatgggaaattaatttggacatcctgaatggatagattt

SEQ ID NO: 76444 - DNA, 321 bp, Zea mays
  Clone ID: LIB3079-025-Q1-K1-G1
atcttagttcttgatgaggccacggcatctatagacaacgctactgatgctatccttgagaagacgatcaggacagagtttagagattgcactgtcatcactgtcgcacaccgtatacccaccgttatggactgcgatatggtacttgcaatgagtgacgggaaagtagtggagtacgacaagcctacaaagctcgtggaaaccgaaggatctctcttccgtgatcttgtcaaggagtactggtcatacacatcgaattgaaatatctaggagaaactgtgacaatcacatgttcactcgttgcaatctcttaaaaaaaga

SEQ ID NO: 76445 - DNA, 245 bp, Zea mays
  Clone ID: LIB3079-025-Q1-K1-G11
acggctgacgccaggaccacccaacccactgcccttttcagagatctctccgcctccgccgggtacttcagtcgggcgactattccccgtacggacttacccgattgcacggcatcactgtcttgatgccgctctgccgctcgggatcatcgctgagcatgctctgcatcatgggcaacgcccactatttcatccacaatgcacgagcacggcatgccgaagcacatacctaacgatatgttcga

SEQ ID NO: 76446 - DNA, 416 bp, Zea mays
  Clone ID: LIB3079-025-Q1-K1-G12
ggcagactctattgactaccatatcatagaagtagagccacattatgcgggaccgagaattgatggggaagaaataacgatagagtttgtcaaagcaatgttggatgaatttaagaagcagaaatgcatacataaaagatatgcttaccagattgtgctaaaaaccttggatttgctgcgatcgatgccttcccttgttgatgtggatgttccaaacggtggacattttacagtttgcggtgatgtgcatggccagtactttgatttgctcaacatatttgacctcaatggccttccatcagaagaaaatccttacctcttcaatggcgattttgtggaccgaggatctttctccgttgaagtcatactcaccctttttgctttcaagtgcctctacccaaaagctatgtaccttg

SEQ ID NO: 76447 - DNA, 65 bp, Zea mays
  Clone ID: LIB3079-025-Q1-K1-G2
aaaaaaaaaataagaatggaaaaaagtataaaaaaaaaaaaaaaaaaaaaaaaaaaagggaaggg

SEQ ID NO: 76448 - DNA, 435 bp, Zea mays
  unsure at all n locations
  Clone ID: LIB3079-025-Q1-K1-G3
acgtgaagagggacttcattccggctctggtgttaggcggaaccatctggcctgctgtgcagatcgcgaacttccgcttcgttcccgtgcggtaccagctcctgtatgtgaacttgttctgcctcctggacagctgcttcctgtcgtggattgagcagcagggtgacgcctcctggaagcggtggttcacttcgttccagaaaatcgaagaccagaagggtaaggtttgatttgagtcatgcatggttcgttgtctggatcagtacctgtaaactccggttgatcaaggaagataattgcgatgccagcaagggctgaacatntggcgtcgctaatttagagaattctttttagtctttgacgggatgaaacggttgccgagttgctctgttaactgaagtgcctgtgttttgccgatgtgttaaactttctttt

SEQ ID NO: 76449 - DNA, 318 bp, Zea mays
  unsure at all n locations
  Clone ID: LIB3079-025-Q1-K1-G4
cggacgcgtgggtggcttctgagtcctatggtgctgttacgatggtcacctctctggatatgctaaactggttgtgccctgcaatgtagcccggctagaagctcttctgtttgaagcgaaaagtgaatgggctgaagctgaaagagcttacacgcaaatcctggaaatcaatccatttgaccagattgtccacaagcggacgcgtgggcggtgagaacgaaatccagcattcctggtgcacaacacagcacaggcagcagcgtacctagaatgccgncgtcagccggcggcaaccctgcgagcgacagcgccgcgggc

SEQ ID NO: 76450 - DNA, 430 bp, Zea mays
  unsure at all n locations
  Clone ID: LIB3079-025-Q1-K1-G5
gagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgggcgcaagcacaccgnccccggtgtgctctccatggccaacgccgggcccaacaccaacggctcccagttcttcatctgcaccgtcgcgaccccttggct

SEQ ID NO: 76451 - DNA, 434 bp, Zea mays
  Clone ID: LIB3079-025-Q1-K1-G6
cccacgcgtccggttaactcgtgggacagcgtgtggactgagaatggcaagggaaatgaaagggcccgtttgggcacagtgaggcagttctcctgaaaggagaggagggcgagtttgcttgtggaagagaaatctgcgaatatctgttcggatgcgttttgcatatgcatagaaggcatagacaaggaaccccttatgcctttttgtatttgtcatgttcttccatggtgtacatatagatcagtgtgcaatgagaaatgtgagcgggtaatgtacggctttcccccccaaaatattactgcaatagtaccgtttgtacttaaaaaagacggaaaacacaatatagatgatcctttttatttggcctgttgctacatataaggttgtttatacatggagtcttggcatgtggtggtgccaggtattagcaaaaa

SEQ ID NO: 76452 - DNA, 439 bp, Zea mays
  unsure at all n locations
  Clone ID: LIB3079-025-Q1-K1-F2
cttcatccatcctggcgtcggtgtcttgccctgccccagcgccgccgctccttcccggaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccncccactccccaaccctaacctnccccctgtagcacaccccacctncagctntgtaggtcctactatacttgcaacctctcccgncgactcgcttcgatcta

SEQ ID NO: 76453 - DNA, 430 bp, Zea mays
  unsure at all n locations
  Clone ID: LIB3079-025-Q1-K1-G7
cctttgtgttgaatctggccttttctttgagcgttcttggttttatgattatgcgatagttcacttgtttctgctaatacaacaacaattgaggcatatgagaagaagacaactccacattggatatatgatcttggccggaagaggaattttgctcaggtttttggaaatgacagaaaatattggttcatccctgcatactcagaagaggatttgagaagaactccagctctacagggtctggattatcctgtgagaccagattttgatggtcaggaactgtaacacagcaatttttgccagtgtcctcgtcagatacctcagtgttgggaacatctactgatacaactgacagcattgctgattgcgctatgcaaggcatcaaatgaaatgttcacaagattntagtaaccatgagtaattcatctgt

SEQ ID NO: 76454 - DNA, 427 bp, Zea mays
  unsure at all n locations
  Clone ID: LIB3079-025-Q1-K1-G8
ggctgatcggcggcacgagcgcgcacctggcggccgtgctgcagggcctgctgaaggtggtggcgggcatcgagatctccttcactctgacgtccaagtcgggcggcgacgacgtggacgacgagttcgcggacctgtacatcgtcaagtggacgtcgctgatgatcccgcccatcgtgatcatgatggtgaacctgatcggcatcgcggtcgggttcagccgcaccatctacagcgagatcccgcagtggagcaagctgctgggcggcgtcttcttcagcttctgggtgctggcgcacctgtacccgttcgccaagggcctgatggggcggaaaggggccggacgccgaccatcgtcttcgtctgggcgggcctnctctccatcaccatctcgctgctgtgggtggccatcaacccgccgtcccag

SEQ ID NO: 76455 - DNA, 431 bp, Zea mays
  Clone ID: LIB3079-015-Q1-K1-D6
cggacgcgtgggccccaacgacgtgtctcatcgccatcacgaggaagaagcccaagtggagcaagatcctggcgcacttccgctcgtccagctccgacatgaaggagctcgtgctgtccctccccaggacggcgcagtctgactccggcgaaaccgagaccgagccgtccgtgaccgccaaatcccgagccgagccgtgagtgactagctcccggtcgcggtctcgttctctcatgtatagctgctacatcccttagctagctgcacacagagcgaggctactgtatagctactacgacgaagaagtcgccgataagcaagtgtgcagtgcaggcacgcgtccatcgatcggcctaaagcggctgcagcagtcggtcggtcggtcggtcggcgtggattaaatgatcggacatatacgaatggtgcacacg

SEQ ID NO: 76456 - DNA, 400 bp, Zea mays
  unsure at all n locations
  Clone ID: LIB3079-015-Q1-K1-D7
ctttggccacagtataactatgggggctggccatcatgctgcagaccaaccagattcgacatatataagatcttaatgttgatgccgatactcgagaagtattggccgtccttgtactgtggttcttcttcaacctgctttggtggaagggggccattttgggtgcatgagtgggaaactcatgggacctgtgcttaccctgaaatacaggatgaatatgactacttctccacagcactgtatctctacagcaaatacaatgttacgaaagctctgagaaaagcacgtatccggcctacaagcggcagaaaatacgccgttggccatattgttgccgtcattgaatatgcgtntggtgcaatgccgtcactcgtctgtaagaacggctcagttcaagaac

SEQ ID NO: 76457 - DNA, 330 bp, Zea mays
  Clone ID: LIB3079-015-Q1-K1-D8
gctctccatggccaacgccgggcccaacacgggacgaccccaagtgcgaggagatggtgccctgcaccttcaggcgctgcatccagtactgcgtcagcatcgggctgcagcccaaggggttctgcaactccaagcccaacatgcaggtctactgctgctgcgtcatcccctagcatcatagctcctcgtcaacacacctaaatctgcagccctgctagagaagatacgatctctatgcagattagctgcagcgatatatatagatggatgaatcgtgcaagcggttgaactatggtgctggaatctgtaatatatataagcggatcatcc

SEQ ID NO: 76458 - DNA, 361 bp, Zea mays
  Clone ID: LIB3079-015-Q1-K1-D9
gcaaaacaacatagtgcagctaacagatataaggcgacagcatgttaaggctcaaagaagtgaagcgggtggctactcaaatgagagcaaaggtagcgagggcaagaatgatgttgtctatcaatcagcaacacccgtcatggattcgaactcatccaatcacaggaatgtgccaagatctgatgtgaaaaacagcggcgtagtttcacactctagagcctggaagccgaaaaccaattcccatcctcaggacagctcagacggcaagattgctgttgacgggcaagttgattctcatggtggtaggcttgagatgaatactttcaaaagatctgatacaattacccatctagtgaccagt

SEQ ID NO: 76459 - DNA, 272 bp, Zea mays
  Clone ID: LIB3079-015-Q1-K1-E1
gtgctttgaagcattgcttctaccatctactttaaggatgagctttatctgaacgtattggtcgaatatgtgccctagacagttcatccagtcgtgaagcatcacaacaagatgaaccaacgcatgccacttatttatgtgaagctgtatatgtaccatatatgtatggcatttgcttacattcatggcactattgctgactgccacagagatattaagccacaaaaccttttggtgaacccacacatctaccagcttaaactatgtgactt

SEQ ID NO: 76460 - DNA, 55 bp, Zea mays
  Clone ID: LIB3079-015-Q1-K1-E10
agcagcatgacattgctgacacaccatttccatctataatggacaacagagagca

SEQ ID NO: 76461 - DNA, 222 bp, Zea mays
  Clone ID: LIB3079-015-Q1-K1-E12
gccacgcgtcgtcctcggccatcgcttctcagctaactgggagcactgggggaggacatcgagccggctcgctgaccccggcgtgaccgacccgtcggtgcgcgaggcggcgcggatcctccgcctgaccccgggtcgcggctggtccgctcgagtgctccgggggcgactggcggcatcgcacccgcatttggccaacaccaagtcctggcgtatcgtacc

SEQ ID NO: 76462 - DNA, 452 bp, Zea mays
  Clone ID: LIB3079-015-Q1-K1-E2
gctggcttgggcccagggcggctgcatgggaagggttgtagtctgttggccttctagccttgggcggtgccccttcgaacataatgccatccagggccattgcattgcttgcttcctcaacagatctcatctccacaaaagcaaatttcttgtcatgatttatgtatacattgagaacagcatcacctggaccagcagtgtttcccccaatagcagccatgacttgattaaagtaaattgccactgtctgttcgttagcagatggaggaaggccaccgacataaacacgccgagcatgacgagtagcctgttgagtcattgcttgtggctggatgacaaggggattgaactgcccagcaacaccgaaagggagcatgtttggaaacatgccaccaatgttgtgaagcgaagagcctggttactgacctgcagggcatcaataaatttctagt

SEQ ID NO: 76463 - DNA, 245 bp, Zea mays
  Clone ID: LIB3079-015-Q1-K1-E3
cggactcgtggggtcggagatgtcccttaagattcagccgcaggctagcgccggcccgcttcgcgcctgctttggtggaggtggtgagcctagtgggagcacatcttgcttcttcctgccccatctccctgtctagcctaagctgcatatgatcgtccttcgtgatttcaacacttatgttattcacaacaccattgctcttgatccccttttcagtagagtctaagaatttgacaattgcaatt

SEQ ID NO: 76464 - DNA, 261 bp, Zea mays
  Clone ID: LIB3079-015-Q1-K1-E4
actaccattatcaagtccccgaaagcatcgtttcagactagatgctcccactaaagctccggggcttgttctactggttctgaaccaaaccgttcaccagcaaactttcctgatcctctaccaccatcaccttcaatgaaatatgacgagattcttgctccatctcattagctgatcaagcaatcatctatcctgcatgctgttattgaaccaagtgctactgaaattatcaatctcatgcatagcctacatgaatgctac

SEQ ID NO: 76465 - DNA, 242 bp, Zea mays
  Clone ID: LIB3079-015-Q1-K1-E5
cacacgtattgctactatcgtctactttctacatctttagcttaccacttatgacatagtcacatttatagacttgtcatcggttacaattcacatactagaatcatgttagctctactacctattcttgttaaataattctgacccctttctacacataatcatcacttctgagttctatactgttacaatgttcgtatacgctaaattcactttattcacatataatttccctaaacttt

SEQ ID NO: 76466 - DNA, 415 bp, Zea mays
  Clone ID: LIB3079-015-Q1-K1-E6
cagaccttcaaccgctacatttccgttactaccggagccgccactcccacgaacgcgggcggtttaacggaagcgaaccagttatctagtggagttgcctccttcaagctactctaatgtcctttctattcaagtctagcaatggcggcaccactgaaaaaatcccatccccagaagaacagcgagaaaaaataaatgaattacgcaaggagcttggtgaacactcatcagcagccattaaagacttcctttcagatgcctcgttagcgagatttcttcgagcaaggaactggaatgtgcagaaagctagtaaaatgatgaaagcagctgtgaagtggctgcttgcattcaaacctgaaaacatctgttgggatgatattgcagaggaagcagagactggaaagatttatagagc

SEQ ID NO: 76467 - DNA, 414 bp, Zea mays
  Clone ID: LIB3079-015-Q1-K1-E7
gagaaattgcaagatttagctcaactttagttaccggattgaataacaacgaataccagataaccaggggaaaggagctcaaccgtttagcaggaattagtggaacatgtgattttgtcaaggcggacttcatgaagatgccgttcgatgacaacacttttgatgctgtttacgccattgaggcaacatgtcatgcacctgatccagttggttgctacaaggagatatatcgtgtgttgaagcctggccagtgctttgccgtgtacgagtggtgcattacggatcactatgatcctaacaatgcaacccacaaaaggatcaaggatgaaattgagcttggcaatggcctgccagatatcagaagcactcgggaatgtcttcaggcagtaaaagacgccgggtttgaggttgttt

SEQ ID NO: 76468 - DNA, 391 bp, Zea mays
  Clone ID: LIB3079-015-Q1-K1-E8
gtcaaatcaggcctcctcctcccggttccggttccaccaacgaccaagcacccatcggtactcgagtctctgcgaatccgttgccggtagcctctctgcggtgagagttctgctgccgcctgctggagatgatggacgacggaggaggaggcgtgcagtcgcagggcgtcaacccggactgccccaacgccgccaaccccttccaccgctgcgccgcgtactgccccgtccccgccccggcccccaccaaagccgccgccgccgccgtgcgcagcaagccgtctccgcctcgtccgagggcggctgcggtggctgcgcagaacgggacagccaagcacggagacggcgctgcgcgtgtcgctcccgtcttcgacgccgatgacgacgacga

SEQ ID NO: 76469 - DNA, 429 bp, Zea mays
  Clone ID: LIB3079-015-Q1-K1-F10
tgagtatgcatcaaaagcagatgtccattaaccatagatatttgttgatcatgatgtgtcctggcacctgccccaagccatcatgatgctcatggccagttttgctctggaggtattgtattggcttctcgagatggaaagattgtgtttgagagtacacttgacgcaagactagaagttgttttccgcaagaaattgccagagatccggaagcttctttttggccagactgcagcctaatcgactcatctgccgatggtacggctgcttctatgtaatggttgccggctgcacgcctgcactgcagccataaggaactccgcctgtttttgtcaaattgattgtttaaggtattcatcccctatgtacaaactacctattggttcattattgtcgccgagagcaccgactgtttgtactctgtttgct

SEQ ID NO: 76470 - DNA, 448 bp, Zea mays
  unsure at all n locations
  Clone ID: LIB3079-015-Q1-K1-D5
atcggcgtcgatgaccctaccactcgctggccctcccacgccttccccggcatggccgagcccaccccaccgtccctcccctcgtccgactgcgcagacgtgctcgtgggatcctccgccccctccttcccctacatccgcggctggtcattcacctccgactcgggcgctgctatgggttctgtagaggaacatctccaacccaaggtgtgcgtgcagacgagcacctccgcggggcttgagcagatcctgccctggctcttctatcacaaggtcgtcggcgtcgcgcagttcctgctcttcgtggagggcaaggcggcgaaacccaatgtcgcgggagtcctcgagtcaattcctggggtaaaagtggtgtacagaactaaggatcttgaggagcggcaggcacggagtcgaatctggaatgagactnggctttcaggatttttct

SEQ ID NO: 76471 - DNA, 422 bp, Zea mays
  Clone ID: LIB3079-015-Q1-K1-F11
tccagatggaactcaggacattgtaaatcagctgcagcaagtatatggtgaagatttggttttagtgcgagctaggccaaggaagctagggcttggtaccgcatatttacatggactaaagcatgccttaggggaatttgtcattatcatggacgcggacctatctcaccatctacaatactagccaagcttgattaggaaccataaggaaactggagctgacattgttactggcacacgttatgacaagaatggtggtgtccatggttggaatgttatgctcaagctgactcgcagaagtccaaatgttcttgcacaaacgttactgcagcctggagcttcagatttaaccggatcatttaggctatataagcgagatgtcctggaagacttaatctcctcatgtgtcagcaagggctacg

SEQ ID NO: 76472 - DNA, 433 bp, Zea mays
  unsure at all n locations
  Clone ID: LIB3079-015-Q1-K1-F12
cgaaaattatgttttgagggaccaggatactcggtatcgtcaaaggtatcttgatctgatggtagaccatgaagtgaggcacatcttcaagacacgatctaaaattgtctcatttatccgaaagtttcttgatgaccgtgaatttttggaggtggagactccgatgatgaacatgattgctggtggagcagctgcaaggccttttgttacacatcacaatgaattaaacatgcggctttttatgcgcattgctcctgaattatatctgaaagaactggttgttggtggattggaccgtgtttatgaaattggaaagcaattcaggaatgaaggaattgatttaacacacaatcctgaattcacaacttgtgaatnttatatggcgtatgcagattataatgatttgatggagcttactgaaaaccatgtgtca

SEQ ID NO: 76473 - DNA, 424 bp, Zea mays
  Clone ID: LIB3079-015-Q1-K1-C10
cagaaaaagggaagacattcactctttcaagattcttttcctcatcggtatctagggaccccggtaaacatagtgtttgatggcaccattcctctactaaatgggggtgaggcattgaaggaacaagtggccatggatccctggcgggtctcccagtcccatttgacgatgaccacatcttcttcatctctagactcaagctcaccagaatcaatgaagcggatgcgggaaagtggggatgaaattccaatcacaagggacactgattgcctacaaagtggaaagctctgtgtgcagctgaaaatgttcaagcacagagatggagtgaatgccgacgcaactaatgccatttttcgctgacgaaaacaaaacttcgcttggtcttcatattgtacaaagtaacaaagaaacatgacttgtttgc

SEQ ID NO: 76474 - DNA, 435 bp, Zea mays
  Clone ID: LIB3079-015-Q1-K1-C11
cagaaggccgtcactatccgcaacgacatcaaccttaagaaggagacgcttcggatcgggcctgaggaagaacgccctggccgcttcctcgtcgccttcacctttgacgccacggtcgctggcagcatgactgtttacttctttgcaaaggaagagctcaactgcaatctaacaacagtgaaagaagacctaattaagcccattactgttagcttcaaagagggtcttggtcaaaaattcaggcaaccttcaggaacaggaattgacttttcagtgtttgaagaatcagatctattaaagcaaggggacatggatgtatatccacttgcagttaaagctgaaacaacattgtctgttgatcacccaccagaaagggatgaccaaaagatgattactactaactcacagatcacccaggccgtttctgaaaagaaa

SEQ ID NO: 76475 - DNA, 112 bp, Zea mays
  unsure at all n locations
  Clone ID: LIB3079-015-Q1-K1-C12
ccgatccgaattggggatagcctaccaagctnntgtatgcaagtctttgcgcattagnatnngggaagaaaaaggggaagtcaggggggcaatgcgacagcannnatctgga

SEQ ID NO: 76476 - DNA, 430 bp, Zea mays
  Clone ID: LIB3079-015-Q1-K1-C2
cttttcggtgcctatacagaacttgatggttgttgcaagcaggctctatgagcagagtgagcggaaacttcagagtttgcaatttgagaagcaacattggtctgacatgctgcagcagaaggaagccattatccaatccctaaactcagctcgttttgagcaacataataagtatcaagcggagcttagacgcttcgagcatgatctgaatgttatggctcagttggtcactacatacaaaaaagctttaaaacagacccgggcttcttttgatgagtacaggaagaagttcccttgcaatgttcctctttatggtgatgttgcttgtggcggtggtcttgttcttagtgtgagggagttggagaaaaggctgtgttgaggagcaacatcaaaaatattgccatggtaaaatggtattgattgaaaagat

SEQ ID NO: 76477 - DNA, 398 bp, Zea mays
  unsure at all n locations
  Clone ID: LIB3079-015-Q1-K1-C3
agcttaccagatactcaaggattaatgatctctatcaactctcttggnnaggggcccaagtgacagggagactgtagtcttgagattcaaggccaatgcagatgcctgcactcactaaaggcgaacttaaataggatactcttgcatactcacaactgggcagcctcctggataagaaatcaacgtagatacctgactcgtgactaccttcatgagncgcgaaagaagcaaaggagtatggccttattgatggagtaatcatgaatcccctcaaggcccttcaaccacttccagcttccagttagtcatgaagtgtgctagaactccgtcaaacatttttgttgtatcaatgtgtctgttggaaaccctggctacgtaatattctacgtncaaatgca

SEQ ID NO: 76478 - DNA, 295 bp, Zea mays
  Clone ID: LIB3079-015-Q1-K1-C4
gccacgcgtcactccacgcgtacgccatcacttctatcttcattcgctcctattaatgcccagttcttcttaccctttacaattcccacatattttatccagattcatatttacatctagctactctatctatcttgctcactactcatctccatcacttcaaactaattctactatatccatacttatcactttatatcaacatatattaaacctttctttcatcatcatgcacatgtatacatacatttccgaattttatatccgtttgacataagctccttactttgaccac

SEQ ID NO: 76479 - DNA, 130 bp, Zea mays
  Clone ID: LIB3079-015-Q1-K1-C5
aaaaaaaaaaaaaaaaaaaaatagaaattaaaaaaaaaaaaaaaaaaaaaggagaaacggaggatattaaagaattcgaggacctggcaacaagaaacagcaacagtaacaagcatacgctgcctaatgg

SEQ ID NO: 76480 - DNA, 431 bp, Zea mays
  unsure at all n locations
  Clone ID: LIB3079-015-Q1-K1-C6
gccaaattctgtgcaaaatatctacacagagaagttctccataccgaagcctatgcggctggtgacctgggtgctgctgtccacagagcttacttaagaatggatgaaatgatgcggggtcaaagaggatggcgggaactccaagcacttggagataagataaatcagttcactggcataatagaaggcttgatttggtcccctaaagcaagtgattcaaatgatagacatgatgattgggctttcgaggagggaccacactctgactntactgggccaaattgtgggagtacagcatgtgtagcattagtcagaaataggcaactcgttgtggcaaatgctggtgactcccgctgcgtcatctcaaggaatggccaggcatacanattgtcaagagaccataaaccagagcttgatgcataaagagaaag

SEQ ID NO: 76481 - DNA, 439 bp, Zea mays
  Clone ID: LIB3079-015-Q1-K1-C7
cgaagaattccctcccctagccgccgtcgccgccgctcgtctccctgagaggtgcctgtaccgatgaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatttcccttttgctttctcattctagtagtttaggatttcttttctgaca

SEQ ID NO: 76482 - DNA, 444 bp, Zea mays
  Clone ID: LIB3079-015-Q1-K1-C8
cgcacgcgtccgctaatggttcagcatcaagttagtgcaagatttggtaaatgcctgggtgaacttagcggaaacaatgccatcattgttatggatgatgcagatatccagctagctgtgcgatctgtcttgttcgctgctgttggtacagcaggacaacgctgcactacatgtcgtaggctgattcttcatgagaacatatatcaaaccttccttgatcagcttgttgaggtatacaaacaagtccgaattggggatccgttggagaaaggcaccttactgggaccactgcacactcctgcttcaaaagagaactttttgaaaggcattcagactatcaaatctcagggagggaaaatcctttttggaggatctgccattgaatcagaaggaaactttgtgcaaccaacaattgtggaaattacaccttctgcaccagttgtg

SEQ ID NO: 76483 - DNA, 374 bp, Zea mays
  unsure at all n locations
  Clone ID: LIB3079-015-Q1-K1-C9
tccacttccaccaatctgtctcccaatctttcttgctgctccaattcgctctctttacgcggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacgagcggctggaggcactggaaggcaaggacgccgtgctnctgcgcgcctacgtcggggacaagcccacttggcgcgacccggcgcacccgtggagggtggacc

SEQ ID NO: 76484 - DNA, 399 bp, Zea mays
  Clone ID: LIB3079-015-Q1-K1-D1
cccacgcgtccgcccacgcgtccgtctattctttccgacggcgctcctggcagcagggacaaggtgtccaatagggccacacattggtgttatgcctgtcggcggccaattcgtctccgtgggcaggatatcgcatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgtttgatattcgtggtagacaaggaacaggtactgaatatggaaagaggccaacttgctgttctacattggtatttggcggcattcct

SEQ ID NO: 76485 - DNA, 430 bp, Zea mays
  Clone ID: LIB3079-015-Q1-K1-D10
cccacgcgtccgtgcaaattaaattgatctgtacctgttggtcttcctcctcgctctggttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctgagagcactgatgcactcactcccagaacaagatcatcagctccaggagaacatcaaggtccatggcatcaacggcactttgcacgatgatcatcagtactgcggccatttggatcagctcggctcttc

SEQ ID NO: 76486 - DNA, 364 bp, Zea mays
  Clone ID: LIB3079-015-Q1-K1-D2
ccaacttccgcaagcagctcactgtgcagctgatgaagctcgctgccgccggcaagctgacgagtgtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccctcccaaggtcgtcaagaccttcgccaaggccttccccgtcaaggcagccaagaaagcggctgctcctgccaagaaaggaaaggcagc

SEQ ID NO: 76487 - DNA, 219 bp, Zea mays
  Clone ID: LIB3079-015-Q1-K1-D3
aaaaaaaataaaaacacataacaactttttaaatttacacataaaacatccataccaaacgaaaaggtgaaatttaaaactttaaatataccttaccaaaattctaaaacgttctgccgttatactacatccaatcttacgtcatacatccatccaatgtcatacaccatttttattgccacctaatttaatttatttaacctacatttaacaactcaa

SEQ ID NO: 76488 - DNA, 363 bp, Zea mays
  Clone ID: LIB3079-015-Q1-K1-D4
gtccagttgatgcagcttacaaggctattgacctaataatccagatcccaactgttctccgagaatatggtatgacctcagtcaccgaaggcatcgacgcaatcgcaacaacccgggtggttgtcaccggagatgtgaccaacaacttcaaacatgccttgactggccgcgctttcaaccgctccttcagcgggagcggtgcatcaatggacatcgtcgtctccagtgtcagagcttacctgaatgccctgaacaagatgtgtagctttgctggtgccgcgaaagccagcggcgaggtacctgagagtgcaagcgtccaaagcgcagagtgagcttggcgaccatttgtttctcatgtggact

SEQ ID NO: 76489 - DNA, 414 bp, Zea mays
  Clone ID: LIB3079-015-Q1-K1-C1
gtcccctattttacattacccactggtgacagtccgatgatgttcgtcttaatcttcgtttgggaccaaatcatccatgttcaattatccgccttcggcctaatttggatactcacatccatctggaatcctggaattttccctgggtgggtaatccatggggatgacattttagtctttataggggtttttgcatccctgggttttgcttacccttcttcgaaagtaggcattagtggccagagcgccaggccatgccaattttcttttttctgatgcatatgttcttttatcagtgatcgggttgcagctgggcgtgcacttgatctttcagtgtattttggtgattctggaagcagataggtactgcacaaaattggagctgaaagagcttgtgctgctgcaattactttg

SEQ ID NO: 76490 - DNA, 324 bp, Zea mays
  Clone ID: LIB3079-015-Q1-K1-A4
acatcgcttgctttcataatgccaatcctgggtttgactcccatatcggataacacaggtacaggatgctctaacatcttgaatcctattgattgataaaatcatttgcagctcattaaaaatactccaattcgatgagaggctgacactaaagaaactttccatgaagttcaatctcttcattaaattcctccaaaattcctatgtaacaagccattacataggaattgcacgagatttgtcaaaacccaatccttattccccaacgtgttattcctatattgtttcaatcctatactgatgtttggatactacattgtgaat

SEQ ID NO: 76491 - DNA, 215 bp, Zea mays
  Clone ID: LIB3079-015-Q1-K1-A5
cgcagaggcagcaaagagaagccatattacagctgcacaggagaggacgagcgcaggggccaagaaagcaccgcccgtcccggtctgtcggtatggtggcggcgatcgcggtggcgtcggcggggctcgggatgctggcgggcgtggccatggccaacaggtcgttgtcgtcgtcgtcgtgcgacggcgccgcgcagtggacgtccgggggcccg

SEQ ID NO: 76492 - DNA, 448 bp, Zea mays
  Clone ID: LIB3079-015-Q1-K1-A6
ctgatttgggatttttaggcctgtttgggacgcagaaattggaaaacacaggaacaggatgctctaacatcttgaatcctatggattgagaaaatcatttggagcacaggaaaaatacgccaattcgatgagaggctgacacgaaggaaactttccatgaggttcaatctcttcagtaaattcctccaaaattcctatgtaacaggccattacataggaattgcacgggatttgtcaaaacccaatcctttttccccaaggggttattcctatagggtttcaatcctctactggggtttggatactacatggggaatcgattggtttcctgccctggaatcagtttcgttaccggcaaattttgtgttctcgctctgaccagccgcgaaggccaataacatcttccaacaaggatctactcaacagtaccgcgagctgtttggtgagg

SEQ ID NO: 76493 - DNA, 406 bp, Zea mays
  Clone ID: LIB3079-015-Q1-K1-A7
atcgatgacagcgtggccatcctgatggcattccagatgccgggcgtccaggtcctagggctcaccaccatcttcggaaactgcaccacagagcatgccacacgcaacgccttgatcctgtgcgagaaggcaagccatctagaggtcccagtagctgagggcagccatgagcctctcaagggaggaaagccgcacgttgctgacttcgttcatggacctgatggcctcgggaacgtagatcttcctgatcccactatcaagaaagtggaggaaagtgctaccgacttcttggttgataaggtctcgcgatttcctggagaggtctctgtgctcgccttgggtcctctgacaaacatagcattggccatcaagaaggatccctcattcgtgaaaaacgttaagaaga

SEQ ID NO: 76494 - DNA, 428 bp, Zea mays
  unsure at all n locations
  Clone ID: LIB3079-015-Q1-K1-A8
cccacgcgtccgcccacgcgtccgcccacgcgtccgcccacgcgtccgagcagcggggagctccaatccgcccggccgcctccgcctgttgccactagctaggtgatcgatcgaatggactgcggtggcgcgctgcagctcccgcctgggttccgcttccaccccaccgatgacgagctggtgatgtactatctcctccgcaagtgcggcggcctgccgctcgccgcgccggtcatcgccgaggtggatctctacaagttcgacccatggcagctcccagagaaggcgttcggtggggagaaggagtggtacttcttctcgccgcgcgaccgcaagtacccgaatggctccaggcctaaccgggcggccgggacagggtactgggaggccaccggcgccgacaagccggtagggtcgccgngccccgt

SEQ ID NO: 76495 - DNA, 215 bp, Zea mays
  Clone ID: LIB3079-015-Q1-K1-A9
gccggttttaggagccacagtagtgccttttagctggtatttataccgtgaccgtagagctgtctcaaattcgcagcggaaagatttatagataggtctttgtttcggattttgtagctggaataaatgaataatacgtctagaactgattttctgtcaaaaaaaaaaaaaaaaaaaaaaaaaaaaaaaaaaaaaaaaaaaaaaaaaaaagaaaa

SEQ ID NO: 76496 - DNA, 444 bp, Zea mays
  unsure at all n locations
  Clone ID: LIB3079-015-Q1-K1-B1
gcggcaatgacgaccgccgcgagggagaggcgcctgccgccgacgctgcccctggccgcgctggtcggtcgcgagctccgtgcggggggctccgagcgcccggccctgcgctacggccacgccggcttcgccaagcgcggcgaggactacttcctcgtcaagcccgactgcgtccgcgtccccggggaccccgcatcggcgttctcagttttcgccgtgttcgacggccacaacggcgtgtcggcggcggtctatagcaaagagcatctgctcgagcacgtcatgagcgcgctgccgncggacatcgggcgcgacgactggctgcaggcgctgccgcgcgctctcgtcgccggctttgtcaaggccgacattgatttccagcgcaagggggatgtgtcatgaaccacggcgacactggtgggcatcgatgggttcacggtcaca

SEQ ID NO: 76497 - DNA, 351 bp, Zea mays
  Clone ID: LIB3079-015-Q1-K1-B10
ttgacggatgcatgcacgcgtccgttcatctgtatacaccgactttctgtttctgtcagtagtatagtgagaatggggcagggagtattagacaaggggaaatggggaagggagcgcaaggtactgatgctgctcctgtgttccaccaggtcgcagagaacatcgctgactatctggttgccaaaaacaccctcaagatcatgcccttcaagctaccggccgtcggtccttatgatgtccgcgtgcgcatgaatgcactgacgatttgctgcaccgatgtgcactaccttcaggagatgcgcatcgcgcacttcgtggtgaatgagccgatggtgatcgggcaccagtgct

SEQ ID NO: 76498 - DNA, 424 bp, Zea mays
  Clone ID: LIB3079-015-Q1-K1-B11
ggaggaagcggatgccatggaggagaatgcgggagtgcttgatgagtaagacggactgctgatgtggatttgcttctgagttgtttattttatatcgtcgcaatttcgtggttgtcgtttggttattctgtgaagcatccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattatggctatgaattacattttgccttttcgaaataagaatactggcggcgtctgttcaagatatggtttgagcctgtgctttctatttttctgaagaccggtctacttgacgctaaattcgca

SEQ ID NO: 76499 - DNA, 425 bp, Zea mays
  Clone ID: LIB3079-015-Q1-K1-B12
cggacgcgtgggctccatgggctccagtcgccagaggcatccatcttcgagaacaaggcgacattgaatgagctgaaccagctcgcggaagaggcccgcaggagagccgagatggcgaggttgcgagaagtgagcaccctgaaggggaggatggagtcagtggtgaagcagaagggtctggacatcgagaccatccagcagtcctacaccgtgtgactggctgaccgacgacgacggggtttatagaggtttcttcttcttatactatacaatctgtactaggtagcaataaagatcaaggaaagaacccctatatattggctgtggttcgcgggaaatgaatgatggtcatatttatgatgtcggtgtggtgcttctgtcgccaactctcgaccatactaccctcaactcaccccttgtatgct

SEQ ID NO: 76500 - DNA, 416 bp, Zea mays
  unsure at all n locations
  Clone ID: LIB3079-015-Q1-K1-B2
gcgggattaactcggaaattagttggtagcggatccagacctccccctttatatagatgaagggctacggccgattaaagcccccaacaatcgaacaaatcaagtctattactcatttttaccttatgcattaggagtagttctagtctagttctagtttagccctagtttagtattccaatccccaaattctccgcctctcctcgactctacgtcgattagaggagtctaggtcggcctgcccgagcctagacaactcctaggatctctcctccccgacggggtccctcccgggagtgagatccaggcgccgtcggcgatctaccgtcgcccctgcgcacgcgcggaccgtccggccctaatgcgcggaccgtncggccgtcaggcatggaacccgagcttctgcacccagtcgc

SEQ ID NO: 76501 - DNA, 363 bp, Zea mays
  unsure at all n locations
  Clone ID: LIB3079-015-Q1-K1-B3
caagctcctcctcgcgattccaatccacgcacgcctgctccgcttccgcctcgctcaggcttatagtcagtgatggaacacaaggaggcgggctgccagcagccggagggcccaatcctatgcatcaataactgcggcttcttcggcagtgctgcgacgatgaacatgtgctccaagtgccacaaggagatgataacgaagcaggagcaggcccagctggctgcctnctccatcgatagcattgtcaatggcggtgacggcgggaaaggacctgtaattgctgcatctgtaaatgtggcagttcctcaagttgagcagaagactattgttgtgcagcccatgcttgtagctgaaaccagcgag

SEQ ID NO: 76502 - DNA, 271 bp, Zea mays
  Clone ID: LIB3079-015-Q1-K1-B4
cttgacaggacatgctgcgctatcgtctatacttcttacaactccattcttgtgcacattctggtggtcttcctatgcctgaccgcctttggcttcaaccgcctctactaccgctcacctatcaccacttcaacattcacatacagcttcaactccacatattacattttaccacttccattattactacatatctacaattgaacccacttcaatccttattctctgatcacacttactactcaactgtgctataatacacctgttcctt

SEQ ID NO: 76503 - DNA, 238 bp, Zea mays
  Clone ID: LIB3079-015-Q1-K1-B5
gctgccccggctgtctggcccccactactgccaccgacggcggcgccgaacgcccgtgccaatcatcatatcgtagacgacgcgcagcattaaactatcaatcaccggatctggctctttcttggccctgtactgtactattaatgttccgttcttgtttttttattcggaattgtcgccgtttcagtatacgtaaatctcgaggtcgataatacagtaatactaccaatttaactgt

SEQ ID NO: 76504 - DNA, 438 bp, Zea mays
  unsure at all n locations
  Clone ID: LIB3079-015-Q1-K1-B6
gcgcagtacgccgggtacgtgaccgttagcgagcagcgcggcgctgcgctcttctaggggttctttgaggccgagaaggacccggggtccaagcccctcgtgctctggctcaacggagggcctggatgctcgtccattgcttttggacttggagaagaagtaggacctttccatgttaacgcagatgggaagggggtccatgtcaatccttattcttggaacaaagttgcaaatttactgttccttgattcacctgttggtgttggttactcatattcaaacacctctgatgatgctttaaaaaatggggatgcaagaactgccacggattcattggcattcttactgaagtggcttgaacgctttcctcaatacaaggaacgcgaattttatttgacaggngagagttatgctggtcactatgttcctcaactggct

SEQ ID NO: 76505 - DNA, 448 bp, Zea mays
  unsure at all n locations
  Clone ID: LIB3079-015-Q1-K1-B8
ctttgaagagcagggtcaacctgtggtaagtagaaattatgagaactactattttccgccttcactgcaccacttgagtttgctctacatgggaacaaatgatatgcaaatactgtttccatatgctactgcacttaagaagttagaccttcagtttacattcctttccacagaggatcattgtcagatagttcaacgctgctccaatctggaaaccttagaggtgagggatgtcataggggatcgtggactacaagttgttgcacagacctgcaagaaattgcataggctcagagtagagagaggagatgatgatcaaggaggtcttgaggatgaacaaggtaggatttcacaggtggngttgatggctatagcccaaggctgccctgagttgacatactgngcgatacatgtatcagacattacanatgcagctttagaggcagtt

SEQ ID NO: 76506 - DNA, 382 bp, Zea mays
  unsure at all n locations
  Clone ID: LIB3079-015-Q1-K1-B9
aaactgtctgaacaagtaggtggatcgaagcaactgggactgcgggccacacatacataatatagagtactacagtacagtatatatatagatcgatactgcatgctgctcctggcaatacagcggctttattttatttcttccctggcttcatcactcgtgcagcgcgcgggacgtacgtgtacgttcggtaggcttattagcttggtcgtcgtaacttagctgatcttgttgcagtcggtggacatgctgatggggaatccgacggagacgccgcacttgccggggatggtggcgacggtgcccatgttgacgctcttgacgctgttggcgaggctcttgaggcagcggcacgccgnctggcggtccgcgctggtccgcg

SEQ ID NO: 76507 - DNA, 409 bp, Zea mays
  Clone ID: LIB3079-015-Q1-K1-A3
cccacgcgtccgggcatcaagaagctgcaaatcatgatgaccattgtcgatgacctgggctctgttgacactctcatcgaggaccatctctgcgctgagccagtgagcgaatacgtccagagctgcgacattgtcgccttcaacaagatctaaatttccttgtgatggtggcaatggtggttggtgggcactgtaccagcctaatttataattttccatgagcatcttcaagagtttttctaaattatcatttggagtcatttacataaaaagcactttctatatctttttaatctcaacaacttttctatatcttggttgcaccctggagagctatttacgttttctatctttagctagcgagaaacctggatgggtggaatagaagataactatatttagacaatac

SEQ ID NO: 76508 - DNA, 320 bp, Zea mays
  Clone ID: LIB3079-017-Q1-K1-C2
atccgtccacgcgtccgagctatatctgtgccattaacaacttcaaatttggatgtttgttcagggatcagctggcagtataactaaatcccatattgttttataagaatatgcaatgcacgtagtcactgttcacttgccgttactagaatagggtcactgagtgtttaatgccttgctgctaatattttttctcacctgcatgtgtggacgctcatgaactacgtctcctgaatagttaaatgtctgggttatggtgaagtagtgtgattcttgtgtacctatctacgtgctttcttatttttcaaaatgcttcgctt

SEQ ID NO: 76509 - DNA, 284 bp, Zea mays
  Clone ID: LIB3079-017-Q1-K1-C3
atccgccgcgccggactgcccccgcgcgacctacgcatcctcggccccgttttctctcgctcctccagcatcctcgctagggagaaggcgatggtgatcaacctcgaattcatcagggcgatagttactgccgaggaggtgctcctgttggaccctctcatgcacgaagtgctccctttcgttgaccaattgaggcagcacctgcctctgaggagccgggtgggtgagaatggtgagtgtgcccctgatggcaatggggaaaaacagaatggctcgcttaatga

SEQ ID NO: 76510 - DNA, 297 bp, Zea mays
  Clone ID: LIB3079-017-Q1-K1-C4
gcgttcaagtaccaactctaacatgagacgttcacctaaaggtcatgcaccgaactctgcctggtcagaaagaattgctaggcgatcatgcgttcacttcgaggagctcatatgtctacacttattaagctacacacctgacatacttcatggcaccatctaccattggtctacagcgacagcttgtcgagacattgactacctcaggacgattgctggacatcgtactgttcctgtcgaaatctgaaagaattacgtgtgtaccgagtggaagcacgagcttatcacattttatca

SEQ ID NO: 76511 - DNA, 267 bp, Zea mays
  Clone ID: LIB3079-017-Q1-K1-C5
cgccctcttgctccgccggcgcggccaccgccaccgccaccgcaacagctagtgaggagatcgtaaccatggcggattcgaaggccgctgcggcggtgacgctccgcacacgcaagttcatgaccaaccgtcttctgtcccgcaagcagttcgtgctcgaggtcatgcaccccggccgccccaacgtcttcaaggcggagctcaaggagaggctggcgaagatctacgaggtgaaggacccaaactgcatcttcgtgttcacgttcc

SEQ ID NO: 76512 - DNA, 292 bp, Zea mays
  Clone ID: LIB3079-017-Q1-K1-C6
cccacgcgtgcgtccgcctgcgccttcgccccggcaaaaagcaaaacacggtcatggaaggctacgaccgcgagttctaccagttcagcgaccagttgcgcctgcagacggacgtcttctctggcctctcgctcggcgactccatctggtcccccgtcggccggcgcaacatcagcaacgacgttctcttcggcgtctgcgcgtcgtccgccaactccgccgccaagagcaacgccgtcgtcgggctcaagctcaacgactgatggcccggcctcatcggctccgggaagct

SEQ ID NO: 76513 - DNA, 410 bp, Zea mays
  unsure at all n locations
  Clone ID: LIB3079-017-Q1-K1-C7
atttagaatcagctgagcagtcatacacaacacgcttgctggtgtcaacatcacgtattgggtgcctaattggcaaaggtggttcaatcattactgagatacggagaacatccagagcaaatgtacgtattctttcaaaagaaaatgttccaaaggtagcagcagaagatgatgagatggttcagatcactggaggccttgatgttgcaagaaatgctcttgtgcaaatagctacaaggctgaaagccaatttctttgaaagagagggctctgtatctgcatttncacctggtatcccttaccatgctttgcctgcttgtgtttcggatggaccaaaatatctaagcagagacaccaagccttgtgggcactatctatattcaagtggttntcgtacatcggatgacacg

SEQ ID NO: 76514 - DNA, 306 bp, Zea mays
  Clone ID: LIB3079-017-Q1-K1-C8
cgacaggaaccgagacatcgctgatgcactgaaaattcttccagcgaactctttatgctgtaagaaagttgagaggcgatcatgcatttccttggaggagttcatatgtaattactttttgcgcgacacccccgtcataattagtggcaccatcgaccattggcctgcaaggacaaaatggaaggacattgagtacctcaagaagattgctggagatcgtactgttcctgttgaagttggaaagaattacgtgtgtagtgagtggaagcaggagcttatcacattttctcagttcctggatagaat

SEQ ID NO: 76515 - DNA, 403 bp, Zea mays
  Clone ID: LIB3079-017-Q1-K1-C9
ttgacatatgtgaaattgatcagctggttattgatatctgcaaggaattcttcccacgtttgtctgttggatttgaagatcctcgtgttcaacttcatgttggtgacgctgtggagttcttgagaaatgctcctgaagggacatatgatgctatcattgttgattcatctgacccaatagggcctgctcaggaacttgtggagaagcctttttttgagaccatcgctagagctttgaggcctggtggtgttctttgtaatcaagctgagagtatgtggttgcatacacatttgattcaggacatgctttcaatttgccgtgagactttcaagggttctgtccgctatgcatgggctagtgtcccaacatacccgagtggggtgattgggtttctgttatgcgc

SEQ ID NO: 76516 - DNA, 289 bp, Zea mays
  Clone ID: LIB3079-017-Q1-K1-D1
gcagcgcatacacaacgacttcatcgactgaccccaaggcgtacggcttccagaccggcaccgacgcgtgctgcggccagggccgcttcaacggcatggggctctgcaccatggtgtccaagctctgcgccgaccgcgacacctacgtgttctgggacgccttccaccccacggagcgcgccaaccgactcatcgtgcagcagttcatgtccggctccaccgactacatcacgcccatgaaccttagcaccgtactcgccgtcgaccatcagaagcagcagctgcgtac

SEQ ID NO: 76517 - DNA, 326 bp, Zea mays
  Clone ID: LIB3079-017-Q1-K1-D10
ttcacacattcgtacccagtctactcgacacccgtccgagatgggccccacgttcttggttggtcgcaactggaaatgcaatggaaccacagatcacgttgagaacattcgtaaaaccctgaatgaacgaaatgttccttacttaaatgtcgataaggtccctagcattccttattatggagatctatctatagtcaagagacatgtacgtccagagttgcatgttgatgcttataactactatgtgaagaaactacgtgcattcgccaatgaaaatagtgcttacatgctcatcaaacttgtcgttgaatgcatagttcttgtac

SEQ ID NO: 76518 - DNA, 216 bp, Zea mays
  Clone ID: LIB3079-017-Q1-K1-D12
gtgcttccgagaataaattttttccatcggaatgtctgaaactatgttgggtgtatcctagtggttggttgagcattaatggctcatattttgtcaggtctatgtgtcgccgtgaaacttttaatcaaatcagttcactcttttgccaaaaaaaaaaaaaaaaaaaaaaaaaaaaaaaaaaaaaaaaaaaaaaaaaaaaaataaaaaaaaaacaaa

SEQ ID NO: 76519 - DNA, 298 bp, Zea mays
  Clone ID: LIB3079-017-Q1-K1-D2
atgcgggctctcaaggaaccgaacaagaacatgaagcttgataagaggcttgccaagaagtgccatgctttctaggcatcagaggccatcatccagcagattccccgactccatgggcctggactcaacaaggcacgcaagttccctaccctgggtactcaccaggaatccctctagtccaacgtgaacgagactcatgcaacccctaagttccagctcaagaaagctctctgcatgggtgttaccgttagcgacttgcctatggaggaaaagcagatccagcctaacatccagatga

SEQ ID NO: 76520 - DNA, 341 bp, Zea mays
  unsure at all n locations
  Clone ID: LIB3079-017-Q1-K1-D3
ggaagatttcctccagaaggcttgccaagaggtgtccctccatctcagcctgtgcatcacatggctggttatagacctgaaatgggtaatgtaaataatttccatatgcaccctcgccagcccaactatggagaatttggattgatgatgccaggcccatcaggtccagaggtgaggggcaatcatccagaggcgttcgaaaggttgatccagatggagatgtcagccagatcgaagcaacagcaggtgcaccaccctgcaatggccgctggccgtgtgcctagtgggatgtacgggcacgagcttgatgcgaaatngagatacagatgatggatgcctgg

SEQ ID NO: 76521 - DNA, 325 bp, Zea mays
  Clone ID: LIB3079-017-Q1-K1-D4
cccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaatacctcgcccatgagcgagttccaagtgatctgaagaagaatctcatg

SEQ ID NO: 76522 - DNA, 186 bp, Zea mays
  Clone ID: LIB3079-017-Q1-K1-D5
cccacgcgtccgcacacgcgtcctgcggcggaccacctgccgacgccggtccggatggcaccgtcggtccatgtgccgccggcggttcatcatgacgcctctaccataccactaccatactcaaccgcgacagcctcagcctcatatgcagggacacccatgcccgtaccaacagccgcatccaag

SEQ ID NO: 76523 - DNA, 100 bp, Zea mays
  Clone ID: LIB3079-017-Q1-K1-D6
atgaggctgccgcgtgtggaccggtctctgaccacctgcgaaagatggacggggagctcgccgtgatttgaccggtcactcaggattggcaaccgctcgt

SEQ ID NO: 76524 - DNA, 425 bp, Zea mays
  unsure at all n locations
  Clone ID: LIB3079-017-Q1-K1-D7
cccacgcgtccgatttccctacgagctcgagctcacggctcaccgcagctcaaaagcgagcacaggcaaacccccgtcatggcctcctacaagatactgcgcgccgccgtcgtcgtcgtggccgtcgccgtgtgcttcttcgacggctccgacctagccgcctaggctcctgcgccgagcccggcctccggcgccgcggccgtctcctcgtcgctcttggccgccgccctctgcccggccgtcgcgctcctcctcggcaacctgcgccactgatgacgcctgcctgcctgtncgacgagagccgncgtgtgctgtcgcgtgatgttattggcctctgtatgtgtgtgtgtgtgttcctgacctgtgcgtgccttgtaccgncaccccgcgcgtggatgggaactttatcgatcgttcggagattc

SEQ ID NO: 76525 - DNA, 249 bp, Zea mays
  Clone ID: LIB3079-017-Q1-K1-D8
cagacgcttgcgcggacgcaccggctgctcaagagctgggtatgtcgtatggggggatggccagcatctgaccgatcaggcaggactgggaacccttatgttcgcgctagaaggcacccaccagaccagcctacaatgctgacaaagccttcaacagctcgcgacgagcctgtgcactaatcgataccatgaagaaactcaacactgttacgaccaaagctgcattcagcggtacattcctcaacacca

SEQ ID NO: 76526 - DNA, 415 bp, Zea mays
  Clone ID: LIB3079-017-Q1-K1-D9
ttaaaactctcggagagagaatgcacgctttctttgattatcttgaaccagcgccgaacgggggaagccgaaccaccgcgtatcaaacataggaaagcacgtgatgatttccttgcaatgttggaataacgcatggagcttacatcatcaacaagatggaccaaagcaatacttatgtttgaagatgatgaaagattcacagcacttgaacgtccaagggagcgtcaacatttatttgagaactatcttgtggaactgcataagaaggaaaaagccaatgctgctgatgaacacaacagatatgttacagaatacagagcttttctagaatcatgtgacttcatcaaagcaagtactcactggagaaaagttcacgaacgtctggatgacgatgaacgttattcccgacttgaga

SEQ ID NO: 76527 - DNA, 426 bp, Zea mays
  unsure at all n locations
  Clone ID: LIB3079-017-Q1-K1-C12
cacagacacacgatgcatggaaccatggagcgagatgcaaaccgcaggatcaagtatggacattcataccaggagagggcacatagaacttgcccaggttgtaagctgtgtggtcaaaattacaattaccccaatggtgaggaattttctgcaatcagcggttgtcaggaggcatactaccagacagaccatgatctgattccttcaacttctcaagtagcatctcattgcgagggttcttgctgcaagggccagcagttgaaaccgaaaagttattctgtgatgcgtgattatgactatatcaatcaagagtcaacacctagttcaagtgaccatgccagaacaagatctaatcttccagcgccgcctcatcattggcatgttaaacattctaatgagcatcggangcatgttactgatgcacat

SEQ ID NO: 76528 - DNA, 267 bp, Zea mays
  Clone ID: LIB3079-017-Q1-K1-E1
gaatgctcagggtctggctcgctacgccatcatctgccaggagaacggtctggtgccaattgttgagcctgagatccttgttgatggccctcatgacattgatcgctgcgcttacgtcactgagacagtccttgctgcctgctacaaggctctcaacgagcaccatgtcctcctggagggtaccctcctgaagcccaacatggtgactcctggctccgactctaagaaggtgacacctgaggtgatcgcccagtacaccgtccgtac

SEQ ID NO: 76529 - DNA, 459 bp, Zea mays
  Clone ID: LIB3079-017-Q1-K1-A5
gaattcgcggggggagccacgcgtgcggaagatggccaagtacagtagctgcgagtggctagcagttatggcatttcttgtttgggtggcatcgtggatacttcttcggctcgttatgttccctttctggatcctaagaagcacaagctatgaagtgctgctgaccttggatagggagaagcatcgattttatggccccatatactactatgttttcaactgtcttctgttctcactcctagttcttcacatatattggtgggtactgatatggcggatgctagttaaacagattcaatcgaaagggcgtgttggtgatgatgttcgatccgattctgaaggcgaagatgagcattgagattaactttttaggttgaatgattaacttgagaactacattgtgtgatacctgcagcaaggcacaccttctgaaccttttttttttcttttacagaagat

SEQ ID NO: 76530 - DNA, 412 bp, Zea mays
  Clone ID: LIB3079-017-Q1-K1-A7
cacatgcaatggatagtcttcaactggaacaggtaatcaccagtcaaatgatgaatagactcatttgactgtgtcaattagagatgcaaagtgaagcaacaagttgaacctgcaaattactagatgcaaaaaaggcactcctggataccttgtttggtgttcatgcagtcctgctaatatgaacaactccatcttcttgtgaatcttaagtatatttggaaaatgtggaaaacacgaaaacctgaaccagcacaagaatgcttacaacttctcaaggatcacctgaacctttggactatcagaacttcatcgaacctgaatcaacattccccggtcatcaccttgaattagtggcgtaaccattcttatgatgcaagcacatagcttgcttatttgttccttaaatcatcac

SEQ ID NO: 76531 - DNA, 312 bp, Zea mays
  unsure at all n locations
  Clone ID: LIB3079-017-Q1-K1-A8
gacttcacaaacagcctccctgagaatgactgccgatacgcgatctatgatttcgacgtttgttactgcagaggatgtccagaagagcaggatcttctatatcctatggtccccatcctccgccaaggtgaagagcaagatgctttatgcaagctcaaaccagaaattcaagagtggcctcaatggcattcaggttgaactccaggccacagatgcgagtgaaatcagcctcgatgagatcaaggatcgggcacgctaggcgcaccgncatcgcgagtttcatggtcacgcatcatggactcgcctactact

SEQ ID NO: 76532 - DNA, 400 bp, Zea mays
  unsure at all n locations
  Clone ID: LIB3079-017-Q1-K1-A9
gtcgccagctgcctagacgcccggaggcccgcgggcgctccctcctgggctgctggcctccttcacattattggagccagaggagcgggcggcggcttgcactccatcccatcgcttgggtgcgtcgccccgaatccaatcgcctggtcaagtctgttgctgccggaggtagacggacgccttatcgtgctcgtggccgcagctagcgcgccggagccacagctggagcgctcgccggcgacgagtcgccgccccgcaaggagcctacgcaggcacgcaccgncacgtctaggcgccaggcggagacgttattaccacaacattaaaggagatgccttcactccagaaagcattgcctncagaactngctgataatgtgctcaggttatatcgtgaatgc

SEQ ID NO: 76533 - DNA, 243 bp, Zea mays
  Clone ID: LIB3079-017-Q1-K1-B1
caaggcactttgactctgctaattccattgaggacaaggacacgatcattgagataacgggggtccaaaacttgggcaagtcattatctacacaacattgtgacacgcgcagcgatagatcatcatcgcgcggttctagactttactggcatgagttcattgcgaccaaccagtctttttgagagtattgagacgcttgcataggctgtcgagcgattaacagagaaaaggctatatatctct

SEQ ID NO: 76534 - DNA, 345 bp, Zea mays
  Clone ID: LIB3079-017-Q1-K1-B10
cgacaatggcaagggccaaggaagacgagcagatcatgggaattgacctagaatcttgcaatctagcaaaacgatcattttatgatgccatgcaacatgacattctagaaatatgggtggctaccacgaagtgagtgtagcattatgtattatgttctcatttgttcatcagttgcaacaactatttgctaaactctttgaattttgtaataattggaatgtggtcgcatggtcagactatgtttgctttctaaaacactcatgtcttagtttataggtcgtgtacacttatttaagttattggttgattaagatctgggcttcaagtgcaaaaaagaagacgag

SEQ ID NO: 76535 - DNA, 416 bp, Zea mays
  Clone ID: LIB3079-017-Q1-K1-B11
atttacgcatacttatatatatatgatttgtgtgctttatataaacccgcgtttctgatgatatggcctggccggagggtacaatagtagtagatgcaacagctaaattcacacgtacaaatgcacgcacacagtggtggcactcacaaatatatataccctaacagttgcactaatcacaattattaataattaagcaaacgtacgtagagttacttgagatctcgatttggcacatgatataactgcatgcgtgatctatctcgattgggggccgggcgccgccaggtatagcgctgatttcatcatccgagctggagggttgtaggttgcagctgatgggagtagtgctgaggcatgctcacttgcagaaagtttctcgagtcgaaaggggccatgtggtcgtactcgctcgt

SEQ ID NO: 76536 - DNA, 160 bp, Zea mays
  Clone ID: LIB3079-017-Q1-K1-B12
cccacgcgtccgcccacgcgtccgcccacgcgtccgctcagctaccagccggagcccggcgccaagatgctcgaccccgaggtgtacccgcggcccaccggggaggtgtacatatgtgggatgagcaaggacgagaacccgccagatgacccagcaacga

SEQ ID NO: 76537 - DNA, 307 bp, Zea mays
  Clone ID: LIB3079-017-Q1-K1-B2
acttcacaaacagactccctgagaatgactgccgctacgccatctatgacgggggtgtgataccgagaggatgtccataagagcaggatcttctatatcctatggtccccatcctccgccaaggtgaagagcacgatgctctatgcaagctcatgcgaacacacctgacagtgccctcaatggcattcacgttgaacttccggccacagatgcgagggaaatcagcctagatgccatcaccgatcgggcacgctaagcgcagcgcaatcgggagggccatgggtacgcatcatggactcggctacta

SEQ ID NO: 76538 - DNA, 285 bp, Zea mays
  Clone ID: LIB3079-017-Q1-K1-B3
cccacgcgtccgctcggattttcaattaatccagcaattgacattggccagattgaaggagcttttatccaaggattgggctgggcagccatagaagagctaaaatggggggatgataaccataagtggattcgacctggacacctcttcacctgcggtcctggttcttacaaaataccctctgtaaatgatatacctctgaatttcaaggtttctctattaaagggtgttccaaatccaaaggctattcattcttccaaagccgtgggagagccaccatttttc

SEQ ID NO: 76539 - DNA, 169 bp, Zea mays
  Clone ID: LIB3079-017-Q1-K1-B4
tcgaaggggccaatcggtcttgactgtcagcacgctggacatagggataagattgttgacttccactggaattcgtcagatccttggactaacgtgacaccttgtcatgctagcgagagcactggtggaggtggaacactgcatattcggcgcatgagtgatttgatct

SEQ ID NO: 76540 - DNA, 290 bp, Zea mays
  Clone ID: LIB3079-017-Q1-K1-B5
ctcgttcgttccaaacggagaagaggatcaggttcgttccaagggaaaggagaagagggtcagtacagagagagagagagagagagagagagagagagagcccttgctcgttcgttcaccaccacagcttcgatcgatccgcaaggcacgcaagatgtacaacgcgccgtctgcccatgagatgtcctacttggagcacgtgcataggctccactattagaagggctgcctatacgcctgcatcttcactgctctgtgctgcttctactgctaccagacctgctagtgct

SEQ ID NO: 76541 - DNA, 122 bp, Zea mays
  Clone ID: LIB3079-017-Q1-K1-B6
gcgagaggaagacaagcgcacgcccacagagcggggaggcacaacgcaccgaagcaaaagagcgctgcaagaacaccagagcagaacaaacaggcatgcaaggaagcggacaccaaaaggca

SEQ ID NO: 76542 - DNA, 286 bp, Zea mays
  Clone ID: LIB3079-017-Q1-K1-B7
ttcccggctcccccacggtactccagccgctagcctgcgattccgccagtacgccggcaccaccgagcctggactaccgccgccgcccttcgccgatatcttcagcggctaacagcgcccaccagatcccgcccctgcgatggagtccgtggtgaacccgaaggcatacccgctggctgatgcgcagctgacgatgggtatcctcgatatcattcagcaggcctgcaactacaaacagctcaagacgggagcgaatgaaccgacgtaaaccctgaataggggcata

SEQ ID NO: 76543 - DNA, 241 bp, Zea mays
  Clone ID: LIB3079-017-Q1-K1-B8
gccacgcgtccggccacgcgtccggccacgcgtccgtcttctctttgctttccaaggcggacatgggtcctgaagggcagtatatcacattgcaggttctagtgaatattttggagcatactgaatgccatgctgattataacttgacacctcggcaaactattgagccagtgataaccttactgaattcatctacaccagctgtacatgaattagctgcacaactactatcacatcttct

SEQ ID NO: 76544 - DNA, 403 bp, Zea mays
  unsure at all n locations
  Clone ID: LIB3079-017-Q1-K1-B9
aatccaagatctgaactccctcaaatcccgcaaccgggcccctaatcccttccaaacgcaatctcccatctccgatccaatgccccctaccggcgacgacccgtcggccgccgccggcatctcattccccgatgcgggtggcggtggcgattctgaagacggcgacttcgccggctcccacctcctcgaccccaccgatccgggccttcccaaccccaccacctcctccgctaccggcctgccccacgcgatccctgcggccggtagcggcggcggcccggtcacctccggcaacggcggggagcggcggcccctgttccagcgcctctggaccgaggaggacgagatcgtgatcctccgcggcttcgcggagttcaccgncgcgcgcggcacggcgttcgcg

SEQ ID NO: 76545 - DNA, 314 bp, Zea mays
  Clone ID: LIB3079-017-Q1-K1-C1
gtcctcttcgacaagtccaccaactccctgctagtcgcatccgaccccgagggcagggtgccgctcttctgggggatcaccggcgacggctgcgtcgccttctccgacgacatcgacatgctcaaaggctcatgcggcaagtcgctcgcgccgttcccgcaaggctgcttctactccaacgccctcggagggctcaagtgctacgagaaccccaagcacaaggtcaccgctgttcccgacgacgaagaagagatctgcggtgccactttcaaggtggtggaaggctctactgtcctgacggcgctgcactgatc

SEQ ID NO: 76546 - DNA, 425 bp, Zea mays
  unsure at all n locations
  Clone ID: LIB3079-017-Q1-K1-C11
cccacgcgtccgcccacgcgtccgcccacgcgtccgcccacgcgtccgcccacgcgtgcgcccacgcgtccgctgatttgtttaccccccgaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggtggtatggcggcgccgccggcgagggccagggccgactacgactaccttatcaagctgctcctcattggagacagcggtgttggcaagagttgcctcctgttgcggttctctgatggttccttcactacaagctntattaccacaattggtattgactttaagatacgaacgatagaattggatggcaagc

SEQ ID NO: 76547 - DNA, 399 bp, Zea mays
  Clone ID: LIB3079-016-Q1-K1-H1
gaccagcgtcaagatcatccacgccaggctgcatgctcaggctctcacgctggctgccttggctgggtccgcgctggtggagtactacgaccaccagcaagggtcaggatcgaaagttcaccaatatgcaaagcagttcctttcatctgatagcaatagcggccaacaaaaggagtagctagccagtgtccttgcgaagtgcaagcagcggagtgggcgttatttcctgatcaaataattttgcctatggcacattctgtggaaactttgacggatctttgcctgcttttctatgcgatgtaagctgctgaaacctgcactcatcaaatgttgtgtatgcagatggtaccatgcatttgtttccctgaatggcttcaaatgaaatgaatgttttttttt

SEQ ID NO: 76548 - DNA, 395 bp, Zea mays
  Clone ID: LIB3079-016-Q1-K1-H10
gttgctagtgagaaagctgcattgcatatgtctggctatgatgggaagcgtgctcaaaaccaagaggaggagactagactggcaattcctggctatgtgactccattgaaagctggagaggttatggaatcaaccgaaggaatgatgaacaatgaactgttggcgttagctcctgcagatggaagcatgtatagggaggaggatggatttctgccacagtggtttagtgaaacaatgtctggccccctgctgagctcaggaatgtgcactgaagttttccagttcgatgtgtccccatcatcagctcatccaaatggcatcattcctgtctattccaatgccatgtcaaactcgtcacagaacttcactcaagatcttcatcctgctcgtgttcg

SEQ ID NO: 76549 - DNA, 433 bp, Zea mays
  Clone ID: LIB3079-016-Q1-K1-H11
gtcatttgaagacagaaatcatgtcaatgtttgatgatctaactcaagatgaccaaggttcagtgcgactattggcagttgagggttgtgctgctcttgggaagttgttggagccccaagattgtgcagcacatattctcccagttattgtaaatttctctcaggataaatcttggcgtgtgcgctatatggtggcaaatcaactgtatgaactatgtgaagctgttggtactgaacccacaaggggtgatctggtgtcagcgtatgttcgccttctctgtgacaatgaggctgaagtgcggattgcagctgctggaaaagttacaaaattctgcaaaatattaaacccacaaattgcaattgaacatattcttccgtgtatcaaggaattatcatcagattcatctcagcatgttcgttcagctttggcatc

SEQ ID NO: 76550 - DNA, 392 bp, Zea mays
  Clone ID: LIB3079-016-Q1-K1-H12
gtcattcgtacacatgaatcctgtcattgatagccgatctaactgaagacggccaaggttgatggcgactgtaggcagtggagggtcgtgctgcatttgcgaactggttaaaacgcccagattgttcagcacatatgctctcagatattgactggtgctgtcaggataaaccgtggcgctggtgctatatgatgtgacgtcgattctgtgaactatgtgaagctattgggactgaacccacacggggagacctgatgtgaacttgtgctggggttgtctatggcagaaaagctgacgtgccaataggatcttgtggaaaaggctcatgatgatgcttattattcagcacataacttggaaccgagcatatactgtcatgctgcaatggatta

SEQ ID NO: 76551 - DNA, 354 bp, Zea mays
  Clone ID: LIB3079-016-Q1-K1-H2
ggagcacaacacaacaccctagaacagtagtgtgatatgtagctcaataggttggttggttgggtatcacaagagcaggggtagagacacagagagctaaaagaacattattggacgcgagggagcagagtagaactgtagaagggagtggtgtacgtgcgctagactgccagtggcagctgctgcaagctagctaaggtgaaggatggatatcgagtctaggcaagtttccaaaggggacgccatagctgctgctgtctctgttgactggaagggaaggccctgcgaccccctcaagcacggcggcatgaaagccgcggtcttcgtcctagggatccaggcgttcgaaatgat

SEQ ID NO: 76552 - DNA, 440 bp, Zea mays
  Clone ID: LIB3079-016-Q1-K1-H3
gggtgggagtggaggcggaggatctggtgggggcggcagcagtggtggaggcggcggcagcggtggtggaggcggaggaggatctggtggtggcggcggcggcggcggtgggacgagcggtcgttgccccgtggacgcgctgaagctgggcgtgtgcgccaacttgctgaacgggctgatcaacgcgaccctggggacgccgtccaggacgccgtgctgcacgctgatccaggggctggcggacctggaggcggcggtgtgcctctgcaccgtcctcagggccaacgtcctgtgcatcaacctcaacctgcccatcaacctcagcctcctcgtcaactactgcggcaggcgcgtcccatcgggcttccagtgcttctgatatatatggtgtagtattatatatgtccatgcatgcaatgcatctcgtcgtccatcacatg

SEQ ID NO: 76553 - DNA, 356 bp, Zea mays
  Clone ID: LIB3079-016-Q1-K1-H4
ggaagatatcctccacaaggcttgccaagaggtgtccctccatctcagcctgtgcaggacatggctggttatagacctgaaatgggtaatgtaaataatttccatatgcaccctcgccagcccaactatggagaatttggattgatgatgccaggcccatcaagtccataagtgaggggcaatcatccagaggcgttcgaaaggttgatccagatggatatgtcatccagatcgaagcaacagcaggtgcaccaccctgcaatggccgctggccgtgtgcctagtgggatgtacgggcacgagcttgatgcgaaattgagatacagatgatggatgcctggatgcttcactccgta

SEQ ID NO: 76554 - DNA, 445 bp, Zea mays
  Clone ID: LIB3079-016-Q1-K1-H5
gagacaccgcgtgcgaaccaagcagaccacaacaagaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggagaggctcgg

SEQ ID NO: 76555 - DNA, 303 bp, Zea mays
  Clone ID: LIB3079-016-Q1-K1-H6
atcctaacccttctagtcctgtccatccccatccgctccaatggcggcgactgccgggtgcttcgccactctcgccgtcgcgcgctcggcagggcagcggttgctccttgccttcaaggccggccccttggcggttcttttccttcgcggcggccggcttcctttgcaaggcgtgttcctaatcggggggcctcgcggtgtcgccctctaatagccgcgcgcgttgcgacatataacccagcgccaaacccagggacgcagatctagagtctaaactcacacacagggtgcactgagacatac

SEQ ID NO: 76556 - DNA, 424 bp, Zea mays
  Clone ID: LIB3079-016-Q1-K1-H7
atcctaaaccctgctagccctctccatccccatccgctccaatggcggcgactgccgggtgcttcgccactctcgccgtcgcgcgctcggcagggcagcggttgctccttgcctgcaaggccgaccgctcgccgctcctctccctccgcggcgcccgcctcccttcgcagggcgtctccttatctgggggcctcgcggcgtcgccctctcatagccgcgcgcgcttcgccacatcagccagcgccgaacccaaggaagcagaacttcagtctaaaatcacaaacacggtgtactttgacataagcattgggaaccctgtgggcaagaatgttgggaggatcgtcatcggcttgtacggtgatgatgttccacagacaacagagaacttccgtgctctttgcactggagagaaagggtttggata

SEQ ID NO: 76557 - DNA, 437 bp, Zea mays
  Clone ID: LIB3079-016-Q1-K1-H9
attggagatcctctcaaggacacgtctggcccttccctcaacatcctcatcaagcttgtggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgctttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttgtcttgca

SEQ ID NO: 76558 - DNA, 314 bp, Zea mays
  Clone ID: LIB3079-017-Q1-K1-A1
gggacttgtaaatgttgggcgattgattaagctgggctttcaaggtatcatttgcgggcgctatttgagttcagggaacaactcatttttcttcaggagaggcaggtgcacacatctacttttttttttcaaatgaaacatatgaccttaaatttgaaggattatctactatctagtgaaacataaactctcatgaatgtaaatgaaaagggataacctcacatttgtcacacacacatacgtaggcataaaatattgctaaacttagaagacatatggatgattgaattcattactttattttttacaagaca

SEQ ID NO: 76559 - DNA, 313 bp, Zea mays
  Clone ID: LIB3079-017-Q1-K1-A10
cgagcacattcaatagacatactgtctgaagtgctcactgctctgcaagaattaaatggttactgcaaaaagataggtcactataacatgaagtgcatatggagtcctggctttcctgctcacattcataacaatcataacttcatggcaaggtccattgaaactgatagcctcagtcagaggtataagtgctaattaaccttgaaattcacgtgtgcaccacaagagacgcgatatacctcctcgatttgcaaagagtcagggagcctcagctcctatttatggactcgtgcacgggctttctaactacact

SEQ ID NO: 76560 - DNA, 405 bp, Zea mays
  Clone ID: LIB3079-017-Q1-K1-A11
cggacacgtgggaaaaaggaaaaccaaccaccactcgcaccaccctccgcctccgcctgcgccacagctgccgattcgaaagccctcgtcctgacccctcgcaaaaccctagctccaaccaccatgaagggcaaggccaacgcctccaagaaggatgaggccaggctccgggccggcggcggcggcgccggaaagcgcaagaaggccgtcgcgagcggcaagcccaagcgccctccctccgccttcttcgtcttcatgtctgaattcaggcaggagtaccaggcgcagcaccctggcaacaagagcgttgcggccgtgagcaaggcagcaggggaaaagtggcgctctatgtcagagcatgagaagcaaccctatgtggaccaaagctggcagaagaagcacgac

SEQ ID NO: 76561 - DNA, 369 bp, Zea mays
  Clone ID: LIB3079-017-Q1-K1-A12
gtggtgaaggtgtctatgtacaggcatctacccttgggtctttggaagctctcactgagttcttgaagagccctgctgtgaatattcccttctgtgatttcagtatagggccagtgcataagaaggatgttatgaaggctagtgtcatgcttgagagaaagaaagaatatgcaactatcttggcctttgatgtcaaagtgatgcctgatgcccgcgatctcgcagaagagttcggtgtgaggatctttgcggcagatataatataccatctggttgatcaattcacagcatacattaagaacctgacggtagagacgcagaatgaaagcgcttgacaagctgcgttacctcgtggtcttaagattatgc

SEQ ID NO: 76562 - DNA, 283 bp, Zea mays
  Clone ID: LIB3079-017-Q1-K1-A2
gggttccatcatgatcctactcgtcctcgccatcgtcggcgttacctactacgctggggtcctctgcaactacggccccgccctcctcaccggcggcggcaccactctcgccgcgctcgctgtcctgctcctcttccactttctgcttgctatgcttttatggagttatttttctgtggtgctcactgaccctggttctgttccaccaaattggaatcttgattttgatgcgcagaggggagaaactgctcctctcactagctcagagttcagtagcccgatg

SEQ ID NO: 76563 - DNA, 403 bp, Zea mays
  Clone ID: LIB3079-016-Q1-K1-G9
gcagggagtgtttcccgtctccaccgcattccctgtgctgaaacctggcacttctacaggggagagcctctcacggtcttcgagcttcacgacgacggtcacattgaccttactgtcattggcccacaccttgaggcaggccagcgcccccagtataccgtgccaccgaacgtgtggtttgggtcgttccccacactagacgtcgagtcgttcgcatctgatggcagcgttcttgtcaagtctcggaagagggaccctgagctgcattactcccttgttggctgcacctgtgcccctggcttccagtacgaggattttgaaatggccaaatttgaggacgtgagatccatcgctcccaaggctgaacctttcctcaagtttcttattccctctaccgattaac

SEQ ID NO: 76564 - DNA, 429 bp, Zea mays
  Clone ID: LIB3079-016-Q1-K1-F4
gggatctacaaaagatgtctggtaattctacagcaaaagttggccactggaccacagatgagataaaagcactaaggacgaggtttcagttgtcaaaaagagtccaaaatgaggaagttcccatggcagaggaagctctggcgatgatatcacaatcatttaggcaggtcgttcttgatgtgaaagttggacccccttcatttgagaaaggtttagctgacgatattttgtctcttctcaggagaacaaattgcaagaattgtcttgtctgggcaaaaagtgatgatataggaagagagataattaaattgtctaaagatgttattgttggctatgttgtcatggtggataaatttaccaatagaagaacggagttagtgaggattgaaggggctaaagttgctggcatatatcatcctttgatccatg

SEQ ID NO: 76565 - DNA, 419 bp, Zea mays
  Clone ID: LIB3079-016-Q1-K1-F5
gggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgtccgctggtacgagaccgtctctgcggctgtagcctcaagattccctggtaaggctgttggtgtaaatctgcctgcgggatcagctcctgcggcagctgctcctgcggatgaggctgaggacgatgatgaccttgatctttttggtgatgaaactgaggaggacaagaaggcagctgatgag

SEQ ID NO: 76566 - DNA, 432 bp, Zea mays
  unsure at all n locations
  Clone ID: LIB3079-016-Q1-K1-F6
ttgtttttattcctgacgacgcccgcagccgacgtcgccgacgacggaggagcagcacctctcgtctgtccaccgctgaccgctcgtttgtcagcctagcaccggggtgcatgaacgcccagtatatgctacagcaccgccgcccctggccctgccgcctgcgccggtcgttgccctgtgcactccgcgggcctcgggaatggccaaccaggacatttatcggtttgcccaccctctcctgtcttctcttctctcccgcccgctctccctctctcccttctctccggcttccgattgggtattgtttattggcttctggctttaattaattactgtatttgcatgttcaggtatgttgctcatccatctcgtatgatgaagtgttttatgctctnttccaattattgttgcaagtagcataattagaacatg

SEQ ID NO: 76567 - DNA, 390 bp, Zea mays
  Clone ID: LIB3079-016-Q1-K1-F7
cggccgtcaccctctccggcatcgcaggaaacatcatctgcttcctggtgtgccttgcaccagtggcgacgttcctgcaggtgtaccggaagaagtcgacgggcgggttcagctcggtgccgtacgtggtggcgctcttcagctcggtgctgtggatcttctacgcgctggtgaagaccaacttgaggccgctgctgaccatcaacgccttcagctgcagcgtggaggcggcctacatagtcctctacctggcgtacgcgccgtgtcgggcgcgcctgctgactctggcctacttgttcctgctggacgtggcggccttcgcgctcgtcgtcggcgtcacgctcttcgccgttcgcgagccccaccgcgtcaagttcctcggcagcgtct

SEQ ID NO: 76568 - DNA, 176 bp, Zea mays
  Clone ID: LIB3079-016-Q1-K1-F8
gttctagatccttcgcggccgtcccggccatcctcggcctcgcccctccggaagcacgcaacagtcgccgtccatcccgcacattgtgtgctaacctccacgccaggcacgaccagccagtcgacgacaaccagcgagtggaggggaggcaggtcacgacggcagctagatccttc

SEQ ID NO: 76569 - DNA, 407 bp, Zea mays
  Clone ID: LIB3079-016-Q1-K1-F9
atggaactgctgctgaccatattgaaacgtacaaaatgcatgcatccatccgggctcgtacctgatcgatgtacatgtaaatcattatcaatatatataatgaacgaataaaatgcatgtgttgaaaaagaaaatgaaagaggaaacaaagataaaacctgagttaacataaaaaaaccgaaaagaccgagtcactgaaacccttaccagagcagagaagagaactcactgcaagcgagcagcagcatgcaccagagactgtacgccatcgagttcgaacatcagaagtgagatcgcgaagctcagattgaacggaagatcactgagcaagcaaatcctgactgaaatctctaccatatatactccctaccaggcaaaagcttggtagctcaccagttcatacacct

SEQ ID NO: 76570 - DNA, 446 bp, Zea mays
  Clone ID: LIB3079-016-Q1-K1-G1
gaatgtcctcatctttgatcttggaggtggtacctttgatgtctccctcctcaccagtgaggaaggaatctttgaggtcaaggccacagctggtcacacccatcttggtggtgaggactttgacaacaggatggtcaaccacttcgtccaggagttcaagaggaagaacaagaaggatatcactggcaaccccagggctctccggaggctgaggaccgcttgtgagagggcgaagaggactctgtcttccactgcccagaccacgattgagattgactcgctgtatgagggcatcgacttctactccaccatcacccgtgccaggtttgaggagctcaacatggacctgttcaggaagtgcatggagcctgttgagaagtgcctgagggatgccaagatggacaagagcaccgtccatgacgttgtacttgttggtggctccacta

SEQ ID NO: 76571 - DNA, 438 bp, Zea mays
  Clone ID: LIB3079-016-Q1-K1-G10
cccacgcgtccgggggcactagagcatgagttcccctggagatcaatttcatgttgggttttttttgcgaagttccattttctattttcaatttgattagggctagtttgggaacttattcttccaaggtttcctaaggaaaattagttcatttttttttttgggaaaatgaagtttccaaaagggtttcaaatccatggtggtgtgggaattgattgcagtaaaggcgatgggtaagctgataccggtgggttgagaattagaccatcagtagcttactctttcccatatttaaactataatctacactacaaaatagtgcaaaaggtgttcatagtgacctatgaataatataatctacactacaaaaatagtccaaaaggtgtttgtagtgaccatatatgggtgtacattgtacctttttacattgtatttgta

SEQ ID NO: 76572 - DNA, 419 bp, Zea mays
  Clone ID: LIB3079-016-Q1-K1-G11
cccacgcgtccgcccacgcgtccgcataaaaaaaaaaaaaaaacaaaaaaaagaaaacgagaaaaatgcaaaataaaatataaaaaaataaaaatcaaattaaggactaaaacgggaacttattcttccaaggtttcctaaagaacattagttcatatatttttttgggaaaatgaagtttccaaaagggtttcaaatccatggtggtgtgcgaattgattgcagtaaaggcgatgggtaagctgataccagtgggttgagaattagaccatcagtagcttactctttcccatatttaaactataatctacactacaaaatagtgcaaaaggtgttcatagtgacctatgaataatataatctacactacaaatatagtccaaaatgtgtttgtagtgaccatatatgggtgaacattg

SEQ ID NO: 76573 - DNA, 296 bp, Zea mays
  Clone ID: LIB3079-016-Q1-K1-G12
cccacgcgtccgaaaaaaaaaaaaaaaaaaaaaaaaaaaaaaaaaaaaaaaagagaaaagaaaaaaaaaaaaaaaaaaaaaaaaaaaaaaaaaaaaaaaaaaaaaaaaaaagggagaacgaaaagaaggaaccgaagctatagtgcaaatgaatgcaaattaatagagcgggaaaaagagaaataaaaataaaggaaaaaaggcagacgtggcaaaactaaaaggatggggaaaaccatgcgggtaccaaaataaagggaaataggagaaaaggcccatatggatagtaggcgaaa

SEQ ID NO: 76574 - DNA, 304 bp, Zea mays
  Clone ID: LIB3079-016-Q1-K1-G2
ccgatcatgaagggccattcggatcgcgggtgagtccaaaccggcctgccagttcggagaaggctgatggcgtaaaggtgaaccgcaacttctcaaacggcactcctccaaacagaacgctctcaatcagtggccaacacaacggtggtggccatggcgtcaggtctggagggaaggattgcatgacagacacggcgaatacagcatcttcagggaacaatgcagatacagctgctcctgtggacgcggtcttccaaattactgtcaccgatccggtttcgagctcaccatgatctttaaccta

SEQ ID NO: 76575 - DNA, 254 bp, Zea mays
  Clone ID: LIB3079-016-Q1-K1-G3
ctagaactagtctctgcttctgcttggcactgacagtaacgttttcagaagaccgggggtacacgtcaactcttacatatatatatgtatgtatgcataatgaattacctggtctgctttccgcaaaaaaggacgccctttgttgtacatgtacatgatgctgtacccttagttttcctgaagtgcagaccagagaagagaacattgacattagattgtagctgctaagctgtatggtaattacagttttcttt

SEQ ID NO: 76576 - DNA, 157 bp, Zea mays
  Clone ID: LIB3079-016-Q1-K1-G4
aaaaaaaaaaaaaaaaataaaaaaaaaaaaaaaaaaaaaaaaaaaaaaaaaaaaaaagaaaaaagcaaaaactaaaaaaaaaaataaaaaaaataaatacataataaataacactaactataattttctcaaaaaatatacaccctaaattaaacat

SEQ ID NO: 76577 - DNA, 377 bp, Zea mays
  Clone ID: LIB3079-016-Q1-K1-G5
tggacttgctctgatcctatgtgtgtgtggctatgcttgtgctcaatggtgggcacttttcagttaaagttttgtagtgctgtctgtcagttgctgcctcaaacttggaatactacttctgtttggcacctgaactgcttatcaaaaactttatgtataccagttacattccacttttaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaataaataataaaaaaattaaaaatattataataaaataaaaataatataaatataatttaaaaaataaaagggggggttttttta

SEQ ID NO: 76578 - DNA, 440 bp, Zea mays
  Clone ID: LIB3079-016-Q1-K1-G6
ggacagtatgcatatattggacttctgaattcggagctgtcatcaaactgcacagcttctcctgcattgcccttccaggaatacccacctggaataacacttgtacctatgaagagtaggacactagcgccattccgtacaactaatcttgtggtagtaagatcaaccaatggtgctggtggatctacatgttctgatttttttgcttcgggggaagctctgcttatagatcccggatgcagctctcaggttcatgcagagcttgcagatctcattgattcccttccaaaaaggttattagttcttgttacacattatcatcaggatcacattgagggtctttcagtcgttcagagatgcaatcctaatgctgttcttctgacacaccaaagtacaatggatcgcattgggaaaggaacttggcagattgactacacttc

SEQ ID NO: 76579 - DNA, 430 bp, Zea mays
  Clone ID: LIB3079-016-Q1-K1-G7
gctgcagtgctttatggagttagcattgccttgagggacggggctgacaaggcatcggagtatttagctgggtatctattggaacagagtttgacggcggacaatctctttgatagtgttctggtcttcaagtatttcaaagcgccaaaagaataccagaatcgaatactttcttatggtatagctggagctgtggtctttcgggctgtgatgatcatcttatgaacagctagcattcagaaatttgaggcggtgaacttgctgctggctgtgatcctgttattcacttcttacaagctatttgctgaacaagaacacgaatctgatctatccgataacttcattgcgaaaacatgccaaaagttcattccagtcactgaatattatgacgacgatcggttttcacagatcaggaccgtttatggaaagc

SEQ ID NO: 76580 - DNA, 443 bp, Zea mays
  Clone ID: LIB3079-016-Q1-K1-G8
gctaccctgaccccctcatcaaggccaacgacaccgtcaagatctatctggacacgcagcaagattgtggacttcatcaagtttgatgttggcaacgtcgtcatggtgactggcggaaggaacactggccgcgtgggtgttatcaagaacagggtgaagcacaagggcagctttgagaccattcacgtggaggactccctgggccaccagttcgccacccgtatgggcaacgtgttcaccatcggcaagggtaataagccgtgcgtgagcctgcccaagggcaagggaatcaagctgagcatcatagaagagcaaaggaagcgggatgccgatgcccatgctgctgccaacgcatcaatcctctgaatgtgctgagttgagagttttttctagttgctttgcatggttatagaacaatgttctaagactaccatgtctttaag

SEQ ID NO: 76581 - DNA, 447 bp, Zea mays
  unsure at all n locations
  Clone ID: LIB3079-016-Q1-K1-F3
gtcgcagaccatccgccacatgatcgaggatgactgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgncgncgncggcgncgccgtctcgaaggccggttccgacgacgtgggtgccgcctccgccaacagcaccgacgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgaca

SEQ ID NO: 76582 - DNA, 423 bp, Zea mays
  Clone ID: LIB3079-016-Q1-K1-E10
gccaacggtctatttttacattagcaatgagtatgctggcctttgctgaaaaagttggcgacgtcactgaactgtcggacttgctaaggtgtttttcatgttccaaaattgaccctcacctaataataggtgaagacttgcaactctctgtacggtcgcaatcacatctatgcagctatggttctgaaagtgatcaagagattgccaaatccatgctttctgactgcatgacagatgtcgagattaacgatcatcgagtgcttgatgatattgcctctgcactgtctaatttcatcgagatggtcaaggatgtaatagtcaacgatctgactgagttgttcacgcctgaagagatgcctctgtttggctcgaattcagcacttgactgggccaacttcaatgcacaagcatattctgatgaat

SEQ ID NO: 76583 - DNA, 392 bp, Zea mays
  Clone ID: LIB3079-016-Q1-K1-E11
ggcaaactggcagcagcaagtactactagcgcttgctaaaggccaggagcccaggacgcggaggtgctcgctgtcgctgatcaaccgcgcgccgtcgcaggcagcacagcaaccagcaacagccaacagctaggcaggtagtagtagtatacatgagcaggttcgcggggcagacgtccaccaggccgtgggtggggatggcgggctctggcgccaccgcgtccgagcctgccgccgccgacgtcgcgagggacgacgccacggcagccatgaggggcgccggtgccggcgccggcaccaacgccagcgccatctacttcggcttcgcggccacggcggtcctcgtctgcatgttcctcctcatgggcatcttagagcacctcatcaagccc

SEQ ID NO: 76584 - DNA, 136 bp, Zea mays
  Clone ID: LIB3079-016-Q1-K1-E12
ggcaaactgcaaccagaaagtacgactggtgatagctgaacacctcacacagggcacgctgaaatgctcaggtgaagtggtcacccaagcggcaaatgagtcagcacattgaccatcaacagctaacatgtacata

SEQ ID NO: 76585 - DNA, 385 bp, Zea mays
  Clone ID: LIB3079-016-Q1-K1-E2
gcaacgcgttggctctataactcacacacactcgcgagcgaatgcaacgaagaagaggaggaggatgatgcatggacaagtgcaggttggtgacccacgagcactcgtcaaggtactatgggtgcatgatgaaactccgactacgatgacagcttcctgagggccctggcatgccggcaagctgtacagcttaaacaggtcgatcgtgacgacacgtacctggtactgaatcaggggtgccatctgtccgaagtacaacgtactcgacacacagggactgatcaagaccactgtcagaagaatcatcgagtggctcaaatgcaaggtttacgacgacctctactgtggactatcaactgatctgattaacgcgagactactgaat

SEQ ID NO: 76586 - DNA, 446 bp, Zea mays
  Clone ID: LIB3079-016-Q1-K1-E3
cccacgcgtccggcctcgccttcccttccccaccagcccgtctctctcttctctctgactctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcacccggcggcgcgcccgccaacgtcgcctgcgccatcgccaagctcggcggatcctccgccttcgtaggcaagttcggcgacgacgagttcgggcacatgctggtgaacatcctgaagcagaacaacgtgaacgcggaggggtgcctgttcgacaagcacgcgcggacggcgctggccttcgtgacgctcaagcac

SEQ ID NO: 76587 - DNA, 356 bp, Zea mays
  Clone ID: LIB3079-016-Q1-K1-E4
aaaaaacgtacggactagaacttaaattacacaccaaaccgaatatatattatatatgggctatatatctagtagccgagtacaacctagcaacaacgggcaagcgctaccaaatggcgcctctaggagacggcggagctgctgccgcggcggcgtccaacaacctggtggtgtcattcggcgagatgctgatcgacttcgtccccaacgtggacaggctgtcgctggccgagtcgggcggcttggtcaaggcacccgtttgcgcagcctgccaacgtagcctgcagcatcgccaagctcggcggatccatacgcttcgcaggcaagttcggcgacgacaagttcgggcacatgct

SEQ ID NO: 76588 - DNA, 442 bp, Zea mays
  unsure at all n locations
  Clone ID: LIB3079-016-Q1-K1-E5
caagcatcgttggatttatctgacaatgcttcattagagaggcgaatgtcttcagagagtaatatgtcgtattatctgaagaccatgactccaagtgcttttgaatcagcacttcgtcaaaaagatggagagctggcttcttacatgtcacgcttggcctcattggaatctattcggaattcactagcagaggagttggtaaaactgacagaacaatgtgaaaagttacggactgaagccactgctgtgcctggcttaagggctgaattggaagctctgaaacaaaggcactttcaagctctagaactcatgggggaacgtgatgaagagttggaggagctaagaaatgatattgttgacttaaaagagatgtacagagagcatgtggatcttcttgttagccagctccagtcattgngtgctcgtgtatagcgctgcctgc

SEQ ID NO: 76589 - DNA, 261 bp, Zea mays
  Clone ID: LIB3079-016-Q1-K1-E6
ctcgtcttcttatccatacataacttgctaaaaaatgtaatgcgaggatggttgcatgggccaaaaatattaaggcttcagatccactctaagagggctgcaggcttgggccagttgttagtgaatgacaagctgagaagattcatatgttgatatcgaatgccaaaagccatggtgctactattctgactggaggtgttagacctgcacatctagtgaagggggtctctatcgagaccaactatgattactgatatcacc

SEQ ID NO: 76590 - DNA, 441 bp, Zea mays
  Clone ID: LIB3079-016-Q1-K1-E7
gagaatgtggcctttggcggcaccatgaggagcatgacgaatgaaggtctatcgtatctcaagaagaggatcaaagagatcgtcgaaggacaggcagcggtgcaccactgcagtgccagcgtggacttcatggaggacacgatgaagccgtacccggccgtggtcaacgacgaagggatgtacgctcacgccaaggaggtggccgagggcctccttggggagaagaacgtcagggtgggtccccaggtgatgggcgcggaggacttcgggttctacgcgcagaggatggcgggcgccttcttcaccatcggggtcggcaacgcgagcaccatggcgaccatccattccacccactcgcctcacttcgtcgtcgacgaggacgtgcttcccgtcggagctgcgttccatgctgctgtggcgattgaaatgtcaggaagaacc

SEQ ID NO: 76591 - DNA, 439 bp, Zea mays
  Clone ID: LIB3079-016-Q1-K1-E8
ggcggcgaagaaaccgagcgggaagacggaagaggagaaggtagcggaggcggcggagatcggctacaaggtgctcgcaccgctcggggctgacgagaaacccttcaagccctacgagcccgtcttcgccatcgtacagatcggctcgcatcaattcaaggtgagcaatggcgactcaatcttcacggagaggttgaagttctgtgatgtgaacgacaagttgttcttgaaccgagttctcatgcttggttcacaaactcaaacagttattgggaggccaatactacctgatgctgctgttcatgctgttgtggaagagcatgccttagatgcaaaagtgatcatattcaagaagaaacggagaaaaaattaccgacggacaaagggccatcgtcaggagttgacaaaactgagaataatcaacattgaaagaatagat

SEQ ID NO: 76592 - DNA, 415 bp, Zea mays
  Clone ID: LIB3079-016-Q1-K1-E9
gcgagaggaaagagaaaaaggaaaggaaaggacaaaggagcggcggcgaggtctatggggtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcattgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaag

SEQ ID NO: 76593 - DNA, 438 bp, Zea mays
  Clone ID: LIB3079-016-Q1-K1-F1
catctattcagaacttgaagaaagaatcaaaatacactcttgacaaagtagctatcggtgaaagcgatgtgcagcgtgggcgaactgatctgagatctactgggaagcagatacaatctcttataggttccatttacaaagcagaatctacctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtc

SEQ ID NO: 76594 - DNA, 307 bp, Zea mays
  Clone ID: LIB3079-016-Q1-K1-F10
ctaggtatcatatatttaggtccttgtcagttgtattgggatgtatattaggggtatgtaaatgcacagcggccgagccaatgcatgtgatggtagatactaaccacttgaggttgcaggtgtgaattgatctgttcagaagaaaaaccttctcttgattttcctgtttcttgatgtggtaatttgcgcaaaaaaaaaaataaaaaaaaaaacataagaaaaaaactaactgaaagaaaacaaaaactaaaaaaaataactgtacgaaatcttataaaaacaatcagacatgagatctagaagttca

SEQ ID NO: 76595 - DNA, 417 bp, Zea mays
  Clone ID: LIB3079-016-Q1-K1-F11
ctgcagcccccaactacccccagcctcggaaggaaccttccagaagcgcaagactctgggggccgtcgccttcccattcttcctcgccgcgggggtcgcctgagatcacataaacaatggtgaaggctgttgctgtgcttggtagcagcgatggtgtcaagggcaccatctttttcacccaagagggagatggccctaccgctgtcaccggaagtgtctctggcctcaagcctggcctccatgggttccatgtacatgcacttggtgacaccaccaatggatgcatgtcaactggaccacactacaatcctgcgagcaaggagcatggggcaccagaagatgagaaccgccatgctggtgatcttggaaacgtgacagctggagcagatggtgttgctaatatcaatgtcaccgaca

SEQ ID NO: 76596 - DNA, 419 bp, Zea mays
  Clone ID: LIB3079-016-Q1-K1-F12
ctcagacccacagctacctacagccgagagagggaccgggcagaatcccacggctcggaacgacttcgagttggcatggttgctgcgcgcaggcatcggctgacatcacatagacaatgctgaaatgctgttgctagtgctctgtgctagcaacctgaatggtgaccaagtggcaaccatatgttttcacccaatagggagatggccctaccggtgtcaccggaagacgtctctggatctacaagcctggccttcatgggttacatgtacatgcactgggagacaccaccaatggatgcatgtcaacttgaccacactacactactgctagcaatgagcatccggcaccatacgatgagaaccgccatgctggtgatcatggcaacgagacagcttgagcatatggagctgcttgtatc

SEQ ID NO: 76597 - DNA, 350 bp, Zea mays
  Clone ID: LIB3079-016-Q1-K1-D9
ctgacacgtccggtgaccaatgtacctcaagcttccgtgtatttgccttgcataggggggtgatactagagattgggatcttcataactgacaggcatactaaacatattgtgataaagatcggtctgccaggctatggcaatttcttagagcagacataactgatgcctatggaccactgcttgtggttatcagaatgcataaaaaacctgtacttggaactgatatactaggaaaagatgtctgtatctttatgcgtccaagagatccaatacatgggataactagaccgtatataggacgcatagatgctactggtatagctagctatgataccatatgcttgtcat

SEQ ID NO: 76598 - DNA, 51 bp, Zea mays
  Clone ID: LIB3079-016-Q1-K1-C5
cccacgcgtccgcccacgcgtccgcccacgcgtccgcccacgcgtccgaag

SEQ ID NO: 76599 - DNA, 291 bp, Zea mays
  Clone ID: LIB3079-016-Q1-K1-C6
tctagatcgcgagccgcagcgtctttttacgctttctctcacgcatacaatgactagtgtaaatttatattgacaatagcttaattatgaaccaacctataaatacatttatctttttagaacaaaacaaaattacatacacataaatgtcatcctatatctattatataagctcacctaaacttaatttattgtccatatttttacaacatttttacttgaatatccttgactttaccaaatttaatatcttttcacatattaatcttttttacatttttaattatattt

SEQ ID NO: 76600 - DNA, 437 bp, Zea mays
  Clone ID: LIB3079-016-Q1-K1-C7
ggctggaggagctggtggcggaggtggcccgcctgcaggcggagaacgcggcgacgcaggcccgcaccgcggcgctggagcgcgacctgggcagggtggacggcgacaacgcggtgctgcgcgcccgccacgccgagctggccggccgcctgcagtcgctgggcggcgtcctcgaggtgctccagatggccggcgccgccgtcgacatcccggagatggtcaccgacgaccccatgctccgcccctggcagccgtccttccccccgatgcagcccatcgggttctgagaatctgagcctcagccggcgggagagagccaatttctgtcgtcgtgccgctgtctatctcgtattggtatatctattcataaatcatccttgtcatggtttgctcttcttgtcagtgttataaatttgcttcttgttagtgttataaat

SEQ ID NO: 76601 - DNA, 444 bp, Zea mays
  Clone ID: LIB3079-016-Q1-K1-C8
ctgtgttccgctgcattcatttgattatgtgtataactacctgatgggaacgaatgttagcttcattgattgtttcaaggatccaggtccacatggcagtggaaggtaccctattgagatgtatcctgaaatagacgagagtgattttagaaagggtgcccagtggtttgcagttacgaggagacatgctttaatgattctggctgacagcctgtactacaagaagttcaagctatactgcaagccagcagaagggcgcaactgtattgcagatgagcattatttgccaacgctgttcaatatggtagatcctggtggcatctccaattggtctgttacacatgtggattggtccgagggaaaatggcatccaaggtcatatagtgctgacgatgtcacttatgatctcttgaagaatattacaacaactgatgagaacttcca

SEQ ID NO: 76602 - DNA, 408 bp, Zea mays
  Clone ID: LIB3079-016-Q1-K1-C9
cccacgcgtacgtccacgcgtccgggacggctacagggaggagggaagctctccgaggctgctgcagaggtggtcctcgtccgtgtgggccgtcagcggtaccgggcgcctgctgtggacagccaactaggcgtggagggcgcacatctggatggccctcgtacaggtagcctacagcagctaccacgtgctcaccaagtccgtcctcaacgtaagtatgaaccacatcgttttctgcgtataccgcgacctggtcgcgctcgcgctcctcgcacccatcgccttctttcgcgagagaaacgtgcggcgcccggtgactcctagcctcctcgcgtccttcgctctcctcggattcactgggatcttcaggaaccagctactgttcctactgggcctcggtttcaccaa

SEQ ID NO: 76603 - DNA, 433 bp, Zea mays
  Clone ID: LIB3079-016-Q1-K1-D1
cttgctctggggggaaggagagagagagagcgagagagagatctagtagagaggctggctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgtgcg

SEQ ID NO: 76604 - DNA, 444 bp, Zea mays
  Clone ID: LIB3079-016-Q1-K1-D10
ctcttttaaaatgttgatgaattcaatttgtggtttaaatatctcgtcagaacaattgtcttgctgagatgtttcatctcactcttgcattactcaatgcaggtgcttgttgctcatcaaggggagtgggaagtagcagcacacccaccttcattctcataataatgctgcccagacgcagccatgatttaattagaaacttcttgtcaaaggatgtttgtttttaactagtcgtgcgcactgattaattcagttcatgttgttatggttgtcttcccattgctagcagattattaatgtcttatatgttttcttaaaaaaaaaaaaccttattacaaaaaatcaaaaaaaaataaaaaaaataaaataaaaaaaaaaacacataataaaatcaaaaaatttaacaaaatataatataaaaaaaaaaaaaggggcgcccctttt

SEQ ID NO: 76605 - DNA, 422 bp, Zea mays
  Clone ID: LIB3079-016-Q1-K1-D11
gcctccattcgtcccccgccgccgccgctcccagtctccacgcggaagcagcgcctggcaacgctcctacccaatggcgccgacgtcgaagctgtcgatgggcatcaagcgcgcgtcgcggtcgcacgcgtaccaccgccgtgggctctgggccatcaaggccaagaacggcggcgtcttccccaaggccgagaagcccgccgccgccgcggaacccaagttctaccccgccgacgacgtcaagcctcgcgttcccagcacccgcaagcctaatcccaccaagctcaggtcgagcatcacgcctgggacggtgctgatcctcctcgcggggcgcttcatggggaagagagtggtgttcctcaagcagctcaactccggcctgctcctcgtctctggtccattcaagatcaatggagtaccga

SEQ ID NO: 76606 - DNA, 415 bp, Zea mays
  Clone ID: LIB3079-016-Q1-K1-D12
gcctgcattcggcccccgtcgccgccgctcccagtctccacgcggaagcagcgcctgggaacgctcctacccaatggcgccgacgtcgaagctgtcgatgggcatcaagcgcgcgtcgcggtcgcacgcgtaccaccgacgtgggctctgggccatcaaggccaagaacggcggggtcttccccaaggccgagaagcccgccgccgacgcggaacccaaggtctaccccgacgactacgttaagcctcgcgtgcccagcacccgcatgcctaattccaccaagctcaggtcgagcatcacgcctggtacggtgctgatcctactcgcggcgcgcttcatggcgaagagagtggtgttcctcaagcagctcaactccggcctgctcctcgtatgtggtccattcaggatcaatgga

SEQ ID NO: 76607 - DNA, 450 bp, Zea mays
  unsure at all n locations
  Clone ID: LIB3079-016-Q1-K1-D2
gggtatctgagaaagaagtggtcgaggcaatgcaggcctttgcgtccaacgtcctgaacctgtgggagaggcacaggtcggagcaaaggcagggtctgatggcgaacaaaggcatggacagagatcttagggtgatggaaagagacgagcaatcgatgcgcaaggctctggaggcacagaacaagaagcttgtgctcatttcgaaccagggcagcgtgtccttgtctgcacaagcgttacatgagcgaggccctggcgctgaagccggtggtagtctgcagacaggtctgaggaatattttcgaagcgatggagaacttcacctctgcatctgcaaatacgtacagggagctccatcttcgcgccgaagaagagaaagcccgggttgcgcangagagcggcagcgtttcctagttccacatgaggacatgagcatttgtcggtggaaaga

SEQ ID NO: 76608 - DNA, 424 bp, Zea mays
  Clone ID: LIB3079-016-Q1-K1-D3
cagatccgtgttccgtgtccgcgtccagtgtgtccgctactccgctccccctcagtggtcagttcctcacctagcggtagcgtgcgcgcgggagacgtatatggcggcttcggaggcggcagcagcggcggcaacaccggtgacgccgacagaggggacggtgatcgcgatccacagcctggaggagtggagcatccagatcgaggaggccaacagcgccaagaagctggtggtgattgacttcactgcaacatggtgttctacgtgccgcgccatggctcccatttttgctgatatggccaagaagtccccaaatgttgatttcctgaaagttgatgtcgatgaaatgaataccattgctgagcaattcagcgtagaggccatgccaacattcctgttcatgagggagggcgacgtccatgac

SEQ ID NO: 76609 - DNA, 443 bp, Zea mays
  Clone ID: LIB3079-016-Q1-K1-D4
caaaatcatggatccagagactaagactacaacaccttcagcaaccattacaagctgtggtgttgctacccctgtttcaattaccacatcgaccaccccttctggtgctgcaaggagcacacctctgagacctgtgaggatgtctcctggctcccatcagaaatacagcacgccaccaaaaaagggtgagggtgaacttccaactccaatgtccttagagcaagcagtggaggcctttgagaacttgggtgtatatcctgagattgagcagtggctagatagtctcaggcagtggttttcttcagttgtgatgaacccacttgtacaaaaaatcaaaacaagccatactcaggctaagcaaacaacagctactggtggggcttcagttactgttagccaagttggaagtgatctgccaagcacaacaccaccagttgccttgt

SEQ ID NO: 76610 - DNA, 439 bp, Zea mays
  Clone ID: LIB3079-016-Q1-K1-D5
cttggtttgagctcaacaatgatggcctgttgtgacctttcgcttcgggccgcctgcctgttttcgtttggatcatctaagatttgccatggtaagtcagagtcgctggctactttacaaccatgcttggcaatgataactcatggcagctttaggtgctcttctgcattgcgttggtgggtttgcccttcgtggtcttgttagttttggttgtaggagttggtttgtggtctggtgcatgaagtcggagctgctaagcctcggtgctaagctcgacaacgatgacttgagccaggctttagaactgctgacgaggtgagtggagtagagcaaaagtgttgtgtggtcatctgttgatgtcccaatccaaccagcccacttttgttgtttctagttggttcgagtgttgtgtggcacatgttgatgttccaatccaacc

SEQ ID NO: 76611 - DNA, 431 bp, Zea mays
  Clone ID: LIB3079-016-Q1-K1-D6
aaagaaactcaggtgcccacacaaagtgctaggtttgctattcttcacaggtctgatttttagcatttaaccaaagcgtttgtgtatccttaaaaggagagtgttttccaatgcttgaacttttgtagtaagggtgtgctacatcaaatccagcgtgtttaggatactgctacatacatcaaatcctaaagcctcctagaatctgtcattaggaatttttagagatgctgacatacttagatttttctctctttttggggacattcttgatcaaataagtaattattgcttgtgtagtagactagagtgggctgtattaacacacactaaacaaaaacggaaagaaaaggaaagatgtactcgtggttgttctgttgtaaaattatgtccaaactggtttttttttgtcgtgaaagctcgtcagctcgtgt

SEQ ID NO: 76612 - DNA, 442 bp, Zea mays
  Clone ID: LIB3079-016-Q1-K1-D7
cagaaaaaccagcggcgcagtgacaaaagcccacagcttcttctccctactcctccagtcctccgtcatccgtttcgctctctgccgccgccaccgcacaagaagctagctcctgcctgtaccgccccgtcatggcgatgctatcccgcgcagcctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcgtcaagat

SEQ ID NO: 76613 - DNA, 446 bp, Zea mays
  Clone ID: LIB3079-016-Q1-K1-D8
gagagaaacgcaggggcgcactgacagaagcacacgggttcttctgcctgactcgtccaggcctgcgcaatccgtctggctatctgacggctgcaccgcacaagaagctagctcctgcctgtaccgccccgtcatggcgatgctatcccgcgcagcctcctccgcggcccggcgcccgctgctgccgccgactaggcttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtacctttcgatgggaggcagcgtcaagatga

SEQ ID NO: 76614 - DNA, 311 bp, Zea mays
  Clone ID: LIB3079-016-Q1-K1-C4
gcaaaggctgaggatgattataagactggagataacgagaagatgatgaagcacatgcgtagaggtctctcatgagcgagcatgtgccaacgagctacagcccatatcgcatgggcacccagaacaaatcacacaagaacaatctgctgactgctataatatcttgaccaatgactgccaggaacatttggctatgaagcacttcgtcttaataaatcaactggactttaaaggttgactacatgatcctaacatgtgaccctttgatctctgtgacaccaaaaataagcttaacaacttcaaactatatg

SEQ ID NO: 76615 - DNA, 428 bp, Zea mays
  Clone ID: LIB3079-014-Q1-K1-A1
tggcttggaacctttgggctgctttatgtgcttgtaatcacggaagacgtctatctggtcccgtcagactctgataacgatatcgtgcccgccggcgcccccgacggatacggaggaaaagcagctgttaaacctcgcgtaaaacactcatatagagaagcctctaggagcgaagttcacgtagtcggcgattcgggcgtcgtcgcttatagagtccatcctagaacggacgaaacgacgtgaggctaaagaggacggtgggaatcctaagtatccggagacaagacaaactagcccagcggtacaacagaaggtccaacccggctcttcaaagtaagcgacctaaacgacagatacgacgaccgggtccccgaggagggattatatctcgaccccatcgggttaaaccgcgggagcatagttcgcgc

SEQ ID NO: 76616 - DNA, 103 bp, Zea mays
  Clone ID: LIB3079-014-Q1-K1-A10
cgcacacgtcctgagatggctaccatttatgatcaacacctatactgagagggttgccgtcacttggacactgtccatcacttacatacatcaccttacacat

SEQ ID NO: 76617 - DNA, 401 bp, Zea mays
  Clone ID: LIB3079-014-Q1-K1-A11
gcgcccacgcgtccgcccacgcgttcgggggtcgtccgtggagggtcaccggcgggtagagatagcaggctatgcctgagcacaaatgtttgatataatccgtcccacgatagcaagaaaatgatacgcgatttctgagcacaaacttttgcactcagatgatcgtgcaaacagttagcattttaagaaaaatgttgcagttcaatgtaactgcaggaatgtctctgatgtagcctcttcgatgtggcagccttaacaatcgatgtgctacagttactctgcctatgtatttactatactaccttggccttgtatatccttttgatgtaagcgcagctggatgctgaaccccccggaggctgttagggacaattacaaaccgtcataatttggcccagata

SEQ ID NO: 76618 - DNA, 357 bp, Zea mays
  Clone ID: LIB3079-014-Q1-K1-A12
cccacgcgtccgggaagccttcactccttctccctcttctctctcttctctcgtcccgttgctcttctctggccgccgccacttgcccggacttcctgcagccgagcgcccctgcagctccctgcaccttcatcctgcgcgctccagtcgaccgcgcactgggaccagcgcagtgcccagccgagcagcgcgacgcccggaggcgttcatgtgcttctcggactttggccgctggatggtgtactctgcgggatccgcaacctcctactgagctcccgcacagaggggcaggcatgtgaggctttcgcaggaagtgcaggcagccggccgtcgacaccaagcaagccttgcgcttat

SEQ ID NO: 76619 - DNA, 361 bp, Zea mays
  Clone ID: LIB3079-014-Q1-K1-A3
ggctggaactttgggctgatttagtgcttgaaaaaaaaaaaaaaaaaaaaaccaaaccaaaaaaaaaaaaaaaaaaaaaaaaaagggggggttgtctcaaaagacttaagtccatgcatgtgcgtacgtgatgctacagtctcctcacagcgctattcaaacctaacctaacggttgctgccccaaaatgctgcgatcgggaaaatttcggtgccatttaatccaactgttccgtaataaaacttttccctgttagtcggtgcaacagttaaaaggtttggattgaatgtttcccttaatagccgtgtaattcgaacggttaacgggatgtgtttcgcaatggtgtaccaagtgtggtggg

SEQ ID NO: 76620 - DNA, 177 bp, Zea mays
  Clone ID: LIB3079-014-Q1-K1-A4
tggcctggaacctttgggctgctttatgtgcttggggtggtgcgtcgaacttcccgtagatcatcgtcggcacagagttggaggacgcggtagaatgtccgacggatcatgggccttatgtattgattacgctacggttcgccttcggtatatccacgaccgaattaatccaaagcg

SEQ ID NO: 76621 - DNA, 362 bp, Zea mays
  Clone ID: LIB3079-014-Q1-K1-A6
tgctgccgttcacgacgatgagccggtcaccaagagtaacgccgaacacaccgttggaggagttatttagaatctcactagggccgtttaacggacgtcctaaatcttcggcgtaataagccatacgggacgtaccggaaaggataagcccggcgaggaaacgaagaaaaatgtctaagtcgtaggagccatcgtctaccatcatgaggacgagatcgtcttcatcggtatacgcgtcgcacgcgccgccggcggcgaaaggctaccgaccgtaaactcgctagtggtaaatcgccataaactcgagtactcaaagagattagagaatcgggtatcagccgaaaaggtaaaacatactcata

SEQ ID NO: 76622 - DNA, 348 bp, Zea mays
  Clone ID: LIB3079-014-Q1-K1-A7
tttggtctgatttatgtgcttgtagagaccgacaaactagtgaataaacctcctctccatcgggacttcgataagaaggaacacgcatcgtaatcgcatcctaagttaagattgttagaagtcaacaaattattattagtcttcttggggatcccgttcaacgggatcggggccttcggcgtcttaataaggttattggtgtaagttttcttattttcgttataagccttattgtttttgttctacgtattcttcttcgtatttacgggaacgtttttcaggaccttcttatttttcacgggcggcgcctaattcttggtgttcttcttattgctagccgtaaacggc

SEQ ID NO: 76623 - DNA, 384 bp, Zea mays
  Clone ID: LIB3079-014-Q1-K1-A9
cgcttttctcatttcggggaaagcatgaagaatcgtctgctggactgagagcattggctcttcttggagttggtgcctctggtcttttgagttttgctacaatagcatctgctgatgaagctgagcatggcttggcagccccagattatccctggccacatgctggcatcatgagctcgtatgatcacgcatcaattcggcgtgggcatcaagtttacacgcaagtttgtgcctcttgtcactccatgtccttgatttcataccgtgatttggttggcgtggcctatactgaagaggaaacaaaggcaatggctgctgagattgaggtagttgatggtcctaatgatgaaggtgaaatgttcacccgccctggtaaactgagcg

SEQ ID NO: 76624 - DNA, 396 bp, Zea mays
  Clone ID: LIB3079-014-Q1-K1-B11
cccacgcgtccgatgctacctaggccagccagccccactgggtctgggtgcagcgatgcagtcctcgtaacagaagcagatcttgagggctatgatacttatattggtaccaggaaagatgcggtgtcgttggaagtagccactcgcagtcccatcatgaggagattgtcctgcctctttggctccctcaaacttagtaacagcaactgtgagccagcttcaagccggttcactgaggttcgcgcctgctaggtaggtagtgtcttcctccagttttgcatgctgcatcaagagtgtatctctagataggcaggcaatcatccaaaaaggatttgtagaagcctgtgttcatttcatggccatggggcagtgccatcgggaagaaagttgtgtgca

SEQ ID NO: 76625 - DNA, 364 bp, Zea mays
  Clone ID: LIB3079-014-Q1-K1-B12
tgattatttgtctgtgaagggacctaagggccgattcaagtaccacgttggccaagtgagggcatttggaatgctggctggtggatcaggcattacttcaatgtttcaagttgccagagcaattcttgagaaccctaatgacaacaccaaggttcacttaatttatgctaatgtcacatatgaagacattcttctgaaggatgagctggacgacatggccaaaacctatcctggccgctttaagatctactatgtgttgaatcagcctcctgagaactggaacggtggtgttgggtttgtgtctaaggaaatgatccaatctcattgtccagcgcctgctgaggacattcagatcctgagatgt

SEQ ID NO: 76626 - DNA, 397 bp, Zea mays
  Clone ID: LIB3079-014-Q1-K1-B3
tggctctggaacctttgggctgatttatgtgcttgcgctactagtacactaggcaatcctcgcctcgataagaagctagtcgtcgcgaatcggaccgacggttgcgggaagctggcggcccgcgaggtagcaactaaggaagaagccgcgaaaaaggcctctaaaataaacgcctaggtctccgcagaaccgaatgcgactaagaattctgtcggcctagtcgccgtcggtgtctccgggggccctaacgtttacgtaagcaataccgcggtggttactcctaccgttatcggctaggatttcgtatagaatgcggagagcctttagcgcactattacgccggaagtcacaaacgacggtaaagactcgtatgctcttgccatcacgttactcaccg

SEQ ID NO: 76627 - DNA, 403 bp, Zea mays
  Clone ID: LIB3079-014-Q1-K1-B4
gcttggaacctttgggctgatttagtgcttgtttatgtgcttggcccgaggtaaatacgcagagagagaggggctaatgggtatcggagtaaagaccagtcgagaagtcggtcgtagctaggagcctagagggtggtatactatcggacgttgtcgataaagcccgaactcctcacgtaatgaataatgagtcgcgtggcgtagcccgcgacccttcggtaacctgccctcacgcgaccctattagttttagttctattgttgagcgtcctaccccccccacggccctctacttcaactactactgggaattaatcaacgaagtatcgtgtgtttaccccttttacggccctctcgcaactaatcagaaacgactaagcattaagtagcgcataacgtgacgt

SEQ ID NO: 76628 - DNA, 302 bp, Zea mays
  Clone ID: LIB3079-014-Q1-K1-B7
tttgggctgatttatgtgcttgtttatgtgcttgtccggccttactggcttggagaggagaagtcagtcaatcagtaggagtcgcgccggcgcgcgcgcgcgcggagggcagtcgtagtcggggtcagtcggaaaggctgggagttacggggaggggttgggcggagtcgaagtggactgagaataagactaattgttaggctattcctgttaagtgttgtaatggttcgtctaagaaggtgcatgagtctcaatagtctcgtgatgttcaagctgtgtctactgctgcacttaattgtggt

SEQ ID NO: 76629 - DNA, 410 bp, Zea mays
  Clone ID: LIB3079-014-Q1-K1-B8
cttggctggacctttggtctgatttatgtgcttgttacttctcgttccgctgactacttactgattgttcttcgtctggtcctttatgtttggcgttcgtgccgtatattagggaggagtcttcttgattgattggttacgagtcattaggtcttcttcttgggtattctagttcatttgttgttgggtatggttcatttcttgttaggttagttgtaggtgcatttgttgttggtacatggtgtgttgttatttacggttgttggtgggcatttctttttgttgtagtaggatctcaagggtggtaatgatggtccttcgaaaggacgtccggttgtctctcgtcgtcgtcgtacgtctgatacgcgtcctcgagcctgctgctaggggtcctaggtatggggacggtg

SEQ ID NO: 76630 - DNA, 382 bp, Zea mays
  Clone ID: LIB3079-014-Q1-K1-C1
ggcttggaacctttgggctgctttatgtgcttgacctgactcttctttactattcctactgctattctctgatggtagatcagggggtaggtttactctaattggtggtagttcagggtcctactttttatttttaaacttacgttgtctaggccggagactaacgcgcgttcgtctgattctatcggactctagcttttacgctgcttcctcatcctctgtgctatcccgaccccgtctctcagcccgaccccgtccttaccgcggcgaccagcggaaacccctctaacggctagagagggctaagccggcggatccgtattttatggaggtacggacgccgagttcgcctctgaggagcgttcgtacttgggaccactat

SEQ ID NO: 76631 - DNA, 383 bp, Zea mays
  Clone ID: LIB3079-013-Q1-K1-H9
ctgctcccgagagctggtttcttgcagtagcatgggcatcacaatgccccacaccagcgtccacgcacagcagccgcagcattaccgtgactccgctggtggcggagtctctggtggcacacctgccgagcagcaccctatccacatggacttctcgcgcaatgaagcttggctgcacccatcacaccaccagcatccccatgaacagaaggtccttcattctcgccctatcggaccagctgggcatgttgggcatccaggccatgttgcccatcctgtgcatgccgtgcatgttgtgcatcaccatcctactggctatgggatgatatcagatgcacaacatactcttcagatgatgcaaccacagcttgagtcacagcttc

SEQ ID NO: 76632 - DNA, 438 bp, Zea mays
  Clone ID: LIB3079-013-Q1-K1-G3
cagaggagtgctgctgctggactaaggccgattggagcagtggtcttcatgcaacggggtgtcctgaaggtttgcttgaggactactgacagtacagttaatacatcagagattgcaaaggcatatggcggaggtggaaaacgaagttcgagttcattcactctaagaatggatgagttcaacatctggacttcagtgaactcatgaattgaactggagaggtcacatagtgttcatactgtgggaactcgcaaccagctcatctgggcatggattccctcagtggtgaacatgtgaagatggggtggtctttttgtgctccggtatgagagggaggaaaacaaaatcttagtctaacctaccatgttgatatgagcttacaggagaataatctcttcgatatgaatgactggagagcaatttggaggcataatgctt

SEQ ID NO: 76633 - DNA, 384 bp, Zea mays
  Clone ID: LIB3079-013-Q1-K1-G4
ctttgctttttgcatggcaatacttgtgagctttcctcctggcacaatcgaaccaagtatggctggcctcgctgtaacatatggacttaatttaaatgctcgcatgtcaagatggatattgagcttctgtaaattagagaacaggataatctctgttgagcgcatttatcaatattgcaggcttcctagtgaagcaccattgattattgagaactgccgtccaccatcatcatggcctcagaatggaaacattgaactgattgatctcaaggtccgctacaaggacgatctaccattagttcttcatggtgtaagttgtatgtttcctggcgggaaaaagattgggattgtagggcgtactggaagcggtaaatctactcttat

SEQ ID NO: 76634 - DNA, 417 bp, Zea mays
  Clone ID: LIB3079-013-Q1-K1-G5
cgttccagtaggtacatcaggcgcataccaaaaccagtctcagccttctttcctgagccatgatgcctctcagcctataacattgatgacagtgactagtgatactagtgatcatgctggcgaatgctagacgtcattaccatacagcaggccagcagccagtaaggagctccactttggcagcctgccactctgcttcttccactcctgaaaccgagcctgcaggtgcaggcaatgcggttgcttgctggagtccttatccaatcagtgaaggcactaaactcgcaaagccgttggaatctgcgagcaaggtcatgcacatcttgttggatgaagttaatacagcctgcactgcaactcccgcactctcgcgatcgtgtggaagacgtgggcgccgttgagggtcaaaatcttctt

SEQ ID NO: 76635 - DNA, 417 bp, Zea mays
  Clone ID: LIB3079-013-Q1-K1-G6
ctcttttaaaatgtcgatgaattcaatctgtggcttaaatatctcgtcagaacagtgagcttgctgagatgtttcatctcactcttgcattactcaatgcaggtgcttgttgctcatcaaggggagcgggaagtagcagcacacccaccttcattctcataataatgctgtccagacgcagccatgatctaattagaaacttcttgtcaaaggatgttcgttcttaactagtcgtgcgcactgattaattcagttcatgttgatatggttgtcttaccattgctagcagatcattaatgtctgatatgttggcttaacacatcttgttggatgaagttaatacagcctgcactgcaacttccgcactctcgcgatcgtgtggaagacgtgggcgccgttgagggtcaaaatcttctt

SEQ ID NO: 76636 - DNA, 436 bp, Zea mays
  Clone ID: LIB3079-013-Q1-K1-G7
gcacactgacttggctgaaaaatatggtgtttctggtttccctacattgaagttctgccctaagggaaacaaagccggtgaagattatgatggtggccgggacttggatgactttgtcaagttcattaatgagaagtgtggcaccagccgggatccaaagggccacctgaatcaagaggctgggcttgtgccaagcttgaatcctcttgtgaaggagtttctcaatgctgctgatgacaagcggaaggaagtcctctctaaaatagaagaggatgttgctaagctcagcggttctgcagccaagcatggaaagatatatgtgacagctgcaaagaagatcatagacaagggctctgactacactaagaaggagactgagaggcttcaccgcatgctggagaagtcaatcagtccttccaaagctgatgaattcatc

SEQ ID NO: 76637 - DNA, 393 bp, Zea mays
  Clone ID: LIB3079-013-Q1-K1-G9
gaaaccacacttgatagcaagctcaagacctctgcaaggcgcttaaggggtgatgctgcagagtctgtacatgatatggatatcgatggggacaatgggaggcgtcggaaacggtcaaaaagcacaacaagcccgttcaagaacaatcacacagaggatggcggttccgtatttattggcgaagatacttacaacgggagtcagcaagggacagaaagcgaagactatactaaattcactgtgctgaagctgaagcaggagctcaccaagcacgggtttggtgctcaactactccagttgaaaaatcccaacaagaaggatatcgttgccttatatgaaaagcatgtcatcggcaagtagttcctcggcaatacttgtatttatgctttatag

SEQ ID NO: 76638 - DNA, 449 bp, Zea mays
  Clone ID: LIB3079-013-Q1-K1-H1
cccacgcgtccgaccagggttcgtgcgggtcgtgctggtcgctcagcgcgtctggagggcgtggaggtgcgcactacctcgcaacatggcaagctggaggtgctttcggagcagcagttcgtcgactgcgaccacgagtgtgattcatcggagcctgattcatgtgattccgattgccatggtgggctaatgacgactgacttcagacatctccagaacgccggtggccttgagagcgagaaggattacccttacactgggagtgatggcaaatgcaagtttgacaagtacaagattgttgcttcagttcagaacttcagtgctgtgtctgtggacgaggctcatatttctgctaacctcatcaaacatgggccattggcaatcggcatcaatgctgactacatgcatacatacatgggaagcgtgttatgcccatacatctgtggcag

SEQ ID NO: 76639 - DNA, 400 bp, Zea mays
  Clone ID: LIB3079-013-Q1-K1-H10
gcgacgcgtgcagccatgtttgtagtcgtcctggccctggtgacggcgatcgcaagggctagcacaggcggtggcagggccgaagccgagtgcgatcccaagtccctggtggtgtgcaatcccgcattcatggacggagcgaaatcctcgtcaacattctgttccaccctgcgttcccaggacgtatgcttgtgcgtgtacgccaaagacccctactttgccaaatacatcaacaaccacaacattgcctaaagctttatctcgatcggcatatgcttacccaaatgcttagcaagcgctctgcgtcgttgctgctcttgctcttgctatagtgagcaacatattcagcttatgaatacattatgtggatcagtttagaaaaaaaggccccccccttttt

SEQ ID NO: 76640 - DNA, 374 bp, Zea mays
  Clone ID: LIB3079-013-Q1-K1-H11
accacctccacctcgtcgtctcccaccaccgccgagcgcgagccctagcccgatctaggcggcggcaggcaccagatcccgccgcccgcggcgtcccgggacgcgccccgccgaatccgccgctcctcgcactgcaacacgcccggaccacggtgcatttgatccgtcccggccgcctacacgatgtccaagtcgggagcgctggatcttgcttctggcctcggagggaagatcaacaaggtggaagtcaagtcggccgtcgatgagtatgagaaatatcatggatactatggagggaaggaggaagcaaggaagtccaactatactgatatggttaataaatactatgatcttgccactagcttctatgagta

SEQ ID NO: 76641 - DNA, 382 bp, Zea mays
  unsure at all n locations
  Clone ID: LIB3079-013-Q1-K1-H2
cccacgcgtccggcacgcagccggcgccagtcatttcttctacattctcaatctcagcggggcggctctcgttctttctttctttcttcctttctgtttgctgcatcgatgtagggaggaggaggaggaggaggaagcaagtatccatctgacagcagggtgccccccaatggcgacaagatcgacatctacgatttcggcgtgatcctgctcgaggtcgtgaccgggaggcccatcacgtccatacacgaggtggaggtcatgaaggagcagctgcagtcggcgctgacgtcggagagcccggngcggcggaaggcgctggtggaccaggcggtgagccgggcgtgctccgacgagtcggcgcggacggtgatggagatct

SEQ ID NO: 76642 - DNA, 410 bp, Zea mays
  Clone ID: LIB3079-013-Q1-K1-H3
ccaacgcataacaaactgaacgggtcttccaccaagataacattactaaacagtatggtggacgcaattaaatgctaactcccgactagaacactaaggaaacgataaccatagctacacagaacttgagcagtgctgtgccacccgtaagcacgcaacacagtccagtatgtagccgatgttgtagacgttgattccgaccagaaagggccaggtacgacaccagagcaacctgtcaagcgaagggcacacaacctgcgactaggactgagaactctgctgcgaaatgcaccgagacaaggaacacccacataacagatattgtgttgtcgcgcatcaaatggggcaacacatgatccctagctagggtaactcgagctattacgcagactgggctaactcacgtacga

SEQ ID NO: 76643 - DNA, 329 bp, Zea mays
  Clone ID: LIB3079-013-Q1-K1-H6
tcggttttggggcgcgtcaccgtccctgtttgtttcgttgggtctgatgtgtgcggcggtcgcttggctgtgactcggaggggtccaagggaggtgggacgtttttcggtcgaagcggaaaactagcgggaatggaagggcgaggcagtcggcaggccgagggcggtggcgccggataccggctggtgccggtgcacccaaagtgcgacaatgttcgttgccagaagctgcaccgcctacttgcgtctacgtcatgcgagcggatgctggcgccactctgcaagcaaagatagatgaattcaagcccaatctttcagatgatagctgac

SEQ ID NO: 76644 - DNA, 443 bp, Zea mays
  Clone ID: LIB3079-013-Q1-K1-H7
cttacacgtcttctgaggaggcttcatctgccattactgccttggatggaaagactcgtcgatggacggagcatacgggttaatcatgctaacgagaagaccggtggctttcgtggcggcggtggctatggtggcggcggctatggtggtggtggaggctatggtggtgctggtggaggcggtggatacggtggcggccactatggtggtggtggtggcagcggtggatactgtggcggcgactatggtggcaactacagcaacaggggtggtggtggtgattatggagttgctggtggaggtggaggcaactttactgctggaggtagcgacagctttgccaacagtaactatggttctgacagtagttttggtggaaacggtgctggaggctatgatgcaaccggcggttccacaggcgaagatgggttctctggcacacc

SEQ ID NO: 76645 - DNA, 441 bp, Zea mays
  unsure at all n locations
  Clone ID: LIB3079-013-Q1-K1-H8
cgcacgcgtccggccaattcccaagctgggagtggttcatcaattaatgagcggacgaattctgggttttctcgcggttcatcagaggctgggttagatgaagatcagtcctcaaccggtaagagtggggactcatcattttttgctggtttcttgaagaagggtttcaaggacctttctttattaaataagtccatggatagcgttaaggtttcaattaatggtcatccaatctctgaaagagcccttaagaaggcagagaagaaagctggtcctgttgacccaggttcatattggtacgactaccgtgctggtttttggggtgtcatgggacgagaatgtatcggcattgtccctccatttattagagaatntaattatccgatggccagaaattgtgcccgtggngattctggtgtttttgtcaatggcagagaactg

SEQ ID NO: 76646 - DNA, 448 bp, Zea mays
  unsure at all n locations
  Clone ID: LIB3079-013-Q1-K1-G2
gtggtacgacgacatggcggccaccatcagcaagtcgtcgtcgtcctcgagctcggggcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgttcgcaggcgtgctgcgacgcgctggcgggggcggacctcaagtgcctgtgcggctacaagaactcgccgtggatgggcgtctacaacatcgaccccaagcgcgccatggagcttccggccaagtgcggnctcgccacgccgtccgactgctagcagtgtgctagccaagccaagccaagcagggaggcccccggcattgctagctgtacgtgtctgtgtgtgcatctgcagcagggtgc

SEQ ID NO: 76647 - DNA, 417 bp, Zea mays
  Clone ID: LIB3079-013-Q1-K1-E9
gcgacgtcggcaacggcttccgctgcgtccgcatggtcaacaacatctacctcaactgcgacgccttccacggcgacaaggcccacggcggcgtccatgacggtaccgagatcgtgctctggaagtggtgcgagggcgacaaccagcgctggaagatcctcccttggtgaacgaacgaaagaaactactagctggtaccctaataataattctgctggctgcggcgatcccaaaataaaagaggccgggtgcgatgcatctcggacttctcgagtggtgtttgcgtcagacagccagccactgtggggctagtgttccaacatttgtcagcctgcttgcgcgaggaaggggggtcactgactcaagagaagggcctggtcataggctgctgcattatgaatttctgatgatggctta

SEQ ID NO: 76648 - DNA, 448 bp, Zea mays
  Clone ID: LIB3079-013-Q1-K1-F1
cttggagcaaattcttgctgtgcttatacagtttgttaaagacaagaaattggagcagcaggaccaatttgatgatctgaagaagacctggcttatcaaaaggtgtcggacaatgaatgctaaactaagctatctggagcatcatctattgcgtgacacttacaccaaggacacagtaccagcactgcacaggatcaggaagtatcttgtagaggccacaaaagaagcatccaattcttataatgaagcggtttcgcggttgcgtgagtaccagggtgtagatccacggttcgatgtgattgcgaggcagtaccacgagattgtaaagaaactggagggcatgcagtggacaattcaccaggtggagatggacctgaaacctcaccatgaccacgcagctgtttaagtccacatctgttggaggccatgtttattacctgaatgcagc

SEQ ID NO: 76649 - DNA, 378 bp, Zea mays
  unsure at all n locations
  Clone ID: LIB3079-013-Q1-K1-F10
gcagttcaccacagataacggctttgaggacgctaacattccctttggtcctgtggaagcaaatggtagaacgatactgagcattgatgatcgtttggaggatgacaggcatcagcttcccttgacggctgctgatgcagttgcaaccaatggtgtgaacccgtggaattggagagacacctctactgatggtattaatctgcacatgtcacaacacacaagttaaatcaatacctctgaatgggtggcctttaacttctcagtgcttaaaattggtataatttgaattgttgctatctcactgtgttgtgtactccctccgtttcgttttagttgtcgctggatagtgcaaaattaaaccatncagcgacaactaaa

SEQ ID NO: 76650 - DNA, 393 bp, Zea mays
  Clone ID: LIB3079-013-Q1-K1-F11
cccacgcgtccgcccacgcgtccgcttgccactagcttctatgagtatggttggggtggatccttccactttgctcacagatggaatggagaatccttacgtgaaagcatcaagcgacatgagcattttcttgccctgcaacttggtttgaaaccaggaatgaaggttttagatgtgggctgtggaataggtggaccactgagagaaattgcaagatttagctcaacttcagttaccggattgaataacaacgaataccagataaccaggggaaaggagctcaaccgtttagcaggaattagtggaacatgtgattttgtcaaggcggacttcatgaagatgccgttcgatgacaacacttttgatgcttgttacgccattgaggcaacatgt

SEQ ID NO: 76651 - DNA, 364 bp, Zea mays
  Clone ID: LIB3079-013-Q1-K1-F12
gcgcctccatttcggcctctgtcccttgcaagttcaatctcacctccaaccatgggtgaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaacaagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactg

SEQ ID NO: 76652 - DNA, 445 bp, Zea mays
  unsure at all n locations
  Clone ID: LIB3079-013-Q1-K1-F2
cccacgcgtccgcccacgcgtccgatggagttggttgatgctgcatttcctcttctgaagggagtcgttgcgacaactgatgttgtggaagcgtgcactggcgtgaatgtggccgtcatggttggtggattccccaggaaggagggaatggaaaggaaagatgttatgtctaaaaatgtttcaatctacaaaacccaagcatctgctcttgaagcccatgcggcccccaactgcaaggttctggtggttgccaacccagcgaacaccaatgctcttatcttgaaagaatttgctccatcaattcctgataggaacgttacttgcctgacccggctggaccacaacagggctcttggccagatttctgagagacttagtgtccaagtcagtgatgtgaagaatgttatcatctggggtaaccactcgtncactcagtaccctgatg

SEQ ID NO: 76653 - DNA, 435 bp, Zea mays
  unsure at all n locations
  Clone ID: LIB3079-013-Q1-K1-F3
agcgagggtcggaataatggcggccgttgagggtgccgtgatcgcgtgccacaccagggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaggtcgacgtggacgaactgctggaagtcgcgaagatctacggcgtccatgtgatgccgaccttctgcttcatcaggaacggcgagacgctcgagagctttgctaccgtcgacgaggacgagctccgggacgccgtcaggaagtacgccgncgctggcactacgacggctcctgcctcggcgtccgcctaattcaggagatgtgatgtgtagcaaatagcgcgcgcgca

SEQ ID NO: 76654 - DNA, 436 bp, Zea mays
  unsure at all n locations
  Clone ID: LIB3079-013-Q1-K1-F4
tgaaattgctagtgtcagcacctccgttaaaggagttggagtcattggtaatgtaagaggcgattgacttgcaatccccaattggcagtctcattgggagacaagttgtcaaagttggaagaagttctggtatgacaactgggactgttgtcgcatacgcacttgagtacaatgatgagaagggaatatgtttcttcactgactttcttgtcgttggggagaaccaacaaacatttgatcttgaaggggacagtggaagcctcataatcttaacaggacaagacggtgagaagccgcaacctataggaattatatggngtggtacagctaaccggggaaggttgaaacttaaaagtggccagggtccggagaactggacaagtggagttgatcttggccgncttcttgatctcttggagctagatctgatcacaac

SEQ ID NO: 76655 - DNA, 286 bp, Zea mays
  Clone ID: LIB3079-013-Q1-K1-F5
cccacgcgtccgaaaaaaaaaaaaaattaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaataaaaaaaaaaaaataaaaaaaaataaaaaaacaaaaacacaatataaaacccttatattatccaccaaaaacttaaataaaaacatcttatattcatccaataaataaaatttaaaaggaacactgtaaaaaaacataatcattataaaa

SEQ ID NO: 76656 - DNA, 432 bp, Zea mays
  Clone ID: LIB3079-013-Q1-K1-F6
ctattttgaaggtgttagaccttcagtgcgcgagtaaagttgctcgagaacccgaagggtctgaatggactgaaagagtcagcagatgtgacagattgaaatctccggttaggattgcaatggttggaaagtatactggcctgtcagactcctacctatctgttataaaggctcttttgcatgcgtcggttgctttggacaggaaacttgtggtggactgggttccttcctgtgatcttgaagattctacagcaaaagagactcctgacgcctatgaaaaggcatgggagtcgttgaagggtgcagatggtgtgttggtgccaggaggttttggagacagaggagtccaagggaaaattctggctgcaaaatacgcgcgagaaaacaacgttccatatcttggcatttgcttgggcatgcaaattgcagtga

SEQ ID NO: 76657 - DNA, 443 bp, Zea mays
  Clone ID: LIB3079-013-Q1-K1-F8
catgattatacttttgttatctgttgttatttactgttcatgataagatcattatggtaattggaacatggagcgaccacccgggaaaacagtgctaccacaagggtttatggacgcccttggctgattaattaggaaagctagtggaggactaccttacccgaaaggggcaagggcagtaggggagtggtcagtgtagggaggtccttggttgattttgctgcgatggcggtcagccaagaaccctgcattggagcttcctataaactgtagcgggttttctgaagctagtggaactttgtaaaggcctcgtagtgttaccctgcctcgcctcctcggtagaggtgtatgggaagtcgcgatcccttggaagatgggtaacatgacttgtgggtaaagatgtgcaacctctgcagagtgtaaaactggtatactagccgtgc

SEQ ID NO: 76658 - DNA, 412 bp, Zea mays
  Clone ID: LIB3079-013-Q1-K1-F9
caaaaattgaagatgaacttactgaagaaagagccaagcatgacaatagtagtgatgaggactcatgtggtgattctggcggaaagaacaagaaagcaaagaagactcgcttcactcatgcagtaaagggaaagggcaaatccaaagtctgatgcttggtgtacatagtcggcagcattttgacaagaaagcgtccattaaccagctcctgatgcatctccttttgtaccatcttgccaactccctcaccccccccagctaaggtgctgaagacccgtatgaaacgcatgctgatagaccccatagttgtctcctgcatcaatgctcctaaggagttagccagttaggtttcggactcttttgaatcctgacatgcttatgatcacttgtcatttgtcaacgaggcctttta

SEQ ID NO: 76659 - DNA, 378 bp, Zea mays
  Clone ID: LIB3079-013-Q1-K1-G1
gccaaccctgtttggtttgattattatagtactggttttccaacatacagttcactagcatgtgttagccatgagttggaccatgtgatttccccccactccactccccccccccccccccccaaaaaaatgatcttaaggtattaagttttaactcagtctcccacatggcaaaattcttgtctgaattttctttaaaaagtgcacttttacttttaattgtacagaatctggagaattgtagagtatcaagttaattttgttctgtttaagatatgtaagaaagtacataaatgtactttaaattggtgaatattttgtttatagaaagacttaaagcttcaattttgtgttgattttttagattgataccatttt

SEQ ID NO: 76660 - DNA, 391 bp, Zea mays
  Clone ID: LIB3079-013-Q1-K1-G11
cagaatgctgcccaccgggtgcaggtgcagcctcctctcctgcctccgccgcgacaagggcgaggcgggccgaaccgacccccgcgtcgcggacgagcccaccgcgtcgtcgctcggcaagggcagcgccgcggctcggcggttcgcgtgggccgagatcgagtccgtcacggcggggttctcgtccagggtcatcggccagggcggcttcagcaccgtgtacctggcctgcctctcctcctcccgcctcggcgccgtcaaggtgcagcgcagcagcgagcgccttcaccgcgccttccgccaggagcgcgacgtgctcctcgcgctccgacacccgcacatcgtccgcctgctcggatactgcgacgaacgagaggaaggcgtgttggtg

SEQ ID NO: 76661 - DNA, 379 bp, Zea mays
  Clone ID: LIB3079-013-Q1-K1-G12
gttttgttgaatttacaagccgtgcatctgcatagcgagttcttcagacatataatggacaaatgatgccaaatgttgacttgacatttcggctgaactgggccagtgctggtgaaaagcgtgatgatactcctgactatactattttcgttggtgatttggctgcagatgttacagattacttgttacaagagacattcagggttcattatccctcggtgaagggtgcaaaagttgtgactgataaattgacaatgcgtaccaagggttatggatttgtgaaatttggcgatcctacagagcaagctcgtgcaatgactgaaaatgatggaaatgccttgtctttcaggcctatgcgtattggtcctgcagcaagtag

SEQ ID NO: 76662 - DNA, 307 bp, Zea mays
  Clone ID: LIB3079-013-Q1-K1-E8
cgaagacgcctgctcgccgccggctggaaaccgtcaagccactgcttgagaccttgggcctcctgcactagcagcttgcgcgccatgcagtaacggcgggcgtgtggtttattacaaagggcaaatgcaaatcgagttgctcaaactcaatactcctactagtaaaagtaatgatgagatagatttgatagatgggtactcgaatatgctacagtacaattaatgcatctcaggcgatcaagcagtaattaaaccgaaattaatttaagcatcccctctttgatcgaaaaacagaatatgatgatat

SEQ ID NO: 76663 - DNA, 417 bp, Zea mays
  Clone ID: LIB3079-023-Q1-K1-D10
gtagcgtccgtccggtccgcgcgcgttcccctccccgaccggcaggttccccggccgtgtcatccgtttcccactgctcctccgtggctcagctctgctccctgtatcggtctgcccctctgccctcccggtctctcctcttcccgtcccgcccagcgcgtccaccaaggaagcccccacgccacggcatggggatcgtggaggaggcgcacaacctgcgcgtggtgggcgaggggaagcgcggggtcatcgtgctggcgcacggcttcggcaccgaccagtccgtctggaagcatctggtgccgcacctcgtcgccgactaccgcgtcgtgctcttcgacaccatgggcgccggccccaccaacccggactacttcgacttctcccgctactccacgctcgagggctacgcgctcg

SEQ ID NO: 76664 - DNA, 413 bp, Zea mays
  Clone ID: LIB3079-023-Q1-K1-D11
ggaaaaatcgccccatcccctgactatcactggctcactgcccttccacctacaggggccagcggccatggtgaagaagcccaacggtgtcgccaaggccacggcgacctctgctgacgcggcagcccagccatccaaggagaatccgtccacccctgggttggtcaaggcctcgaagtttaagaagagaaaggtcaaggccaaccgtgcgaagcaggcagtcgctgcagcagctattgacgaggtcgcccctgtaggtgcaggcactggtgatggcgatgcatctgcatcagcggctttaccgcaaccatccgatgttgccgaggcattacttgtggtgcaaacgccaaagtcaaccacttttgctgaggcatcacctgtggcacagacgcagaagccagccactgatgctg

SEQ ID NO: 76665 - DNA, 414 bp, Zea mays
  Clone ID: LIB3079-023-Q1-K1-D12
gaaatcccaagccaagctgaacaggttcttatacagaaccagcagctcccggccatggagaaagagaagcaatccgttcctgaatgctcgctccaaaaaagtgttagttctggatgcctcaactcagcagattggatgaatggacctgccaggccaaactttctagacttccaggggctggactttgaggcagcatttgggctgaggagagcttacagcgaaggagacattcagaaccttggagccaacacgcctcgaccagcagcaaatgtttgtgtgaccatcagtgacctcaagaccgaagaaaggaagcaaaagctttccaggtataggaagaagaagatcaagcggaactttggcaggaagatcatgtacgcgtgcatgaaggctctggcagacagccagccaagagtg

SEQ ID NO: 76666 - DNA, 406 bp, Zea mays
  unsure at all n locations
  Clone ID: LIB3079-023-Q1-K1-D2
gtgggttcccgtcaccaagctcggccgccttgtcaaggagaacaagatcaccaagatcgaggagatctacctgcactcgctccccgtcaaggagcaccagatcgtcgagaccctcgtcccggggctcaaggacgaggtcatgaagatcacgcccgtccagaagcagacccgtgccgggcagcgcacccgcttcaaggccttcgtcgttgtcggcgatggcgacggccacgtcggcctgggagtcaagtgcgccaaggaggtggccaccgccatccgcggcgccatcatcctagccaagctctccgtcgtccccgtcaggagggggtactgggggaacaagatcggacagccccacaccgtgccctgncaggtcaccggcaagtgtggctccgtcactgtgcgcatg

SEQ ID NO: 76667 - DNA, 396 bp, Zea mays
  Clone ID: LIB3079-023-Q1-K1-D4
gtcagtggaaacctgcctcctgggtttgattcaagtacatgccgcagcgtgtatgttggcagtatccatcttcaagtgacggacacagtactgcaggaagtcttccaaagcattggtccagtagaagggtgcaagctcatcagaaaagaaaagtcatcctttggtttcattgactactatgaccgcagatatgctgcactagcaattttatctctcaatggcagacaactgtatggtcagccgattaaagtcaattgggcatatacaagtactccgagggaggacacatcaggtcattctaatatttatgttggggatctttgcccggaagtcactgatgctactatgtttgcatttttctctggatactctacttgctcagatgctagggttatg

SEQ ID NO: 76668 - DNA, 407 bp, Zea mays
  Clone ID: LIB3079-023-Q1-K1-D5
caggcgagctcgggaccagatccactgcgggcagctggagcggaagggccatggggacgccgccgcctttccaggagtccggccactgcgacgtctgccgctgcaccttcaacaccttccgccgccgtcatcactgccgcagctgcggacggacgctctgtcacgagcattcttcgtactacatggctctcccgcagtatgggatatatacagacgtcagagtctgctacggttgcttcaacaaatcctccagccaaggacacgctgataatccggtgtcagctggtagcatttctggagcagctgactctttttcagggctgagtttgggtaaggaggatgattcgtcgcctatgaagaattcaacggttcagagcacggcagcccttattgagtgcaaatgtggg

SEQ ID NO: 76669 - DNA, 230 bp, Zea mays
  Clone ID: LIB3079-023-Q1-K1-D6
gcgtaggctacctgcaataccagatccacttgcattcgacatggcagcaatcaggtaacatgggagggcgcatcaagcctacagtacacattacacgacacatgatcacgcataccgtataaacactcacaccttcgctcactgacatcactgtcaaaaatacgcacggtcattatgatacacacactggtcagactacacacttgatggactgcctcggatatatacat

SEQ ID NO: 76670 - DNA, 374 bp, Zea mays
  Clone ID: LIB3079-023-Q1-K1-D8
cagatcaccaccaccacaccagcaatcgcaagactcctttgagccgaaggcatgttgggtgggatggaagaaacatgcgcacggagctacggacgttgctgatgagacaacgcccgcacgtgggcatggtctgcatgtcacgaccgggatgctcttcacgaggaagagcttgctatcagggacagtcttaccggatggtaccaagatctgtggacacggcttactcgattccgaaaggtttgaactacaagcggatgcagatgccatctcgttcagctgcagccagctggacaccatcctgaggatgtttcggatccctcgggggtgcaagaaggcatagcaagtcggcgtcacgctccggacatgctacgctg

SEQ ID NO: 76671 - DNA, 415 bp, Zea mays
  Clone ID: LIB3079-023-Q1-K1-D9
cccacgcgtccgggactcctcagttccttcgctcctctgtaacccggggcggccgacgaggccgggaccaccgacggcgacgatgggcggcggcgagggcaagtccaagaaacgccgctcttctacctcctcagcggatgaagaagggggggaacggaagaggcgggacaagaaggagagcaagaggaggagccgagacgacagggaggatgacgatgacagacacaagaagaaggggaaacacatcgacaggaacaaaggaaaagagagagattcgaaggataggcattccaaggagaagacgagcaagagaaaagacaaggacgctgccttcaaagaaatatccaaggatgactactttgcaaagaacaacgagttcgctacctggttgaaggaggaaaagggcaaatatttc

SEQ ID NO: 76672 - DNA, 404 bp, Zea mays
  Clone ID: LIB3079-023-Q1-K1-E10
ggggaccagttatgacagacgagtttaatcctcaaaaggacacttatgttctgtgccaccatggcatgcgctcaatgcaagtggctaaatggttgcagtcacagggtttcaaaaaagtttacaatgttgcgggtggaattcatgcctatgcggttaaagccgactcctctatcccaacgtattagaggatcctcatggtgacactttagcacggctgccggctgggaacttctcatatatcttaggcattgacgttgatcaatgcttgaattcagagctcaattttatttctcatactgtgtatcagaaagttttgggactcctagggaggaaaaatatacagctatttttgttaaaaaaagatacttgagaaattgctttattgaacgaaccgtttcatcagg

SEQ ID NO: 76673 - DNA, 398 bp, Zea mays
  unsure at all n locations
  Clone ID: LIB3079-023-Q1-K1-E11
ggccagcggaggagggcacaggcagcagctaacatccctcactctcggtacctgaccggaccacgagagcaacatgggcggaggacacgacatgcacgggcagcactacggccacaacggcggcgtgaagggcttcgtgtccaacctcgtccacggcggcggcggccatggccatggaagcggctacggccatggccatggaaacggctacggccatgggaatggcggctacggcggcggccacgggtaccctcctcccgccgccgccggcgcgtaccctcatccgcacggcgcgtaccctcacccgcacggcggccacgggtaccctnctcccgccacctaccccgcgcactcggcgcactacgggcacacggggtcgtaccacaccagccacaaca

SEQ ID NO: 76674 - DNA, 421 bp, Zea mays
  Clone ID: LIB3079-023-Q1-K1-E12
gaacgcctacctccactaactcacacttctcctaaagtttccccacccccgtgcgccggtccaccaccgatctggtctcactgcatactccttccctcgccgtccaagagcgccggtccgatgggtcgtccgccgagcaccactggtgctccggccttgcggtttctaccttccgaggtggcggaaatggaggcgcgcttgctgcagctcaacaacggcatctgcaccctcgccatgctccagactctcgccgattagttcttcgtctcgcccgaacgcgcctgcaaggtggccatccagcccaagcaggtgtggaactggtttcagaacaggcgttactcgcatcgggccaagaccaccatggtcgtgccgtctccaccggctaagatgacccgctcggtggccgatcaccaccagcacg

SEQ ID NO: 76675 - DNA, 389 bp, Zea mays
  unsure at all n locations
  Clone ID: LIB3079-023-Q1-K1-E2
gggaaatgaagctccaaatatgaaacctgctgatattgttttcatcattgatgagaagccccatgatgttttcactcgggagggaaatgatcttgtcgtgactgagaagatctcactggtggaagcactgactggctataccgcacgtgtcactacgcttgacgggcggagcctatcattgcacatcaactcaataatccatccaaagtacgaagaggtgatgcctggagagggcatgccagtgcccaaggaccccacaaagaagggaaatctgcggattaagttcaacataatgttcccctctaggctgacttctgatcagaaggccgggatcaagaggctattgggttcttaggccgtcacctcaaatgacatcttctntatgatga

SEQ ID NO: 76676 - DNA, 412 bp, Zea mays
  Clone ID: LIB3079-023-Q1-K1-E3
atgcgtccaaatgcatctccaaatctgaaacctgctgctattgctttcatcacttgcttaaaggcggggtgatgttatcactcgccacgcaaatgatcttctcgtgactgacaccatcttactcgggtaagcactgactggctataccgaacctgacattcctcttaaacgacactgcctcatctatcacatatgcttattaatccatccaaagtacagaggaagccatacactatatgaggatcataccacaaccataagggaccctcggacattgggagcagttgaatctaactcagcatcatgatccatgcttgacatccttgtgaggataacgacgctaccaacaagctgttggaggcctaggacaacaattctcctaagcagttgttactcatgaaagtttgccctg

SEQ ID NO: 76677 - DNA, 397 bp, Zea mays
  Clone ID: LIB3079-023-Q1-K1-E4
cccacgcgtccgcccacgcgtccgcccacgcgtccggaaaacacaaataaggttatttcgcctgagatgattccaactgaccatgaccgggttcacaagagttctgcaatttcagatgatccctttatagaggaaaaaatatattatcagctacaagatgctcttggcaagttggataccaaaactcgactatgcattcgagatagtttgcttcgtttggtccatagtgcaacagagagaaagattgatggtgataggagcactaacaagactaataaagatgaagatgaagcttcggaagacgcatctactaggaaaacaaggtctccaaacaaggaagcagaaacaaccactaatccaattgatcgtatagtggcccatttgctgttccacagac

SEQ ID NO: 76678 - DNA, 185 bp, Zea mays
  Clone ID: LIB3079-023-Q1-K1-E5
actccacgcatgcgtctcgacataaccggactcactcatctggtttctctagcatgatgtggagcttctaggtagaaaaaatcgatgtattattaagcacctaactgatcttaatattaacaagcatttaaggctaggtgctgctttggctggctataccgcatgtgtcacttcattaatcagtc

SEQ ID NO: 76679 - DNA, 387 bp, Zea mays
  Clone ID: LIB3079-023-Q1-K1-D1
ttcaaagccatcactgaggagcagaactcatcatcgtctgttccttcctccggtgaagctgtaagtagcgtgacggcaccaagtctgcctctgttgtctttggtccccataacagcaacccttggttgcagggaagaccaaagcattttaggcagggctgttgcaagggcaaacggcatggcggacgtggaaaggaggatgatgcaagagatgccgggcgtgttcaccaatggcctgtccaacggcagcagggtcgaaggcttcctgtacaaatacagcaaatgagaagtgaggatcgtatgcatctgccatggaagcttacttactacttcggagtttgtggagcacgccggcgccggcaaggtagataacccgctgcgacacatt

SEQ ID NO: 76680 - DNA, 382 bp, Zea mays
  Clone ID: LIB3079-023-Q1-K1-B5
tcgtgttggttgcaatgaagctcctgttgtgtcaacatccagaatggatgcgatgggtgggaattgacaaggataaggtaaaagcagctttggagaagcgaacgaaatcgaaaggtggttttgccacgaaggtaaatgtgattgatgatgatgatctacttgagagagagctagaacaaggtgttgagttggctgttgagtttgagaagattaatcaagataagaagcagaactcgtccgatggtagcatgcatgcaccagaccttgaaaacgctgactaattaatggagaatggccaccatgtctagcagagtctaccaactacagctgaatacatgggctgtccgatggacagtaaagaacgacatacttcagcacttta

SEQ ID NO: 76681 - DNA, 411 bp, Zea mays
  Clone ID: LIB3079-023-Q1-K1-B6
gtgcttcagcctctctgcatgatgctacatcacagcaaactgaagttgaaacagaaagaaagaattccgcttatgtgtatgaatctttgggggaagaggaagagaaatggcacgctcagtatggtcaggtcgagaggtcaaatgatgatcaacatttacctccaacaattgatatatgggattgggatgtggtccaagaccatgttaacaaaggtcagcccgtggttaggcttgtgggatgtttatctaggggttcaaataagcttcatccttctcttcctactcgtggtggccttgtaaggactgctcctgtgcgtgaagttcatcttgacctcgtgcaagtttcaacagggaagctgtacaggctaaggaaccctagcagaaagtacttagccactttatccgcatatg

SEQ ID NO: 76682 - DNA, 371 bp, Zea mays
  Clone ID: LIB3079-023-Q1-K1-B7
ctacttctaactgtcaggctcatgcttcatcacctctcactgaagacgacacggcatgctaaaaatatggctaatgaatcagcatcttaggtgaaagaaacagaatcatatcacgctccggacaggcaggaacacgagacagatgactatcaacggttatacataactctagcactacgcaatgggcctgatgagtacattcatactagcaactggaatgcctatgcaagcgatgccgattgtaggtcccgtacatcaaacatttggacacttatgaacctaggttatatggcctggcatacacgtatagtctacaccctgcagatgactacatcttgtgcctgacggacttgaacatgcgacctatttca

SEQ ID NO: 76683 - DNA, 89 bp, Zea mays
  Clone ID: LIB3079-023-Q1-K1-B8
aaaaaaaaaaatatatgaataatgcatacataaaaaaaaaactgaaattaaaacggaagggaaaaataaaactaatgtatatacaatct

SEQ ID NO: 76684 - DNA, 388 bp, Zea mays
  unsure at all n locations
  Clone ID: LIB3079-023-Q1-K1-B9
gttccatcgtaagagtttttaccagcatccaggagaagactcccttaagtgtgatcatgggctccgcaatcggcatcgtcatgaatggtacgctcttgggtcagatagtactgtaccagaagcccgctccaaagaaacagaagaaagaagattaagcaacatggagaagctgcagaaagttcttcctggttgtttaggattctgttccaacactcgctccacatctgaacaaatggcaccagtataggaagttgttggcaacttgttacgagaaaagaacatagtcggactattgctatataacaacatttctgtgctgntgtttttagcacttagcagtgtaccatgacttgaatagttcatataactgcctttagatattgactgc

SEQ ID NO: 76685 - DNA, 397 bp, Zea mays
  Clone ID: LIB3079-023-Q1-K1-C1
gcgtaacaaaaaatcgtccggacaccttccacggagacaaggaccacagaagcatacaggggggccaccgtagggctatgggagtgggccaagggcgacaaccagcgctggaagatcctgccctggtgaacgtgaacttcacctcgttgtcttatatacgcagagagacgagctagatgaatccaaggaaccttacctagctgctgcctacttcggctaattcgtcctactccgctctagctgatatctgtctgtgtcttcgcatcctctgttcctgaatggacgaataatatatagcacgcatgtactgatagcgaccatgtctgaatgacatcttacatgctgctgctgctgctactgctacctgtccgtttggtgttctaagaggactctgatg

SEQ ID NO: 76686 - DNA, 425 bp, Zea mays
  Clone ID: LIB3079-023-Q1-K1-C10
ctttcccctgcaagggaaagagaagaacagagacacaccagtgtatagggtttcggcttgcctgtgcgtgttactgtcgcaatggcaggaggtctcttctccatggagcacccatgggcctctgtttttggcattctaggtacgctgctgcctgtgctgtgttgtgcaccaggaatgctggatttcgttctcaccgtacgatacgacttgcatgcatggcagcatgatcgatggcatgatgcgtgccaaacgattgctcgtcgtcgtcatcatcatcactcatcagtgttttttttacaccgagtgaaaatattcccacaggtttactgacagaaattcccatatgatatgtatcttcctttggtaatttcctgcaggcaacatcatctcatttctggtgttcctcgcaccagtgtaagtgcact

SEQ ID NO: 76687 - DNA, 425 bp, Zea mays
  Clone ID: LIB3079-023-Q1-K1-C11
gagaaggacatcactcccatgggtggtttcccccactatggtatcgtgaagggtgactacctgatgatcaagggatgctgtgtgggtccaaagaagagggtggtgaccctccgccagtccctcctgaagcagacttcccggctggcgctggaggagatcaagctcaagttcattgacacatcgtccaaatttgggcacggtcgcttccagactaccgatgagaagcagaggttctttggtaagctcaaggcgtaaggtgctgcggtgcagcgaaagtcccatttgtcaaaatcatcaaactgtgaaacctttgtttgttaccttgctgtaccaagttttgtagcatgatgatttgggagcatgttccggtcttcaatggattgttctacgcttcagaactgcagtgactatgttttgtgctattt

SEQ ID NO: 76688 - DNA, 419 bp, Zea mays
  Clone ID: LIB3079-023-Q1-K1-C12
acgtgattgacgattttgactcgaatcatggtgtgcatctctaccagatagagagctgacctgaggtggagacgcggatcgtggctcctggggtggaggtacaagcgtacagctcaataggagatcaagagtaaagagtgtggggaggggaaggacgcgatatcgggggaggatggtgcttgtgcttgcgctgggggatctgcacatcccgcaccgggtgcccgacctgcccgccaaattcaagtccatgctcgtgcccggcaagatccaacacatcatctgcgctggcaacctctgcatcaaggaagttcatgactacctgaaaagcctttgccctgatctccacattactggaggtgaatatgatgagtatgctcgatacccagagactaagacactttacaatggtcagtttaagc

SEQ ID NO: 76689 - DNA, 267 bp, Zea mays
  Clone ID: LIB3079-023-Q1-K1-C2
tacaaaaaaaaaaataaaaaaaaaaaataaataaaaaaaaaaaaaaaaaaaaaaaaagggagagatataaaaaaaaaaaaagaaataaaaaaaaaataataaaagactacctctttaaaaatcccaaccttacatcctcttcctttctacgtcttacctctactttagttttacctaatttctattcacttgcctttcttttccatctcataatctggcaaatcctttccgttccccaatttaatcgtcttgcactacatccccttt

SEQ ID NO: 76690 - DNA, 325 bp, Zea mays
  Clone ID: LIB3079-023-Q1-K1-C3
gcagcagcctgtacgagccagctctgatgcagcagcagcagcagctgctggcagcccaggggctcaaccccatggccatgatgatggcgcagaacatgccggccatgggtggactctaccagtaccagctgcccagctaccgcaccaacccctgtggcgtctacgctggcattccgccctactactgattcatgatatttgggaaatctcctctatccatctctctctatctatatatgtaataatgcagtaagacgacacacattatcatgtgtggtatgaccaataatatatgcatgggcataataaagatttgggtttaatg

SEQ ID NO: 76691 - DNA, 394 bp, Zea mays
  Clone ID: LIB3079-023-Q1-K1-C4
tgtacgacgccgggtacggcacgcgctcgacggcgctgagcacggcgctgttcaacgacggcgccatgtgcggcgcgtgcttcgccatcgcctgcgacgcggggcggtcccagtggtgcaagccgggcgccgcctccgtcacggtcacggccaccaacctgtgcccgcccaactgggcgctcccgggcgacgccggcggctggtgcaacccgccgcgccgccacttcgacatgtcgcagccggcgtgggaggccatcgccgtgtaccgcgccgggatcgtgcccgtcaactaccgccgcgtcccgtgccgcagggccggcggcgtcaggttcaccgtccaggggcgcagctacttcgagctggtcaccgtcgccaacgtgggcggcagcggcgt

SEQ ID NO: 76692 - DNA, 360 bp, Zea mays
  Clone ID: LIB3079-023-Q1-K1-C5
cccacgcgtccggacgccttccacggcgacaaggaccacggtggtgtccacgacggggccaccgtcgttctctgggagtgggccaagggcgacaaccagcgctggaagatcctgccctggtgaacgtgaacttcaccttgctgtcttatatacgcagagagactagctagatgaattctaggaaccttacctagctgctgccgccgccgtctaattcgttctccttcgatctagctgatatctgtctgtgtcttcgcgtactctgatcctgaatggacgaataatatatagcatgcatgtactgctagcgaccatgtctgaatgacatcttcgttgctgctgctgctgctactgctacct

SEQ ID NO: 76693 - DNA, 395 bp, Zea mays
  Clone ID: LIB3079-023-Q1-K1-C6
acccacgcgatcgcgtgtacgacacccggttccggaacgcgctcgacggcgctgagcacggagctgatcaacaagcggggccatgtgcggcgcgtgcttcgccatcgcctgcgacgcggggcggtcccagtggtgcaagccgggcgccgcctccgtcacggtcacggccaccaacctgtgcccgcccaactgggcgctcccgggcgacgccggcggctggtgcaacccgccgtgccgacacttcgacatgtcgcagccggcgtgggaggccatcgacgtgtaccgcgccgggatcgtgcccgtcaactaccgccgcgtcccgtgccgtatggacggcggcgtcaggttcaccgtccaggggcgcagctacttcgagctggtcaccgtcgccaacg

SEQ ID NO: 76694 - DNA, 378 bp, Zea mays
  Clone ID: LIB3079-023-Q1-K1-C7
gctccatgtaagctccggcccgatcgatgagaggagtcagacggaggcaaggcgcggggtcggcagcagaggggagcagagagatctcattctccgatccgaccagtccaccatggcggaggatgctacgagcagccacccgtcacgctacgtgaagctcaccagggaccaggacgtcctcgccgaggacatgcgccccggcgagctcaaccagccagttcacgtcccgcagctcgaaggccggaggtgtagcgagtgcggtcaggtcctgcccgagagctacgagccgaccgccgacgagccctggaccaccgggatcttaggatgcaccgatgacccagagacctgccgaactggatggttttgcccctgcgtgct

SEQ ID NO: 76695 - DNA, 400 bp, Zea mays
  Clone ID: LIB3079-023-Q1-K1-C9
cagcgcagcacaaacaaacaccgcgccgccgccacagctttgccctacagaatgcgttgactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgagcgggaatttggttcagtgttgctattcctcattctttttgtatcatatatgtctgcgacatttatatatatgaataaagttggatgatctgctgc

SEQ ID NO: 76696 - DNA, 396 bp, Zea mays
  unsure at all n locations
  Clone ID: LIB3079-023-Q1-K1-B3
gatggtgttggtggcaatgaagctcctgttgtgtcaacatccagaatggatgcgatgaataaaattgacaaggataaggtaaaagcagctttggagaagcgaaggaaatcgaaaggtggttttgccacgaaggtaaatgtgattgatgatgatgatctacttgagagagagctagaacaaggtgttgagttggctgttgagtttgagaagattaatcaagataagaagcagaactcgtccgatggtagcatgcatccaccagaccttgaaaacgctgacgaattaatggagaatggccaccatgtcaagcagagtctaccaacgacagctgaagacatgggctgtccgatggacagtaaagaacgacatcctncagcacttcataagcaaaatgat

SEQ ID NO: 76697 - DNA, 408 bp, Zea mays
  Clone ID: LIB3079-022-Q1-K1-H9
gagataacggggcgccgcgtcgcctgcggcggcaagcggctgaaggccatgaccgaggcggagctcaactacccgtcgctggtggtgaagctgctgtcccgcccggtcaccgtccgccggaccgtgaccaatgtcgggaaggccagctccgtgtacagggccgtggtggacatgcccagcagggccgtgtccgtggtggtgcggcccccgacgctgcggttcgacagggtgaacgagaagcggagcttcaccgtgacggtgcggtggagcgggccgccggccgtcggcggcgtcgagggcaacctgaagtgggtgtcgagggatcacgtagtccgcagcccgatcgtgataccgccggcgaaggccaccgcgtaggcgtagctcccagcccaaatgcccaattgatga

SEQ ID NO: 76698 - DNA, 334 bp, Zea mays
  Clone ID: LIB3079-023-Q1-K1-A1
gagatccatcccgctgagtgctacaaccacgacattgctggtgctggtcattctaatagggcactcatggctccaggcgatatatgaccgaatgcaggcttgagggatagaaccatcgataacaagcatcgagcatcttctgattaggtatcttctgcaggcttttttacgttcaagagataaattaaagcctctagaactgaacggtgcatatatacaatgttggacggcaggaaggctcttgattgctgatctagcatgatcgttagcctgcggtatcagaaacacgattgactcagagcatttggctaatgagatctgagaggctttaaat

SEQ ID NO: 76699 - DNA, 408 bp, Zea mays
  Clone ID: LIB3079-023-Q1-K1-A11
agattgtagaggaggcccgcacgccaccccagtcatctactccggtggctggttttgggtgggctgaggaagaagagcaggaagatggcaagaggtctgatgatgaccaacagtatggggaggatgaagactaccatggcgaagaccaatatgataaacaggtgaagcatgtacatgccaacggggattttcaacaccttctaaaatgaaacttctggcaacgcttaaatccctaaatggggagatactggctggaattggtggaagttggggtgctgagaagcttgaccctcgggcgtactgaagttgcttctgtctggatcaccttttttttcgcattatgtgtgctatactctgtaaattatcaaactggctttctcaatgcctatgtaatgaaccgttgagtga

SEQ ID NO: 76700 - DNA, 415 bp, Zea mays
  Clone ID: LIB3079-023-Q1-K1-A12
agattgtataggaggcccgtactccaccccagtcatttactacggtggctgtgggtggttgtcctgacgaggaagagctggaagatggcaagaggtctgattatgaccagcagtatgtagaggatgaggactaccatggcgaggacgagtatgataaacaggtgatgcatgtacatgccatcggcgattctcaacacctcctagaatgaagctcctgtcagcgctcaagtgctcaactggtgagatactgtctgaatctgttgtactttgtggagctgagatgctgcaccctcggcagctacttgtagttaacttctgtctgtatccaccttttactttcgcatattgtgtgctatactctgttaattatcaaactggcttcctgaatgcctatgtaatgaaccgttgagtgatt

SEQ ID NO: 76701 - DNA, 401 bp, Zea mays
  Clone ID: LIB3079-023-Q1-K1-A2
caccgacccatctggtactttttggcaatgcaacgcgaaggcaattggatctggctctgaaggagctgatagctccttgcaggagcagtacaacaaggagctggcccttgaggaggcggagaccatagccctttctattctgaagcaggttatggaggagaaggtgaccccaaacaacgtcgatattgccaaggttgctcccaagtaccacctctacacccctgccgaggtcgaagccgtgatcgcgaggctgtgaaacgctttcggagctcgtgttattcatgtcatcaatcggtaatagacgatccttgtacgaagcgtggacatcttttgttcttgattatggctgtcatcgtactctgttgttaactccacaaggacagtcgatggtactttgattc

SEQ ID NO: 76702 - DNA, 386 bp, Zea mays
  Clone ID: LIB3079-023-Q1-K1-A3
accgcgctgagctccaaagaatctagcagctaggagcaggccgtgtatacgccatccaccacggcaacatgtgctccggctcctggtcctggagcagcagcaagaagcgcccgtctcttgttgtcgtcaacctcaagcggcagcagctgcagaagacgccgccgccgacgccgcctcgtgcctcagttgctatcaggaggaagaggtacccagctaacccgccctgctcgagtttcccaagcttcctctgctcaagtttcagcagcatcagcgacagtttcctgcaatcacacaagtacactgtacacgtacgcaggctgaggctgatgaggttgagagccggagcagaggccatggagatggtgaacctgaagctctacctggag

SEQ ID NO: 76703 - DNA, 223 bp, Zea mays
  Clone ID: LIB3079-023-Q1-K1-A4
atcgacctcgcaagcggggaatgtatccttttttgctgcaacataaaaaatgctaccgaggcatagctgggtaccttttaacttctgtttgtgggatttgctagagtgatggtttcgatatatagggggacttgaatgtctggaatgctacggtataacgcacatttgggtgcaatgtctgttgcattgctgtctgaatgacatcgttggtacatttattttc

SEQ ID NO: 76704 - DNA, 374 bp, Zea mays
  Clone ID: LIB3079-023-Q1-K1-A5
atctcagactcagggagagacgagagaagtggacacctcgcctgcctggactcgtgtactctagtatacagaaaaaagcagaagagatacggggatgtctaagacggcgggcgtcggcagactcggaggagccggggcggcggacgcggcgcagcagcagcagctggcggcgggtgatgctgcggtggcgcgggcggcacggcccatcgagacgctgctgggcgcggcgccgctggtgctgtgcgtggccgtcatgacccttatgctacgtgaccagcagagcaatgagtacggcaccgtaggctactccgacctggggggcttcaaatacctcgtctacgccaacggactgtgcgccgactactcgctggcgt

SEQ ID NO: 76705 - DNA, 380 bp, Zea mays
  Clone ID: LIB3079-023-Q1-K1-A6
gtcgggcttcagcgtggccatgcccaaggtgcccgcgttcgtggccgacatgcggcgggtgcgcgacctcaacccgagcgccttctgcgggatggactccaagatgggcgtgctgatgcgctacgtgcgggcggcgtcggcggacctgggcaaggaggaggactcgctcgactgtcgacgtcacctactaccggagctacaacgaaggcacaccccgcatgcacgccgacgtattcgacgagctggagcagatggcgctgcgcaagtacggtgcgctcccgcactggggcaagaaccgcaacttcgccttcgacggcgtcatcgccaggtaccccgcgtcagcgcggattctgtacgagaacgacaggtacgacccggac

SEQ ID NO: 76706 - DNA, 356 bp, Zea mays
  Clone ID: LIB3079-023-Q1-K1-A7
gcgatgctgcaggcaaaaggttaggtatggacaagcaacttgtgcaactatgggggcgtcatccagcaatcccagtaacggatgctgagcgtgagtcaacaacgcacgacctttggaggattaaaactgaagccgaaacacctgcagatgacactgtcggcagcgctgtatatatactcagaggatatcaacactacaaagatcccatcttacccgacatgatgcagagtaccaagcttcctgtgctcaagtacatgtagcatcaatcacagttgcctgcaattacacaagttcactgtacacgtacacatgcagaggcattacaagttgagagccggagcacaggccatctagat

SEQ ID NO: 76707 - DNA, 425 bp, Zea mays
  unsure at all n locations
  Clone ID: LIB3079-023-Q1-K1-A8
cccacgcgtccggtctgctctagggtttttgccaagccgccgtcgccgtcgctctgccctcgtatcccctcccacgacaccgagacaccaagatgacggcgcagaccgcggaggagctcgccacccagatcgagcagcagaagctcgaggagcagaagaccgaggcagaggaagttgtggtggaggatgaggaggaggaagatgaggacgatgacgatgatgacaaggatgatgatgaactcgatggggatgccagtggcaagtcaaagcaaagcaggagtgagaagaagagccgcaaggccatgctgaagcttggcatgaagcccatcactggtgtcagccgcgtcactgtaaagaaaagcaagaatatactctntgtcatctccaaaccagatgtgttcaagagcccgaattccgacacgtat

SEQ ID NO: 76708 - DNA, 410 bp, Zea mays
  unsure at all n locations
  Clone ID: LIB3079-023-Q1-K1-A9
gagctctataatcgcaaatatcttcgcagtggtgacacccccatcccggggcacgaaaccctaactgaacccatggcgctctccgccgctcgccggctctccaccaccgcgtcctcctcctccgtcgccgacgcgccgccaaagctctcttcgctgttccagaacccgaagcctcgaccgctgcctgtccgcggcgtcgaggagccgcggcggggggccaggcccaggccgaggcagccctgggaggaggaggcgggggcgctgctgctgcggctccacaaggggaggtacctnccgggccccgacctctcgtcggcgccgcacgctgtctcacccgacgccgtcaagaccgccgccgagtggttcgggcatgaccaccagcccgtcgccaaatggctgtcagggagtga

SEQ ID NO: 76709 - DNA, 331 bp, Zea mays
  Clone ID: LIB3079-023-Q1-K1-B1
ttcatgtttagggcaaaaggttcgggattgacaagccacttatacaactatgggcgggtcaatcactaatcccagttacttatgctggagcagtgtcaacaatcgatgacctatagaggataaaaaacgcaagcaaaagtcgattctatataactcttcggagtactctacatatatctgaaggacatttaccctacaaagatactgaccttaggcacaataagcaaagtattgatgcccaattgtcaaagaacatatggtaacgatcaatattgtcataatttattgcaaataccttgctcaaagcatatttattttcattaccaagtat

SEQ ID NO: 76710 - DNA, 204 bp, Zea mays
  Clone ID: LIB3079-023-Q1-K1-B10
cggacgcgtgggcggacgcgtggagaaaaaaaaaaaaaaaaaaaataaaaaaaaggaggggaatataaaaaaacaaataaaaaaaaacacatacaatctaagaaataaaacatactatagcagaacctggattcaaacaattccatctaacataatacacaataacaagttatacattcttgacgttaatgctgtttattttct

SEQ ID NO: 76711 - DNA, 425 bp, Zea mays
  Clone ID: LIB3079-023-Q1-K1-B11
atttgctcttaacgaggcacagaaatcccttctgtcggatcacaaatccctagaaactaaactgaggcacgccgagaacagggcgatgatgctggaggagatggtggataaactagagtcgcaatgcaaggcgctgtctgagacttcagaagttctgaagctgcaggccggagctagcagggcctctttgttctgctcgatccagtttgtgctgctgtgcatagccattgggaccctcctcgttcgcttcctgtcctcttctccggagattgtacctacttgaggttagagaattatgccagtcagcctttatgtaggcgttgttgaacggttgtttactgtaacttattagggcatcaatcgccttacagattttcgttttttgtaccatcaactcgattttgctagtaatttctttatgaata

SEQ ID NO: 76712 - DNA, 428 bp, Zea mays
  Clone ID: LIB3079-023-Q1-K1-B12
acaaaggtaaaggagaatcagctgaagcagttcttcccagcaaggacgatctgaggaagaccattactgaaatcctcaagaaagttgacttcaacacggcaactttcagtgacattctgaagaagctcgacaatcactacaaaatggatctgaccccaaagaaagaagccatcaaagttatgatccaagacgagttgaccaagctatcagaggaggatgaagaaggagagggagacgaagacgccgggaagaaacagcagcagcctcaggcgcaggagatcgaggcatgagggatccgcggaaccccgtagctgtagtagccactgttaattatcctgtacttagtgcgtatgtgtcgcatgtacaggcatcctttgttgatttcagccaccaacttgagaacctcaccccctgattgtgtatgctaa

SEQ ID NO: 76713 - DNA, 372 bp, Zea mays
  Clone ID: LIB3079-023-Q1-K1-B2
cccacgcgtccggtctgctctagggttcttgccaagccgccgacgccgtcgcggtgccctcgaatcccctgccaggacaccgatacaccaagatgacggcgcagaccgcggacgagctcgccacccagatcgagcagcagaagctcgaggagcataagaccgaggcagaggaagttgtggtggaggatgaggaggaggaagatgaggacgatgacgatgatgacaaggatgatgatgaactcgatggggatgccagtggcaagtcaaagcaaagcatgagtgataagaagagccgcaaggccatgctgaagcttggcatgaagcccatcactggtgtcagacgcgtcactgtgaagactagccagaatatac

SEQ ID NO: 76714 - DNA, 335 bp, Zea mays
  Clone ID: LIB3079-022-Q1-K1-H8
gcggcaggagctctgggcagcgtgcgcacgtggggtacctagctcgctcggctagcgtaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgcggccgccatcgcgctggcgctcat

SEQ ID NO: 76715 - DNA, 431 bp, Zea mays
  Clone ID: LIB3079-027-Q1-K1-D1
cgcaattacacctgttgttgagaagtccataacctctgttgcttctgattcagttcagaaaggcgtgggtgacaaggtgtgcaatcagctggagaagtctattactggaaaacttgaagctacgcttgccaagcaaatccaaatgcagttccatacatctggaagacaggctcttcaagatgctttgcgtactagctttgaatcattgcttgttccagcatttgagcaagcatgcaagacaatgtttgagcaagtagatggtgcatttcaaaagggaatgtctgagcactccaatgctattcagcagcaagttgaggctgcacatactccgttagcgctaactctaaaagaaaccatcaattctgcttcatcaatcacccagagtttttcatcggagttacttgatggcaatcgcaagctattggcacttg

SEQ ID NO: 76716 - DNA, 318 bp, Zea mays
  Clone ID: LIB3079-027-Q1-K1-D2
cacacatgtttcaaactatgtcagcatagcagagcaaaccccggactctctggatggtatcattgttgcaaagctgaaagcagctgcaggcttggccaacatggaaacaaagaaatacaaacttgctgcacgcaaggttagtcattaattcactacacctttaaagcacgggtttcttcatgcgtctcctccacctgaaatagcgagtggtttctaccactacaacgtgtctttttatgttgtattaagaagagatattgtgtatgtgtgtgtatatatacacactaataattggaaaacaaaaaatcgtgtttgaat

SEQ ID NO: 76717 - DNA, 423 bp, Zea mays
  Clone ID: LIB3079-027-Q1-K1-D3
tcccgctcggctcggcgaacgcgatctgttccccaacctccgcagccgctccaccgggctgcactccggctgccgaatcgacccgccccgatccagatcaggagctgagggatggacgcgaacaggcgccagagtgggatccagcagttgctggctgcggagcatgaggctcagcaaattgtgaatgccgctagagctgccaagtcagcgaggctcaggcaagcaaaagaggaggctgagcgggaaatagccgaataccgtgcccagatggaggctgagtttcagaggaaggttgcagagagcagcggcgactccggtgcaaacgtcaagcgtctcgaggaagaaacggcggcgaagatcgagcaactcacccagcatgccgcaagcatcttcccggatgtcattcagatgcttctgcggcat

SEQ ID NO: 76718 - DNA, 271 bp, Zea mays
  Clone ID: LIB3079-027-Q1-K1-D4
tcgcccacgcgtccggcctgtgaagaatctgacatggcctagcggcatccaacaaggctggcggccagaagcagctttgcctaactggagaagctggcatgatgagcgtataactgctgttcgatgcagtcaattgtgcacaccagcatcattggctgctgattgcaaaatttgcaatgcccgtatggtcattgatggaaggggacgattgggactgttgggcttttatgggtgggccctgtgggaatttagacatgtcgaattaacgcga

SEQ ID NO: 76719 - DNA, 422 bp, Zea mays
  Clone ID: LIB3079-027-Q1-K1-D5
ctcatgtacaatgtattaggaacgcataattggctgaactgagagctaactttgagaagaagctgtcagacgcaatttctgggcctgtacaatccatactggaaactggcgagagagactcctgggcatgcattaggagactatataggcgtgagattgaaaatgctgctctttcattctcagcttccctttctgagtttgacctagaccaaacaatttccaataagatggtctcagatttgagggaatatgcaagaagtgtagtagaaactaaagctagagaagaagctggaaatgttctgatgcgcatgaaagaaaggtttttcactgtgttgagccatgataaggactcgatgccaaggtcatggatgctagatgaggatatccgtacaatcactagagaagcacgcttaggggcttta

SEQ ID NO: 76720 - DNA, 234 bp, Zea mays
  Clone ID: LIB3079-027-Q1-K1-D6
caaaaactacatttttctcaaccttcaaagtcgatccaaagagggccatttcgagtcaagcttggacccctaaagatccagcaactgacctgaaatataggcacctaacatgctccgaagcaggatccaccaggtgatgaattggaagctttatgctcagcaaattgtgaatgccactagagctatcaagtcaacgaggctcaggcaagcgaaagaggaggcttatctagaaat

SEQ ID NO: 76721 - DNA, 387 bp, Zea mays
  Clone ID: LIB3079-027-Q1-K1-D7
cccacgcgtccgctagttctagatccggccgcactttttttttttctttttttttgggagattgcatgcatggtgagctgcaatatatagatcatgaaacccttttcaccacctacctaacaagcatatatatatgccatgtatacacatgacctaatgcatgcattctagcagagaaaccctaatcaacaaagatcatgggggtgatgcatggacatggatggattgatcgatcactgcaccggaggtcgatgtccatctaaatatgtaaagtagagtagctatccggccgacgatgcgcacgcttcgcggtgaaacatcgtttttttttccttctccggtgggcggagggtccaaagattcgccgattcggatggacgagctggt

SEQ ID NO: 76722 - DNA, 237 bp, Zea mays
  Clone ID: LIB3079-027-Q1-K1-E1
ctccctacccgttgtctgacggctggcttctctcatagcccacgagctctgtgtgcgacgggggactactcgggcgaccagggggtcgtctcctgccggggcttggtggtcgagggagactgtggccgatgtgaccgtctcgaaccgtggcataggccacgcgctcgccgcccgcctggccgagcacggtctcaccgtggtgctcaccgtgctgcactgcgagcgcatggaggccat

SEQ ID NO: 76723 - DNA, 435 bp, Zea mays
  unsure at all n locations
  Clone ID: LIB3079-027-Q1-K1-E2
cccacgcgtccgcccacgcgtccgcccacgcgtccgaccaccgtcactcaacacagcgcaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcaacacccgggtcaaggacgaggaaggcatgccggcgttcgcgctcgtcaacaaggccacggggctcgcaatcaagcactcccttggccagtcccacccggtcaagctcgcgcctttcagcccggaccaggaggacgcgtcngtgctgtggacggagagca

SEQ ID NO: 76724 - DNA, 432 bp, Zea mays
  Clone ID: LIB3079-027-Q1-K1-E3
ccaacccaacccaacccaacccaccactgtctccctccccgttccccagtccccacggcggccggctgctcctgctcctgtggcccgcgccatcctcgaggcatcaccggcgccgcaacttcgttgaggaggaagcccgcacccgcccccgatccgatggccaacagcaaccttccgcggcggatcatcaaggagacgcagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgacgaatatcccatggctgccccaaaggttaggtttctgaccaagatttatcatcccaacattgacaagcttggtacgatatgcctcgacatt

SEQ ID NO: 76725 - DNA, 262 bp, Zea mays
  Clone ID: LIB3079-027-Q1-K1-E4
aaaaaacaaacaaacaaaaaaatagattaaaaaaaaaaaaaaaaaaaagacaaggagggctttaaaatccaagtacgagagcacagactagccaactattagatgattatttagcgctacctaacttcatttcaccggcctgtgaatcacaacttcatgcactggtaaaacattctcgacactgatctctatcggttcacatactatattcatgtcgatagtttgcgatctaacgacaaggcccgcaatattcatccttcct

SEQ ID NO: 76726 - DNA, 416 bp, Zea mays
  Clone ID: LIB3079-027-Q1-K1-E5
cccacgcgtccgcttctacgaccacgtcgccacgcccaccgccggcgtgcccagccgcgacggcatccggggcccgccggccttcttcttcaagttcgaccgcctcggcgtcagggtgcccaccatcatggtctcgccgtggatcaagaagggcaccgtcgtcggccgcgccctcgggcccacggacacctccgagttcgaacactcctacattccggccaccatcaagaagatcttcaacctctcgtccgatttcctcaccaagagagacgcgtgggccggtaccttcgaccacatcttcaccgagctcgaccaaccaagaacagattgcccagagacattaccggaggtgccatttgagagaccaactccacccaaagaacacggctggctctcagatttccagcgggagctcg

SEQ ID NO: 76727 - DNA, 329 bp, Zea mays
  Clone ID: LIB3079-027-Q1-K1-E6
gcgatggcgtccacgttcgtcggcaactccacctcgatccaggagatgttccggcgcgtcagcgagcagttcacggccatgttccggcgcaaggccttcctgcactggtacaccggggagggcatggacgagatggagttcaccgaggccgagagcaacatgaacgacctggtggccgagtaccagcagtaccaggacgcgacggctgaagaggaggaggagtacaaggagggagatgaggtggctgcctgatccaccggcacattgtggggttgtgcacattgtggggttgtgttattattgttgctcttcatctggtgtttaaaaat

SEQ ID NO: 76728 - DNA, 413 bp, Zea mays
  Clone ID: LIB3079-027-Q1-K1-E7
caaatgctaccggaccccctcctgacatgcaacttctgctcccatttgtggagtcggctttgccagtggcttacggtgtcttgtctatccaactatttcatgaaattgggcactttttggcagcatttccaaaaaatgttaaactgggaattcctttctttattccgaacttcacccttggaacttttggtgcaattactcagttcaagtccattcttccggatcgaaagacaatgtttgacatatcaatggctggtcctgtggctggagctgcactttccttttcaatgttctttgttggcttattactctcttcaaatcctgttggggcaagtgatttagtggaagtacctagtcagctgttccagggttcattgttgcttggacttattagtagagcaacgcttggatac

SEQ ID NO: 76729 - DNA, 169 bp, Zea mays
  Clone ID: LIB3079-027-Q1-K1-E8
cggacgcgtgggctatgccctcttgctgcttctcacctaggcgacggggacgccttggatccttcgggcgcctggacgcctaggcgacgcctttaaaacaagggtcttctctgtattaaatattttctgatgtacagtagctaccttggtaattcatgccttcaacatg

SEQ ID NO: 76730 - DNA, 398 bp, Zea mays
  unsure at all n locations
  Clone ID: LIB3079-027-Q1-K1-F1
gcgatcccactcccgatcagcagctgatcgctcactcttgcagctcgatcattcttgagctgctctagctctagccctagctagtagctagccactcggtcgtgtagtcatcagccttctgatcgtcacccatggccactgccgaggtccagaccccgaccgtcgtggcgaccgaggaagcgccggcggtggagaccccggctccgcccgccgtcgtgcccgaggaggctgcccccgccgccgaggccaaggtggaggagccagctgccccggcggagaccgagccagctgccgncgctgagcccgaggcggcccccgtggaggcggaggaagagacgccaaaggaggcggagccggagccggcggcggctggagaggtgaaggaggaagcggcagcg

SEQ ID NO: 76731 - DNA, 412 bp, Zea mays
  Clone ID: LIB3079-027-Q1-K1-F3
gcccgccgccgccgaggaagacgaagcggattcggaggagaccgagcgccgcaaccgcgggctcaagtccggccttcacccgcttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcatccgtcccctctgggaggatcctgcaaaccagaatggtggcaagtggataattagattcaaaaaggcagtttcaggtcgattttgggaggatttggtgctagtggtagtaggcgaccaacttgagtatagcgatgatgtctgt

SEQ ID NO: 76732 - DNA, 426 bp, Zea mays
  Clone ID: LIB3079-027-Q1-K1-C7
gtttgcggcagctcttctcgttatacccaagactttggctgagaactctggtttaggtactcaagatgtgattgttgctctccagaatgagcatgaccgtggattacttgcggggttgaaccatcactctggggatccgattgatccccagttggaaggcatcttccacaactactctgtgaagcgccagatcatcaattctggacccatcattgcatcccagttgctgcttgtggatgaagtgatcagggcatgccgcaacatgaggaaaccgacttagatttttgtcgccacctagccgagacttattcgttctaccttttgttttggttctgtgcctagtagtgatctggatgatacgtctgacttgagttggtcccatttcacgaagcacgtcgcattcgctttttttttgtgggattactg

SEQ ID NO: 76733 - DNA, 107 bp, Zea mays
  Clone ID: LIB3079-027-Q1-K1-F4
tctcactcgtgcgataaaaaaaaattattaaaaaaaaaaaaaaaaaaaataaaaaaaggattaattaaaaaaaaaaaaaggcaaatttataataaaaaaaatacaat

SEQ ID NO: 76734 - DNA, 422 bp, Zea mays
  Clone ID: LIB3079-027-Q1-K1-A5
cgttcccctattacctagttagtccagtccgcctgctgcctgcctcaacggatcgacgctacaggagggatggaggaaggagacggtcgatcagagtctgagaccgaggcctatccaccaccgcagcgacgagcgggaggagatgaagatcatcattgacacggatcccggcatcgatgacagcgtggccatcctgatggcattccatatgccgggcgtccaggtcctatggctcaccaccatcttctgaaactgcaccacagagcatgccacacgcaacgccttgatcctgtgcgagaaggcaagccatctagaggtcccagtagctgacggcagccatgagcctctcaaaggaggaaagccgcacgttgctgacttcgttcatggacctgatggcctcgggaacgtagatcttactgatc

SEQ ID NO: 76735 - DNA, 434 bp, Zea mays
  Clone ID: LIB3079-027-Q1-K1-A6
aaactggtgatgttcccatgtccagtacacctgctgctgcttgtttgccctctgttgatgtgcctatgcatgaagtcgttactactcatacaccgtcacctattacgcctgtcttgcctacaactatacacttttcagccccagtatctgctcctgcaattgcccctgagcttgcatcaggggctgttggtgtgcctccacctgttagtgctgtggtacctgagctgtcagaactggatgttcacaatgaggagaagttgctgagggagctggaggaaatgggttttaggcaggtcgatctcaacaaggaaatcctcaggcagaacaattacaatctggagcagtctgtcgatgacctatgtggcgtcaatgaatgggatcctctccttgcagagcttggagagatgggatttgatgacacagagatgaacaag

SEQ ID NO: 76736 - DNA, 388 bp, Zea mays
  Clone ID: LIB3079-027-Q1-K1-A7
atcggtctctatgaccctaccactctttggccctcccacgcctttccactcatggcggagccctagccaccgggcctgccctcgtccgactgcgcagacgtgctcgtgggatcctccggcccctccttcccctacatccgcggctggtcattcaccttctactcgggcgctgctatgggttctgtttaggaacatcttcaacccaaggtgtgcgtgcatactagcacctccgttgctgcttgagcagatcctgccctggctcttctatcacaaggtcgtcggcgtctcgcagttcctgctcttcgtggagggcaaggcggctaaacccaatgtcgcgggagtcctcgagtcaattcctggggttaaagtggtgttccgaactaatgat

SEQ ID NO: 76737 - DNA, 434 bp, Zea mays
  Clone ID: LIB3079-027-Q1-K1-A8
cttccctactgctgctagcaaagacctttattactagtgtcaattaagttacgaaagaagaagaaagaaagaaaatttcgaggccgagaaaaaagacggctttgatctctgctagtgtggtgtggtagtgtgtgcttctagtaagtaagcgagccagggatcaagaagcagagagctgctctgtctcttttgtctcttgcaagaatggcttcctccagcgggagcgggagctcgggctccctctcggcggcaacggcggccctggccgccgcggcgggcacggaggaggagctgcgcgcgctcatggagcagcgccgcgcgaagcggatgctgtccaaccgcgagtccgcgcggcggtcgcggatgcgcaagcagcgccacctcgacgagctgaccgcgcaggcggcgcacctgcgccgcgagaacgcgcacgt

SEQ ID NO: 76738 - DNA, 430 bp, Zea mays
  Clone ID: LIB3079-027-Q1-K1-B2
cttgaataccagctcatcaggccgggatgcatacagtgcggctagctctgccgaccacaagcatcaggtcgtcggttccggtgggcaggttgagggcgatgagagcacgtccttgttgtatactgacagaagtaatcagcagttgagcagtaagttaacagaccaatataggcagttagatgggagcggacatgaccctggagaaaccaggggcggtgtcttattgagaagaccatctatggacaggaccgctcaaacattttattgatgtgcaaggtttgggctgtagagaaataatgtaatgtagcctgtaatattatctcgctgcattgtgtaaaaagagaagagagatgtcgtagtccatacaagttgaatccacaacttggtgatataatcccgaggaacctgtaacaaatgtcacgtattccac

SEQ ID NO: 76739 - DNA, 420 bp, Zea mays
  Clone ID: LIB3079-027-Q1-K1-B4
gaaaacccaattcttcaaccctacaggatccaacaggcaatcgcagctggcatcttgcctttatcaccctagctcctgcaacaatcatcagccctattacaacagttacctcaggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccacagcaatttcttccattcaaccaactagcagcattgaactctgctgcttatttacagcagcaacaactactaccattcagccagctagcttgtgtgagccctgctaccttcttgacacaaccacag

SEQ ID NO: 76740 - DNA, 425 bp, Zea mays
  Clone ID: LIB3079-027-Q1-K1-B5
gacagctccttgctaggatcttcgtcataaatcctgcaaagagaataacaatgagggagattaggaatcacccgtggttcctgaagaatttgcccagagagcttacagaagctgcgcaagcgaagtactacaagaaggacaacggtgcccccaccttctatgatcaaacagtcgaagagatcatgaagatcgtagaggaggcccgcacgccgtcccagtcgcctgctccagtggctggttttggttgggcagaagaagaagagcaggaagatgggaagaaacctgaagatgactagcatgatggggaggatgagcaatacgactgcgaggacgagtatgacacacaggtgaagcaagtacatgccaacggtgactttcgacacctaataaaatgaagcttctagcaagaccgagttcttaactga

SEQ ID NO: 76741 - DNA, 373 bp, Zea mays
  Clone ID: LIB3079-027-Q1-K1-B7
ccgcaagatcgacatggacgagagccggtccctgtcccgcgccgagctccacgccctcatcgtcggcatcaacttcgaggaggtcgacttcgacaggacggacgcggtggacaaggtcatggacgacttcgacacgtcccgcaacgacgtcgtcgaggaggaggagttcgtgcaggggatgaggaagtggctggacgaggccaggcgcagcgtgcccgtgggcggcgccttctccagcaagttcatccacgagtaccacgagaggacgaggcaggagcacgacgagctggtcgacaggtccgacgaggcggtggagagcgtggagaaccccgggtggtgcatagccaaggccgtggcgctgctgctgctgggc

SEQ ID NO: 76742 - DNA, 341 bp, Zea mays
  Clone ID: LIB3079-027-Q1-K1-B8
aatctgatgaagaggatgaggaacaaatggagataagggatagaacagagacaaatggtgtgaatcttagaagaacagtatatttgactattatgtctagtgttgattttgaagaagctggacacaagcttatgaaaattaagcttgagcctggtcaagagatggagctgtgcattatgcttcttgagtgttgcagtcaggagagaacatatcttcgttattatgggctgctaggacagcgtttttgcatgatcaataaagtgtaccaagagaacttcgaaaaatgctttgtgcaacaatattcgatgattcatcgtcttggaacaaacaagttgaggaat

SEQ ID NO: 76743 - DNA, 426 bp, Zea mays
  Clone ID: LIB3079-027-Q1-K1-C2
agaaattcctaattgttattgcaggtctctggcttctttcagttctcgggagctggtgcaacttcctgacactgttctatattgtctttgtggcactgtacactgtaccagttctgtatgagaaatatgaggacaaggttgatgcttttggtgagaaggctatgactgaactgaagaagtattatgccattttcgatgagaagtgcctatcgaagattccaaagggcccccttaaggataagaagcactagattggtagtaaggtatttgctatgaatcaacatctacattatgtcactagctgtcacctctttctctgaaggatggtgcttggtcctggtctctagttgatagtatataatctgtatgggcaactttggtgtgactgacagtctgctgaaaactgttgatcttgtttttggtttc

SEQ ID NO: 76744 - DNA, 417 bp, Zea mays
  unsure at all n locations
  Clone ID: LIB3079-027-Q1-K1-C3
ctagggaaagacatggctgcacatttcagactgcagcacacgcatcttctcaagaggaggaagccctacaggccaagctcatgccctgcggctgccaccagcccagcaacataccaagtgaactcttactatgaagaggcagaaccacagcagcactacagcaggccatacaaagatcctgcacctgacccattgctctcccagttcatctgcagcgtcgatgcgatccctggtgatgacaacgcccagaaagatgatcagaggctgaagttgaacaacaagggagcgacagcgagcgacgacgatgcatcatccaaactggggctggaggagaggctgcagaggatcgactntctgacggagatactcatgtccaccattctttgatgtcttgttaccgctatctagggtttcttg

SEQ ID NO: 76745 - DNA, 434 bp, Zea mays
  Clone ID: LIB3079-027-Q1-K1-C4
gggactgtgcggcgctgctcgcggtgctgtcgagcgaccgcttcgacgtgtcggtcgcgtagctgatcgccgggcaccggcttgcgggcgcacagcctgcgggcaaccccgggcaggcgccggacgccgtgcccgatcctcactcacgggctccgagggccgcgtgaagcggcgcgctgtgcctacagcgggatcttgccggtacagatgtccttgaacatcacccagtcgcccatcaagctgtagatcggatgccgggacgtggcggggcggttcttcttgaagaagaagtgcccgacccacgcgaacccgtagccgcagactacaggcgctggcagccacagtcagttggcccttgcgatcggcatcggtactcagtctatcacgcctagcgagcctaccaaatgcatacgccgcgacgtcaggttctggtg

SEQ ID NO: 76746 - DNA, 354 bp, Zea mays
  unsure at all n locations
  Clone ID: LIB3079-027-Q1-K1-C5
cacacactcgagaactccatttcgatctcatttgaaatcaacccatcctcgtttgctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaagangttgctgtgtttggctgcaggaaccttgaggagatcccatggggttcgg

SEQ ID NO: 76747 - DNA, 401 bp, Zea mays
  Clone ID: LIB3079-027-Q1-K1-C6
gctgaatcaagagtttttgcaagacccactcaatcttttgcacatactcctgattatagggttctcagttatccatcttaacctgccatgccttttaccccagcgttctttgccccagggggcagtccatacttggtggatgcaaaaggtgcaccagtcataccaccgctgtcaggtctaagcctcggcatttctcatccatctttcaacaccagagcaacacagacctcatctaatgaactgagttacttgcatcctagcgtggatttcagttatggagtgtcatctgaaggcgcacgtatggaagcatggagctactggcccatgtcctaccagggtcagacaatgtttgtggatgaacgcatgacgaatgcatcacaggatggtacttctgggttggt

SEQ ID NO: 76748 - DNA, 427 bp, Zea mays
  Clone ID: LIB3079-027-Q1-K1-A4
agactattgtagctcatatcatctgtctcccatggcgaagtgcagcagcttccgaggattattctggttgctttccatgattcttctagcatcctttgttgctcatgcacgcacaacaagtgggcacaccaaagaggacagcaatgctaggaacatgacgatgaccaagacgagggcatcggtcaacatacttgttagccgtaatgacgacgggccatgctatctagattccggtcttaatgagtacgtctgcagaaagactaataagtgctataagagcttggtgctctgcgtggcgagttgtcaaccatcatcatgaattcatgatactgcggagacatcatgatactgcggagacagacggcgagagatgaggctagctagatgctgtttcaccaaaatattatgtaacacccaaatcttccat

SEQ ID NO: 76749 - DNA, 443 bp, Zea mays
  unsure at all n locations
  Clone ID: LIB3079-026-Q1-K1-G7
cttgttgttatttgtttgttaatcctatagctattgcatattgtgtgcctgatcaggggcacagaaacctgtaggcgacgaatcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccttccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacggcgagatcgagagcctncacgtctgcgacaacctcgcggaccacatgatcggga

SEQ ID NO: 76750 - DNA, 161 bp, Zea mays
  Clone ID: LIB3079-026-Q1-K1-G8
tcccggctctgccacgcgtcctaaaaaacaaacaacacaaaaaaacgaattaacaaaaaaactaaaaaaaaaaaaggcaggagaaataaaacatggaaaaactaccaaaatataacgaccaatctcaaatctactacccactctttctatcctcttccatc

SEQ ID NO: 76751 - DNA, 422 bp, Zea mays
  unsure at all n locations
  Clone ID: LIB3079-026-Q1-K1-G9
agagaggaccaaggcaggcagccgtcagcgagccaggcagccatgggcaaggactgcggcaaccacggggacgatgacttccggcagtcatgccggcgcctgctggccatcctgctgaccatggcgctgctggtgggcgtcgtggcgctgatcgtgtacctggtgctccgccccacgcacccgcgcttctacctgcaggacgcggcgctgcggcagctggacctgagcaacggctcggccccgctgctgtccacggcggcgcaggtcaccgtggcgtcccgcaaccccaacggccgcgtcggcgtctactacgaccgcctcgacgtctacgccacgtacaagtaccagcaagtgacgctggcgtncaggctgcccgcggtgtaccaaggccacggcgacgtccacgtctggtcgcccgtgct

SEQ ID NO: 76752 - DNA, 418 bp, Zea mays
  Clone ID: LIB3079-026-Q1-K1-H1
ccggaaggagatgttcacggtggagatcaaggaactccagaggaagagggagggcctggtgcgggagatgggcgatgccaacgcaagcaggcatgttgagcagtcactcgcggaggtggcagctcagatcgagtctgtgacggagaagatcataatggaggaggagaaggtgaagaagtggaaagcggagaacctgaggaggaagcataactacgtgcccttcctattcaatttcctcaagattctcgaggagaagcagcagctgaagcccctgatagagaaggcgaaggcgaagcagaagtcccacggccccagctaggtgaaaagccgcaatgcacctacgtactgtctcttttagttggggttccttgtaagattggagttcgcgtatatgctttctggttttagtttaagacaa

SEQ ID NO: 76753 - DNA, 335 bp, Zea mays
  Clone ID: LIB3079-026-Q1-K1-H10
ccaagatcatcctcgatcgggagacgcagaggtcccgcggcttcagcttcgggacctgctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcagtggcagctacggcggtggcggcagctacggtggcagcggctgctacggtggtggtggcagcggctacggcggtggcaaccgtggcggcggctactgcaac

SEQ ID NO: 76754 - DNA, 415 bp, Zea mays
  Clone ID: LIB3079-026-Q1-K1-H11
gttcggtatctgttggtgaagtaggttctcatggtaagaggatcaatgatattgcaggggacaacatgagagcacataacatattgtatgaagctgttggtgaaaatatttcaggtccttcattccatttgaatgaatattctagtggaaccatacaagctactggcaagccaaacgattgtcgacgtattgattcagctgtgcggaatttgttgctcaaaggattaggtcagccgtttagtgaggaagatattattggtatctatagaacaccactgctagatcagcgagggcaagttcgttgtggtctcttccagaaggagatcgaagagaccatgagtcgttcggggaatgcatatgtacgttatgcttggcttccttgctcaagatataccatggagcagatggcaatgcg

SEQ ID NO: 76755 - DNA, 402 bp, Zea mays
  Clone ID: LIB3079-026-Q1-K1-H12
ggccactgagcagcaaattcttgtgactggaatcaaggtcgtggatcttcttgcacggtaccaaaggggtggaaagattggtctcttcggtggtgcaggagtgggtaaaactgtgctcattatggagttgatcaacaatgttgctaaggcccatggtggtttctctgtgtttgctggtgttggagaacgtacccgtgaaggtaatgatctgtacagggaaatgattgaaagtggtgtcattaagctagatgacaagcagagcgaaagcaagtgtgctcttgtttacgggcagatgaatgagcccccgggtgctcgtgctcgtgttgggttgactggtttgactgttgctgaacatttccgtgatgctgaaagacaagatgtgcttctggttatggacaacat

SEQ ID NO: 76756 - DNA, 350 bp, Zea mays
  Clone ID: LIB3079-026-Q1-K1-H2
gatcgatctagcagacgttgtaatgagccaacaaacaaaccggtcgtaacggcgttcgggatgagtacaaagcgtgtgcggtcatggtggttacgcaatgcatctacgccgctctagcgctcttgtccaatgcggcgtttaccggcggtatgagccctctggtgttcgacgtctacaggcaggccgttggcaccattgtacttgtccccgtcgtcatcgctgtcaacatgaagaagattaatgagatgacgacaggccttggactgaccggcttgtcgctggtcttactcgtcttccttgtcggggcaactgtgaaccagtgcatgtactaccaaggggtgaatctgggc

SEQ ID NO: 76757 - DNA, 426 bp, Zea mays
  Clone ID: LIB3079-026-Q1-K1-H3
cccacgcgtccgccccctccccctgcccctctctctcgtggagacgactgggccgccggcgttgctgccctacgcggctacgcccaggtcttcttcgggcccttagccgcgacgagcgccaccagggagtagaagaggttaaccttctggttggaaacgatgtacttcgaaggctatggcttccgtggaagtactttcgagcagacatatcgctgctatcctgcgtctttcatcgacaagccacaacttgaggccggtgacaaaattataatgccaccatcagctcttgatcgtcttgcatctctgcatattgaataccctatgctatttgaagtccacaatgcagcagcagaacggacttcgcattgtggtgttctggagttcattgcaaaagaaggcatgatctacatgccatattggatgatg

SEQ ID NO: 76758 - DNA, 350 bp, Zea mays
  Clone ID: LIB3079-026-Q1-K1-H4
acgctggagcaaacggagcatgctgctcttagtacatttcgtcgagacgactgtatcttcgtaggggctttcctaccaggctacgtccaaggctggtgcacctcctatccctactcaagctgctgcaactggttgcctacggatatccaaccttcgtacacaacttcctattagcgatcaggttctaatggcagtactcatgctgcaacttgttcaggctaacgtacttcagtcatcgacatgccactgagcgacgtcgaaggctacactataatgacgaccactgagcctggccagttgcaccactggaactgaacacgctaggccaagaacggcatacattgcaactg

SEQ ID NO: 76759 - DNA, 106 bp, Zea mays
  Clone ID: LIB3079-026-Q1-K1-H5
tcgaaaaaaaaaaaaaaaaataaaaaaaggaaataaaaaaaaaaactaaaaaaaaagggaaggaaaaaaaaaaacaaaaacgtaaatcgcatgcggcacgttctta

SEQ ID NO: 76760 - DNA, 418 bp, Zea mays
  Clone ID: LIB3079-026-Q1-K1-H7
gattcgtcaaaaatatgttataaatgcataaaggctggacatctttctcgcgattgcgcagaaagcacatctgaggtggaccgaaatgatggcagtattagtagaagcagagacgatacgggtaccaatactgctcctgctggtggcaacagtcctatggacgaagacgatgttcaagaaattggtgatgaagagaaagaaaagttgattgacttggactacttaactggaaacccactaccaaatgatattttgctatatgctgtacctgtgtgtgccccttacaacgcattgcagacatacaaatatcgtgtaaagattaccccaggcactgcaaagaaagggaaagctgcaaaaaccgcgatgagcttgttcctgcacacacctgatgctaccaaccgtgagaaagagctcatga

SEQ ID NO: 76761 - DNA, 410 bp, Zea mays
  Clone ID: LIB3079-026-Q1-K1-H8
aaaatttctgaatcagaaattaaacaattgatggaggcggatgatgttgatggaaagggttccattgattatgcggagtttatatcagccacaatgcatttgaatagattggagaaggaagaccacatactcaaagcttttgaatatttcgataaggatcacagcggatacataaccgtagatgagttggaagaagctttgaagaagtatgatatgggagatgacataactataaaagaaatcattgctgaagtagatacagatcatgatggaagaattaattaccaggagtttgttgccatgatgaggaacaacagccctgagattgttccaaatcggaggcgcatgttctaactgtcatggacaatcacattgaatactttcaagaacaatctggccttagacataat

SEQ ID NO: 76762 - DNA, 423 bp, Zea mays
  Clone ID: LIB3079-026-Q1-K1-H9
acggatctcgccaagcccgcaaatctcgatggcaccaacaaaagcatggacatctaggatcttcggaatcggatcatgagtatacaagaacacagtcaggacgaagcctgaacgagacgaaagatgattatgacgaaggtctagatgatcacgaagctgtgcgcagaaaagcttcggcatgatagcagaaaaggggaaccgacttaaagatgaaaaggcaaattagacctcgaagagttactatagagttattagcaaatataaagggcatgggtgtaattgtacatgggttgagtcccttgcctataaatagatgaacagtactcccgtactgttcacgctgacttggcattcgcttttgcatcacgcctgtacctttactttccgtcaaaccgaatgtacacttataatttgttattttga

SEQ ID NO: 76763 - DNA, 364 bp, Zea mays
  Clone ID: LIB3079-027-Q1-K1-A1
cccacgcgtccgggctgtcggaggtgcgacggagcctggcggagggacagctgttggagcggtcgagtccttgctgaggtcggcctgcttccgtaagagagctgagggcagccgtcgtcacagagcttgtggagcgccatcattgcccatccggcggagctggccggatgggacgccggtcttgttctccgtgacccgagtcgattcggggtaggacgatgatggtgcttcctgttgacgtggcgggtctgtgccctaggcagggtgacgtgggggctcctacgaagccgaggttgagtctgtgctctgttgccgaggccgagtccgagccatggggtcgggcgaggcggaagtcgttcggccg

SEQ ID NO: 76764 - DNA, 433 bp, Zea mays
  unsure at all n locations
  Clone ID: LIB3079-027-Q1-K1-A2
atcggcgtcgatgaccctaccactcgctggccctcccacgccttccccggcatggccgagcccaccccaccgtccctgccctcgtacgactgcgcagacgtgctcgtgggatcctccgccccctccttcccctacatccgcggctggtcattcacctccgactcgggcgctgctatgggttctgtagaggaacatctccaacccaaggtgtgcgtgcagacgagcacctacgcggggcttgagcagatcctgccctggctcttctatcacaaggtcgtcggcgtcgcgcagttcctgctcttcgtggagggcaaggcggcgaaacccaatgtcgcgggagtcctcgagtcaattcctggggtaaaagtggtgtacagaactaatgatcttgangagcggcaggcacggagtcgaatctggaatgagacttggc

SEQ ID NO: 76765 - DNA, 408 bp, Zea mays
  Clone ID: LIB3079-027-Q1-K1-A3
caaaagtgtctctttctgcaaaccatctgcagaaactgtgtttatcttttcaactaagcacaccgcttgggcacacatttaaacctcaccaggtgttcttgaaattgaggcatgagagtaaggttgaacacttattcgtggtacctggctctgcaaggcagttcaaaattgttcttgacttcctaggtttggtggagaaattttactacctttctggaagatatgaccttgagcttaccgttggtgatgctgtaatggaaaattcatttctacgacctcttggccatttggagttggacctgccagatgccccagaaaaagccccacgtcctcctgcacaagctgttgacccattctcaaaatttgggccaaaggcagagatatcacatatattccgcgcaccagaga

SEQ ID NO: 76766 - DNA, 386 bp, Zea mays
  Clone ID: LIB3079-026-Q1-K1-G6
cccacgcgtccggcgggtggcggctctggcggaggcgccggtgcaggaggtggcgcgggaggcggctatggcggaggtgccggtgcaggaggcggctatggtggaggagctggtggtggatacggtggaggtgcatgaggtggcgccggaggcggctacggcggaggagctggtggtggtgccggtggtggctactgcggaggcgctggtggaggctacggtggtggtgcaggtgctggctctggcggcggcggtggttatggtgctggtggcggaggtggaggtggcatcggccgcggtgtctgaatcagcgtctcacatgcatgcatggtggtgcaagctgcaagcagaagcaagtgctcgaactcgctcggtattcccttcgc

SEQ ID NO: 76767 - DNA, 90 bp, Zea mays
  Clone ID: LIB3079-031-Q1-K1-H5
aaaaaacaaaaaaaaaaaaaaaaaaaaataaaaaaacaaaaaaaaaaacaaaaaagaacgggtaaaatcaaaagaaaggaaaacaggacc

SEQ ID NO: 76768 - DNA, 431 bp, Zea mays
  Clone ID: LIB3079-031-Q1-K1-H6
atcaaatacaagatcaccgtttctggctgaatatcatatcacagacactgcgcttcgggatcaaccaacgctgggcgcagctcgtcattagctactgattctccattctctggaagccactatctaaaagcactggctaaagaagatcaacctttgctccaggtcgatgaaactacatcttaaatgcactgtctcccataacaccctttatgctcatttcatcagaacgatccactgtcgttcattatacactgaatgcaataaatcactcacgcatcctatgaacatagctctcctaatatcgctgctctatgctgatacctctggtgacatgctactcttactaatgttggcacttctgaacaacgcattctatttcaagcccttaatgaaccagccgatatagatcgacaatcaaattcttaaaacaa

SEQ ID NO: 76769 - DNA, 384 bp, Zea mays
  Clone ID: LIB3079-031-Q1-K1-H7
cccacgcgtccgccctgcgttgcgtcttgggggagagagagaagtgggagacccgcgagaggctgccgtgtagggactagggaccgtagagtaagcgacagcgaaggagggagagggggatggccgggatcgggccgatcaggcaggactgggagccggtggttgtgcggaagaaggcacccaccgtcgctgccaagaaggatgagaaggccgtcaacgccgcgcgccgctccggcgcggagatcgagaccatgaagaagttcaacgctggtatgaacaaggcggcgtccagcggcacatccctcaacaccaagcgcctcgacgacgacacagagaacctcgcccatgagcgagttccaagtgacctgaagaaaaatctcatgc

SEQ ID NO: 76770 - DNA, 435 bp, Zea mays
  Clone ID: LIB3079-031-Q1-K1-H8
tcttcttttaacaacatccgaaactggattcggaacattgaacaacacgccgctgagagtgtcaacaagattttggttggcaacaaggccgatatggacgaaagcaagagggctgtacctactgcaaaaggacaagcacttgctgatgagtacgggatcaagttttttgaaacgagtgcgaagacaaacctgaatgtggagcaagtgtttttctccatcgcacgtgacatcaagcagaggcttgcggagactgattcaaagccagaggacaaggcaatcaaaattaacaagccagaccagggttccgaggcaccagctgcccagcgatctgcttgctgcggctcataagcagatgcacgatggccatagcctttggttatttgacattatttatttcccgcttggctgttataggaaagatttgaagaagccact

SEQ ID NO: 76771 - DNA, 434 bp, Zea mays
  Clone ID: LIB3079-031-Q1-K1-H9
cgtcgcacatatctactatactatactctaggaatcaaggacaccaccggcatggcagcggagatgcttgcattgttcgctctcctagctctttgtgcaagcgccactagtgcgacgcatattccagggcacttgccaccagtcatgccattgggtaccatgaacccatgcatgcagtactgcatgatgcaacaggggcttgccagcttgatggcgtgtccgttcctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacaagcagtaccattcat

SEQ ID NO: 76772 - DNA, 138 bp, Zea mays
  Clone ID: LIB3079-032-Q1-K1-A10
cccacgcgtccgcacactcgtacgcggacgagtagtcagacgcgtagttctccgtcctgttcgggtccaagaatacgcggtggtcgaacctagagaacgtgctgctttggggatctgtgcggtagatagatgactact

SEQ ID NO: 76773 - DNA, 388 bp, Zea mays
  Clone ID: LIB3079-032-Q1-K1-A11
gcggacgcgtgggttgcggctgtatgggcctagtctgggcctctcgtggtcggatctctcgagctgcactgccttctgtcgtacttggctcgcgtcacctcataccggggccgactgtcacgcctgtccatccatggcggtgcagctgctagactgctctgctccttgcggacacctgctggtcggcctgaccgacttctgctgtcgcgaaccactccatggatgctccagcgagcccttgtctcatggcgacgcgccgttgagactcccagccgccccagctcggagtcctggtgtcgcgatcgcttccagccggacggaataaccagcgatgggagaacatactgatcgacacagatgatgctatgaacgaactgagatgacagac

SEQ ID NO: 76774 - DNA, 266 bp, Zea mays
  unsure at all n locations
  Clone ID: LIB3079-032-Q1-K1-A12
cgaacgtgaagaagccgcgtgcgttatcctttgagcagtttgggcgctgagcaagtccagtgagagagggagagcggcgagaggatggctgggatggcatcgctgcagggcgccatggcgtcgctctccatctccgcgctaggcgcggcgacggcgagcagcagcagcttctggngcaaccggctcgccacctactccgcgccgcagcctggggtaagggttatggtcaagatatgcccaattgaaatgagacttaagagatggga

SEQ ID NO: 76775 - DNA, 177 bp, Zea mays
  Clone ID: LIB3079-032-Q1-K1-A2
ctgagaccctcgctacccagccattagcaaattcgcttatgctgtccaagacttatcttacgttatgtctgtacgcttttgttattacaagtactcaagttttgagtctttgagatgtggctatgacaatgtgatgaagaaccctaaaccatcgtattagagtgaaacttgtttcta

SEQ ID NO: 76776 - DNA, 357 bp, Zea mays
  Clone ID: LIB3079-032-Q1-K1-A3
gtggcgatgccgccgagggcagtgccgtcgtcgtctcccttgcctattgcactcgccggcgtggccatagtcgtcgtagcacttgccgtttcctcctgttccgtgaccaccgatgctccaggcctgggagtgggagccagagagatggtggcacgggacgaccccaagtgcgaggagatggtgccctgcaccttcaggcgctgcatgcagtactgcgtcagcatcgggctgcagcccaaggggttctgcaactccaagcccaacatgcaggtctactgctgctgcgtcatcccctagcatcatagctcctcgtcaacacacctaaatctgcagacctgctagagaagatacgatctc

SEQ ID NO: 76777 - DNA, 268 bp, Zea mays
  Clone ID: LIB3079-032-Q1-K1-A4
gccgcagttcgcgcttgtggggctcgccgaggcgttcggcgtcatcggggagatcgagttcgtgtacaccgagctgcccaagagcatggccagcttcagcatgtcgctgctgtacatggccttcggagtgggcaacctggccggcgccctcatcgtgaaggtggtgcacgtggccaagcgggcaaggggtgggaacgggctggctcgtcgacaacttgaacgtcggccgctacgactattactacttgctgctcacgggctacggcgt

SEQ ID NO: 76778 - DNA, 254 bp, Zea mays
  Clone ID: LIB3079-032-Q1-K1-A5
tcgtcggccacctacgtgcgttcggcaaacgtacaaggagatggacgtcggaggcgtcgacctagcccgccggcgtgatcctggagctgtccgggctggtgatccaccacgatccggacatctggggaggcgcgcgagttcaggcctgacaggttctccgagggcgtgtctagggcctgcaatgacccctggggcgttgcttccgttcggttagggcccgtgcatctgcatcggacagaactttgcgctgttgg

SEQ ID NO: 76779 - DNA, 332 bp, Zea mays
  Clone ID: LIB3079-032-Q1-K1-A6
tcggtccttagttccaggcacgacgtcacgcgtacggccgcagttcgcgcttgtggggctcgccgaggctttcggcgtcatcggggagatcgagttctggtacaccgagctgcccaagagcatggccagcttcagcatgtcgctgctgtacatggccttcggagtgggcaacctggccggcgccctcatcgtgaaggtggtgcacgtggcgagcggtcaatgcgtgggaacggtctggctcgtcgacaacttgaacgtcagccgctacgactattactactggctgctcacgggctacggcgtggcgaacttcgtgtacttcgctaggtgct

SEQ ID NO: 76780 - DNA, 343 bp, Zea mays
  Clone ID: LIB3079-032-Q1-K1-A7
tgataataaggctccagcaccgatgccaaaacatgcacgagttggtcacgagtcagagccttttgttgctggcttaactttgttctttaatgttgcaaagataagataatgtaattactggttatgtgatgttgcatatgatatgagaatatgaggattggtgataaaaaaaatagtgccctgaaccttcaggcgctgcatacagtactgcgtcagcatccggctgcagcccaaggggttcttgaactccaagcccaacatgcaggtctactgctgctgcgtaatcccctagcatcataacttctcgtcaacacacctaaatctgcagtcctgctagagaaga

SEQ ID NO: 76781 - DNA, 219 bp, Zea mays
  Clone ID: LIB3079-032-Q1-K1-A8
acggcgacaccaactggcctgtccgttggccgctgggcggctaccctggccctcacggacctaactagtgcggggacagagcgcacaagtactactggccggacatcgcagacgcgcactacacaggctgtctctacggcggcatctacatcagtggcatcatacgggaaggtcatgccgtggcaatcggagttccaggtcggacctgccgtgctcgtc

SEQ ID NO: 76782 - DNA, 401 bp, Zea mays
  Clone ID: LIB3079-032-Q1-K1-B10
actgaatctgttgatatcacagacacatgggaacctttggaagaaggccttctcccactagaggcgaactcgccatgtgtcgatgatcactgtgacactgtcaaagaaccctctggatacatcatctccaggataccagccacctatcccagctgaagaggtgaaacctgcttttgactatgatcatgaagaatcgtatcccactggtcgtggaagaggacgtggtggtggcagaagaggcaggggaagaggcatgagcaatggcccccttcacctgcttatggttacaacgaaaagtggaaggaggaaggaaatattattaacaaagggcccggaaaaggccggttccttgaccaaggtggaaaaggccttgtggctactaacgaagttggaagccttgt

SEQ ID NO: 76783 - DNA, 242 bp, Zea mays
  unsure at all n locations
  Clone ID: LIB3079-032-Q1-K1-B12
cggtccgtgaatntacccgggtcgacgccacgtccgtccgtggcacggcgtgatgganntatctcactnccctttgagaaggtgtcgaactnccaggctcatctttactctccnttcaccacgtgggtnngccagggagtagccgcctattcaggaaccaatcaaaacntcattgggctgagtgcnncttgcagaatgaagtnntgatcaacgctttgccaagggggctcgttcnncaacag

SEQ ID NO: 76784 - DNA, 119 bp, Zea mays
  Clone ID: LIB3079-032-Q1-K1-B2
gaacgaggatagcgcttgtggcgctcgctcgaattgttcggcgtcatcggagagatcgagttctgggacacgggcggtcgctatgatcgtggccagctttcgtatgcgtgcactgtaca

SEQ ID NO: 76785 - DNA, 424 bp, Zea mays
  Clone ID: LIB3079-032-Q1-K1-B3
acgcgtacgcgccacatgatattatgcgggatgctgctatttcaacattgacaactgattgtgaacacgagcgctgtcgtgccatgtaacggctgctgttgggatgcgtgtcacacgggaactattattctataccacacagaatagagacattgctagcgtccagataggacctacgctgacattattgctgagctctcagcatatgctgattcatcatcacagacgatcagtccttttattgatcctatccatagtttgaatatgcctaactatgaaccccagcggtggtcatttttcagaaatcttgcacaaaatgagtttccaaaaaaggatgaggcccaagatctggcaaagatcgaggaaggagtttatcccttagatcacttagagcatgatacaactaatgtgaagaatttggatc

SEQ ID NO: 76786 - DNA, 395 bp, Zea mays
  unsure at all n locations
  Clone ID: LIB3079-031-Q1-K1-H4
cccacgcgtccgggtaatcctaatagctatccctggcatgacggttctggacatctgtgtttgcatccttgccttcatgcccactggatggggtttgctcctgattgcccaagctatcaggcctgtgattcaaaagatcgggctgtgggggtcgatcaaggctcttgcccggggctacgagatcctaatggggcttctcctgttcacgcccattgctttccttgcctggttcccgttcgtgtccgagttccagaccaggatgctgttcaaccaggccttcagcagaggtctgcagatctcccgtatcctgngaggacacaagaaagaccgaaggacgcggaacaaggagtagtagggctgctgattgaaggtccgtctatcgggagttatgtcgt

SEQ ID NO: 76787 - DNA, 90 bp, Zea mays
  Clone ID: LIB3079-032-Q1-K1-B4
aaaaaaaaaaaaaaaaaaaaaaaaaataaaaataaaaaaaaaaataaaaaagacaacagatatagaaggaaaaaaactaacaaacacata

SEQ ID NO: 76788 - DNA, 250 bp, Zea mays
  Clone ID: LIB3079-032-Q1-K1-B5
tcgaccaggtgcggctgcgtgtttcgtcacaatcaagatgcaacccttatcgccggcgacgttggcaacaaaaagggatattgatggcagacgtgtatttcttggttgaataatatatactgctagaattaatatgggcaccaacaacgaaatatctataatgttattcttcagtgtaatgcttccagcatgttctgttttagtataactaaatatctatctttccccgccaaaaaacataaattgaata

SEQ ID NO: 76789 - DNA, 162 bp, Zea mays
  Clone ID: LIB3079-032-Q1-K1-B6
acgtccacgcgtccgaaaaaaaaaaaaaaaaaatttttaaataaaaataaaaataaaaaaaattactggtaaaggaaaaaaaaaaaaaaaaaaataaaaatacaaacataataaaaaaaaaaatacataaactaacatataaaaaaatatctacatcttttg

SEQ ID NO: 76790 - DNA, 420 bp, Zea mays
  Clone ID: LIB3079-031-Q1-K1-F9
agaattcgggctacctgacctggagggccgtacccaaatctttaagatccatacacgcgccatgaactgcgagcgagatattcgtttcgagcttctggcacggctctgccccaactctactggagcggatataaggagcgtctgcacagaagccgggatgtatgccattcgtgcccgcaggaaaacggtgacagagaaggattttctcgatgctgtcaataaggtcatcaagggctaccagaaattcagtgcaacacccaagtatatggtgtacaactagagagtgtcttcatggaatatgttgattttagaactccgggatcttttcggtgattgtgtcatcgtgaggttctatgcaaggattgttgtttgttttgaaatctggatccccaaggattgcatcctgtaccacatgttttt

SEQ ID NO: 76791 - DNA, 395 bp, Zea mays
  Clone ID: LIB3079-031-Q1-K1-G1
tgcagcttcaatcgtttcaaagtcggggaaagcacttgtttcaagacagtttgttgacatgtctcgcataagaattgaaggattacttgctgcgttcccgaaactggttggaactgggaaacagcacacttatgttgaaactgaaaatgtgcgttatgtttatcaacctattgaaggattatatcttctacttatcacaaacaagcagagcaatattcttgaagatctggacacattgaggcttctctccaagcttgtgcctgaatactccccttccttggatgaggacggtatttgtaaaacagcatttgagattatatttgcttttgatgaagccatctctcttgggaacaaagaaaatgtgacagtgcaacaagttaaacaatattgtgaga

SEQ ID NO: 76792 - DNA, 429 bp, Zea mays
  Clone ID: LIB3079-031-Q1-K1-G10
gaaccctcaaaaaactaactagctagcttagctaaccccggccgatggacatggaccggaggttcaacgtcgactggagtgccaacgagatcgagatggtgagatctctcatcgcttgtcacggcgccagcaacagcacgaacgacgacattgtggatgagctccaggcaatgttcccagggaaggataagcgccaggtaactgacttgtacgttgagcttgtggtggagatgataaacagtggggcagagctgagcagcaaccagctcctgctcaactctggtggggtgcacagcaggacgatggatgggtatttagcagacgagatgaaggcgaagaggatgctgctggaggaacagcgccgtaggaaattagttgctgttcctcgacaggataaccaacaacgtgcaaggaggttttggactctgg

SEQ ID NO: 76793 - DNA, 354 bp, Zea mays
  Clone ID: LIB3079-031-Q1-K1-G12
gccacgcgtacggccaaacacacgcgaaaagtttgagttcgagtacaggttacagagaggcagagagcaaagatgtgtggtggtgcgatcctcgccgagctcatcccgaccacgccggcgcgccgcggctgcgcggcgtggcccgccggcaagtgcaagcggcggaaggcgaacgacttcgaggccgcgttccgggagttcgacgaggactccgaggaggaggaggaggacgagggggtggtggagagcaagcccgccttcgtcgaccgcgcctagtgcgcggtgacgcatcccatggcgctccaggagcagcagatccggcgccaggcgcacgaccagcagcagtacatgggc

SEQ ID NO: 76794 - DNA, 404 bp, Zea mays
  unsure at all n locations
  Clone ID: LIB3079-031-Q1-K1-G2
tcgcttcaatcttaccgcaaacactgtgcatctgtaacctcatcggggcagttgattctccgagaggctctaaaactgctgcctttatatactctggcactggtaaaaagtgtaagcttgagaactgatgggcgattagatgaccgttcctattggatatctctggtctcgtcagtttctgtagtactagctgttcctctggtgttccctagattgattcctatccatgatctcacgtncagggatgatgatgattcccttgtaccaagtccacttatgctcaaaaagtgaaatgtacaagaggatggggtctatttattggaaaacggtgaagatggtctagtctacgtaagaaacatggtaaatccggctaccctggaacaaatattccgtgtctcttcttt

SEQ ID NO: 76795 - DNA, 347 bp, Zea mays
  Clone ID: LIB3079-031-Q1-K1-G3
aaaaaaaaaaaacatacaaaaaaaaaataataaaaacttaaaacaaatatataaaaaaagggcaggggctctattagaatccgggctgatttcacagtacatactgaatcataacccgtgctatcgaaggcaccaaaattcaattaactggacctcattttacatcattgaccactgggaaaacaccgtcgttactgaaataaaactgcttgaaccaaattcaagtttactaaaatggcttactatttatcaagctcggatcttagcatttatgcctacaatgctcacccttgatggcaaatgggcaacccccatgagcgacgcattaaaccccgtaggtgcccttt

SEQ ID NO: 76796 - DNA, 152 bp, Zea mays
  Clone ID: LIB3079-031-Q1-K1-G4
aatggattacgaaacatttctatcttaacaatataacacatgtttatataaaaaaaagaaaaggaaaaaaaaaagaaagggaaaacaaaaaaaaaaaaaaaaaaaaaaaaaaaagaaagggcacaacaactaaaagaaccaaacttaaaaag

SEQ ID NO: 76797 - DNA, 412 bp, Zea mays
  Clone ID: LIB3079-031-Q1-K1-G5
aaaactaatattttcagtgtcagtgtagaattgccagaatcgtatgaaaacgacgagacggcagctttacaggatccactcatacgcaatccaacatgctacgctatactttttgtatataatcacctatatactcttcactgtccaacaagttcacacctcatattacctgtaaaactgttccgtaacctaattctaccctcttactgcataaccctcttttgccagatcctgcaaatgacaatattcccgcaccaatcccacttcccaacatttgtgcagtcctacatgccaatgacaatctccatgctcaacatcattaagtgcccgaaatctgtcccttacatccacccttacctgttcatttagaacaccattaccgccaccatattcaactccatggccttccttc

SEQ ID NO: 76798 - DNA, 431 bp, Zea mays
  Clone ID: LIB3079-031-Q1-K1-G7
cccacgcgtccgtgagtcttcaatgagagctgattccagttatatagaggtgaacaaggttttgattatttctttggttaatttggtgcaacatatagaggtgaacaagcttattaaaggaagatccttgtacaatcaagagttcatacaatagatgaaacgatattgtgattctctcaatggtggcttcatgagcaagcaatcattcaccttgttcactaaaatttcagactgtagctcagataaggctttgagcattccttgctacaatgcttccgagagaagggaaaccggcaaaggggaaaagagacgaatagaagggcattggtgccctctcacacacaggccaagtatacatccacatgccacaaggctgaagcttccacatgaacaagagaatggatcgtgatagctattgcaagatgatgcac

SEQ ID NO: 76799 - DNA, 232 bp, Zea mays
  Clone ID: LIB3079-031-Q1-K1-G8
gtcgacccagcgttcggttaagttaaagcaacttattgactactattgaaggttgatctcgggagacggggaattaatccggtgttgctttcatgcttaaattggatcttatagtcttattccaacacctaacatgtctcttgttcaatcttcctctgtatcatattgtatgcatagatttttgatgggtcctgtgaaaccttggcataatctatacacatgaaataaggga

SEQ ID NO: 76800 - DNA, 422 bp, Zea mays
  unsure at all n locations
  Clone ID: LIB3079-031-Q1-K1-G9
gagctactacgggcagcagccccccgtcggcgttccgccgcagcaaggctacccgggcggggacggctacccgccagcggggtacccgccggccggctaccccccgccggcgcagggctaccctccgcagggctacccgccgcagtacgcgcagccgccgcctacacagcagcagcagagcagcgggccttccttcatggagggatgcttggctgccctctgctgctgctgcctcctggacgcctgcttctgagagtgagaggggccgaccgacggattcgacacggcgacaagtgaaactactagctttctatgcgagggagagagagagagagctggaactggattgagcctggaatgctatcgtgctattctagctttgtcagagcataatatgtcgccctaggnttttatttctctct

SEQ ID NO: 76801 - DNA, 298 bp, Zea mays
  Clone ID: LIB3079-031-Q1-K1-H1
gatgggtgaagacactcagctgcgtaactctcgactcgacttggttcactaatcgttttgggtacgcactcagcttcgaacatgtagtagcaacttttagatctagagccatgtgaaaaaaggcaggtttgactttaacccagatgtttagggatttttcgagcagcaaactgtgacagtatgtatgcattgacaatttaaagctgaagtctggaccggtttccatgaaaaaaaagcccaaaagaaaaaaaaattccaaacaattgcacagcccaaaaggcaaaatgggacgcaccat

SEQ ID NO: 76802 - DNA, 332 bp, Zea mays
  Clone ID: LIB3079-031-Q1-K1-H10
cggacgtatctaatcgcacctgcttgtatgggccgcaagttcttcgtcggtgaggagctgttttatgcggtggaaccacagatcatgtcgagaagattgtcaaaaccctgaatgaacgacacgtttccccttcagatgtcgtcgaggtcgttgtcagccatgcttatgtcttccttgctgtggtcaagaaccatctgcaccaatacttccatgttgctgctcacaactgctgggtgaagaatggaggcgcttttactggtcaagtcattgctgatatgctcgttatcctttggtgttccctgtgtcattattgtacactatgaaatgagagc

SEQ ID NO: 76803 - DNA, 352 bp, Zea mays
  Clone ID: LIB3079-031-Q1-K1-H11
tcggtctgacagaggtactatacgatacgctacgatgctcggacaccgctgctatcacactcaggaggatcgcttcgtccccactgccagctccttgtgctagtgatactcaagacacccatatcatactgctcaacggacaattcgagacggtgcctaccatgctgaacaagatgctgatctgggtgatgcaatacgtgcctgcgaggacggtgcaggggcacgtcgtgaacctgtagggcctgacggagtcacggggcaagactatcccagtgccgatcggactgcacacgctgcgtctcatgagccgagcattggcgatgcagaacgtgacggtaccgacgggggcgct

SEQ ID NO: 76804 - DNA, 225 bp, Zea mays
  Clone ID: LIB3079-031-Q1-K1-H2
gtgaagcggatgatataccactacaagtactagttcagctctaataaaaggaagcagggctatgacaaggatttgtccattacgtcgtctatacatcaataaattggcatgaatttgtaactccattgctatacatcaataaattggcatgaatttgtaacaactgaaaggatcaagatgccacccttgaaaaaaaaaaaagctagacatctgaaacggataaca

SEQ ID NO: 76805 - DNA, 415 bp, Zea mays
  Clone ID: LIB3079-031-Q1-K1-H3
gaggaggagcacaggttgttcctcctaggcctgaagaaatacggcaagggggactgggggaacgtatcgcgcaacgttgtccagaccagaacgcctactcaggtggccagccacgcgcagaagtacttcatcaggctcaactccggcggcaaggacaagacgaggtccagcatccacgacatcaccacggtcaacctgacggacgaccagccggcctcgccgtcccagtcctccctgatcaccagccagtcgaacgcaccagctccatctccagctccggctccagccgcggggatatgccaggtcccattggcggccgacgtcaaacgacacggtgccggaactctgcccttcagctcaccgaaccggacctctgcggtaccggcctacaggatggagtttcatgaccaacaag

SEQ ID NO: 76806 - DNA, 429 bp, Zea mays
  Clone ID: LIB3079-031-Q1-K1-F8
ctgatgtacagatcgtaaaggaatatattgaaagaggaaatgcagctagaagcacagggtcaacaggggccaatgaggaatcatcaaggtcacatgctattctacaactggctgtgaagaagcatatcattgtaaaagataccaggagacagagagatcgtgatgctaatgaagctaaaaatacaaaggctgtggggaaaatatcatttattgaccttgctggaagtgagcgtggtgctgatactaccgataatgatagacaaacaaggatcgagggagcagagataaataaaagtctgttagctctcaaggaatgcattcgagcacttgataatgatcagatacacattcctttcagaggaagcaagcttactgaggtacttcgtgactcatttgttggtaactctaggacagtgatgatttcttgca

SEQ ID NO: 76807 - DNA, 437 bp, Zea mays
  Clone ID: LIB3079-031-Q1-K1-E5
atcactatcagtcgacgccgacgctcctccatcctctgccagtaccaggtcgccttttgttttgcagttcttcctcgctctgctccaaggccggcgcagcgcaggagatcgaaggggaaggatgatggcggcgatgggcggcgcggtgcgggtgctgtgcggcgcggagaaggagcgggtggtgggcacgcgcaaggcgcccggggcgtgcccgcgctgcggcggagccgtggtggccgtcgacgtggagagcgagcgccgcttactcggcctgccgctgtgcctccagagcaagcgcaagtactcctgcacccgctgcctccgccggctcgtcaccctctacagctgagagctcaagaacgagctacactacgctacacatgcacccctcgatctcttcttgccaagcgcccgtcggcccgcccgtcgacgatgac

SEQ ID NO: 76808 - DNA, 434 bp, Zea mays
  Clone ID: LIB3079-031-Q1-K1-E6
accaggctacggcgggtaccctcctccaccagctgcagggggctacgcgcctgctcctgcgcctgcccaggtggaaccaggctacggcgggtaccctcctcccccagctgcagggggctacgcgccgccgcctccgcctgtgcctgtgcaggagcctggctacggcgggtaccgtcctccatctgctgggggctacccggcggggtacgggtacagcaacctgcctcgcgctctggcgtctgaacagaccgtccgcgtctactgcaaggccggcgaagggtacagcctcaccgtcaggaacggcaccgtgtgcctggcgccaaccaaccccagggacgagttccagcactgggtgaaggacatgaggcacagcactagcatcaaggacgaggaagggtacccagcgttcgcgctggtgaacaaggtcaccggcg

SEQ ID NO: 76809 - DNA, 421 bp, Zea mays
  Clone ID: LIB3079-031-Q1-K1-E7
accacgctaccgctggtaccctcctccttcagctgcagggggctacgcgcctgggcctgctcctgcccagggggaaccaggctacggcgggtaccctactactgcagctgcacggggctacgcgccggcgcctccggctgtgcctgtacaggagcctggctacggcagataccgtactccatctgctaggggctacccggcggggtacgggtacagcaacctgcctagcgctctggcgtctgaacagaccgtccgcgtctactgcaaggccccagaagggtacagcctcaccgacaggaacggcaccgtgtgcctgtcgctaaccaaccccagggacgagttccagcactgggtgaaggacatgatgcacagcactagcgtgaaggactaggaaaggtacccagcgttcgcgctggtgaac

SEQ ID NO: 76810 - DNA, 435 bp, Zea mays
  Clone ID: LIB3079-031-Q1-K1-E8
agggaagaaaggtccacacaggacactcctccttcgtctttctccttcctcggcgctcgctgctgcattcgcgaacacgcatcgaccctacgactacgagtagcgagagaggattgatggcggcgcagctgcggtacatgatgagccattattttggtaccccacctagcaaggttcgcgggatcgctcccagaaacgtccgagttgcagttcccaatttttttctctttctttccaaaatcattttctgaagaattctccccaaatcctgttcacttctttggttcggggttgacggggttctttgttgctaacgaggcaggaggtgatccaagatctgtactacgccttgaggacaaagggaggtttgacccccaaggaggaggagacgctcctggcttgcaatttacttcctggtgtttatttcatcgtggg

SEQ ID NO: 76811 - DNA, 311 bp, Zea mays
  Clone ID: LIB3079-031-Q1-K1-E9
cgaagcctccgagtccattctcttccgggtgatgatggtgtgccggatccacgggtcaggcgaggtggttctcgactacgaggtaaaccccatgagcgacctccctccccttccccgggtgggcgtcgtgttcagcgccgggaggtccctgagccacgtcacgtggtacgggcgcgggcccttcgagtgctacccggaccgcaaggcggcggctcacgtcgacgtgtacgagaacagcgtggaggagctgcacgtgccgtacattgtccccgttgagtgcggcggtctggcagacgtcaagtgggtggcac

SEQ ID NO: 76812 - DNA, 439 bp, Zea mays
  Clone ID: LIB3079-031-Q1-K1-F1
cggtgagcacttcgagggcgtgaagcagcactgggcgagcaacttcgccttcctcgactactacaagaaggtctacggccgcgccgagcccctccccaagtggtccgacgccgacgtcgacgagttcatcgactccgacccggtctacgggccccagctcaaggccctgcgggagtcgaggaagtttgcgctcgccggggccttcgccggcgccgtccacctcggcggcgtcgcgctcaagtactccaaagcgccgcacggcgtcgtgctggcgaccgggttcggggcgatcacgggcgccgtgctggggtccgaggtggcggagcactggtaccagctctacaagatggacaagcagggggccaaccttaggttcatctactggtgggaggacaaggtctcaggacagaagagctgaaccatgttgaattgaatgatg

SEQ ID NO: 76813 - DNA, 424 bp, Zea mays
  Clone ID: LIB3079-031-Q1-K1-F10
gcgttcgtccagcgtgcttccacgcgtgcagcggattcagcctcgctggagacctcatatgatggtctcgacacctgcccacgaggcacttattctgacgacaacaaggcctgcaggaagcacaaggaagatagtggtgccagcttcagctctgctcgctccaaggactcaaactcaaaggaaagcagcaaaaggagccgaagaaaaagagacagaagcatcacgaaagtggactaagaggatcccaaagggtacatacatgtcacggcgatgagaggacaagctacggacaaccacagtcttgcatagaaagtgaagagggagagaatcagtgagaagatgagggtgttgcaagccctggtccctggctgtgataaggtcactggaaaagccctcattttggacgagatcatcaattatgtgc

SEQ ID NO: 76814 - DNA, 439 bp, Zea mays
  unsure at all n locations
  Clone ID: LIB3079-031-Q1-K1-F11
atcactatcagtcgacgccgacgctcctccatcctctgccagtaccaggtcgcctttttttttgcagttcttcctcgctctgctccaaggccggcgcagcgcaggagatcgaaggggaaggatgatggcggcgatgggcggcgcggtgcgggtgctgtgcggcgcggagaaggagcgggtggtgggcacgcgcaaggcgcccggggcgtgcccgcgctgcggcggggccgtggtggccgtcgacgtggagagcgagcgccgcttcctcggcctgccgctgtgcctccagagcaagcgcaagtactcctgcacccgctgcctccgncggctcgtcaccctctacagctgagagctcaagaacgagctacactacgctacacatgcacccctcgatctcttcttgccaagcgcccgncggccccgccgtcggcgatgacaa

SEQ ID NO: 76815 - DNA, 442 bp, Zea mays
  unsure at all n locations
  Clone ID: LIB3079-031-Q1-K1-F12
ccgcaatcaaggttgtcacgcccgacgaggatggctgccagtcaccgcacggccggtgggggccccagcgacggctccagcgcaggcgcgaggaagaagctccaactcaccaatgagcagtcgacgctgctcgaggacaccttccgcgcccacaacatactctccaacgcgcagaagcaggagctcgcacggcaggtggatctcagcgccaggcaggtggaagtgtggttccagaacacacatgttcagataacatgttttgcatgaactaccctctgtatctaacaaaaagaagttcaagtttgcaggaaacaaccacaatcgaattgttgcaagtgcgtcccacgatctgaagacaaaaagatctgttgtccattagcaacaaagtgctacagaggctgtgttctgtgtaccagtactngatagtgagtttcagaatgaa

SEQ ID NO: 76816 - DNA, 436 bp, Zea mays
  unsure at all n locations
  Clone ID: LIB3079-031-Q1-K1-F2
cggacgcgtgggcggacgcgtgggcggacgcgtgggcgcgacaaaggttacctttccggtanggtggaccaatacctgctgcagccaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgacgggaaatggggggagcatgagcttgactacctgctgttcatcgtccgggacgtgaaggtgcagccgaacccagatgaagtcgctgacgtgaagtacgtgaaccgcgacgagctcaaggagctcatccggaaggctgacgctggcgaagacggggtgaagatctccccctggttcaagctggtggtggac

SEQ ID NO: 76817 - DNA, 415 bp, Zea mays
  Clone ID: LIB3079-031-Q1-K1-F3
ctcccagttcagcttggacagtctgaacccaaaggagaaaatcatggaactaggcaccgaggagcgtcttcctgtgcccaagatcttgggctgccggtcaggacgcttcgtcgtcctccggcacagcgaacggggtcaccagtgcggcatcagggaaaacaccggcctggcttagctacatgccgttctggccgaccatgtgatcggctagcacacgcacaccccaaactcttccaggtcctaaagaatctccaagtattgcatttgtgagacagatggctacaaggacattgtaaatgtatattttggagtttgtaagcatcttgaatggtgcacgtgcgatcctgcaaatcatctgtggcccatgttacaacccacagattcagggaaaaaatatcgaatgattatgtaatta

SEQ ID NO: 76818 - DNA, 419 bp, Zea mays
  Clone ID: LIB3079-031-Q1-K1-F4
cccacgcgtccgcccacgcgtccggcagtctcttggccaggctcaaaatcagacgatggagtcagactctgcggcttcattatataaggacgatcacgtcccgcctagccggaagctgctgaaaagtgcgaaccacagcaagagctgagctctggagcaagattcttcaatgctcatagaaaagttgtcttgtcgaggccctaacctgagcaggggcaatggcttgcatttctgtgaaatttggtcttagtgtggtcgtgctgcatttaccggaagagcttagaaaccatggacacgcgtgataagagataattcttaggccgtgatgtgtgcacgtgacatggcttgtcccccgccatcttgcaaaattgtttatgtcaggttgattgtatctatctacatacatgttatgttatttc

SEQ ID NO: 76819 - DNA, 434 bp, Zea mays
  Clone ID: LIB3079-031-Q1-K1-F5
ggcgcttctcaagagtaatgacactagggctctcttcctgatggccatcgtggtcatggccatggccatcgtgttgacaccctgccctgtgcacggacgaaatgatggtagctatacatgtgcatcatgcccactctaaccatatttatttagtttctaaaagattgtatgcattggatattggtattgtcattattgactagttttttttatttcaaaaaaaacttttgtgtagagaggtgcacgcatatgccggggtgcactatcagccgttgcctaagccagtgcaagcagtgggggtatgccaaccctgtgataaactgctggaacacaccaccgaatacagttttggacacatgctgctgctttagtaatgctgctagaaaattggcttgattttatcactgacagctctagctgttggatcttgactg

SEQ ID NO: 76820 - DNA, 435 bp, Zea mays
  Clone ID: LIB3079-031-Q1-K1-F6
gcgaccgaaacgaatcaaagcaacaccctcagtctcgcttcgcacacgtgcagccgcggacgaatcctagtgctacataataaagtgcaagcaggcaggaggcgtacgtgtgcgagtgagtgctgctgctgcggcgaccgtgtgaccgtagtcgttatttgtgtgtacggaataaagtggtgagcgctgagacgtgcgtgtcagcctagtaataactaaaataatggccgtgttcacgtaacgtgctcgacgtatgtaccatcgtgtgtaccggccgtacgtatgtacaagccgagtgcaataatacagtactatgtgtatcattaaaaacacaccaccgaatacagaaaaggacacatgctgctgctttagtaatgctgctagaaaattggcttgattatatcactgacagctctagctgttggatcttgactg

SEQ ID NO: 76821 - DNA, 436 bp, Zea mays
  Clone ID: LIB3079-031-Q1-K1-F7
ctctccgccgccacctctgtacaaaatgcccgccccaccaccacgccgaatccgccctgtagtgactagttcacgtcagttgctgctccccccaccttctcctcctgctcctgccctcggtttctgatcagcgaacatgggaacccgcggcgtcgccctgctgctcctcgcggcggtgctgctcctccaggcgctcctcctcgcgtcgtcggagggcctggtgcgggtcgcgctgaagaagctgcccgtcgaccagaacggccgcgtcgccgcgcgcctctccgccgaggagaggcagcgcctcctcctccgcggcgccaacgccctgggctcaggcggcgacgacgactccgacgtcatcgcgctcaagaactacatgaacgcgcagtactttggggagatcggcgtcggctcgccgcagcagaagttcaccgtc

SEQ ID NO: 76822 - DNA, 406 bp, Zea mays
  Clone ID: LIB3079-031-Q1-K1-E4
gcgaattatgtcacctctagagttctctcgatttgtttagatccgatatgcgccaggcgtctcgaaccattcgtcttcggcgccacgtattccctgatgagaaatattcaaaactacacctgtcacaaaaggggaaaaactatggttggacaataagattcatgaaaaacatatgtcgatccaaattaagcgtacatctcttttatcaaggaaccaaatgtaagtcggtcaaatatatacatataagtactaatatttatggaatatatacttttacaataaaattattaaagatatacaatatagagcttgaaccatacaaaccctaactgataatgagtaaccataacatatgtatatgtactccattcgttaccaacaataaggtgtcttacatatcaagtaa

SEQ ID NO: 76823 - DNA, 392 bp, Zea mays
  unsure at all n locations
  Clone ID: LIB3079-030-Q1-K1-F2
gtcgggcttcttcctctcccagctcttctcgtcctcgcggggcgcctcgccgacgcggacgccgccattcccgctcaagcagccgtcagcagctccggccgcgcgcgccccgccgcagctcttcagctggccgggccaccaccagccgcagcagctcccgtcgcccgcgggagcgtcgccgctcttgccgcccggcccgggcgcgttccacccgtcctccgcgcgcccaatgccgtcgttcccaggcggcaaggacgagggccacatgttccacctnccgccagcggcgcaccacgggactaacaagcagctcgctgagcacatggacgagcacaaccaccaccagcagcacccgatggggggggccggcggcgactcgcccgacggcgacc

SEQ ID NO: 76824 - DNA, 281 bp, Zea mays
  Clone ID: LIB3079-030-Q1-K1-F3
cggacgcgtgggggcgcgccgccccttcactgtcgacgaggacgcggccatcgcccgggcggacgcccgcctcggcaaccgctgggccgtcatcgcgcgcctgctccccggccgcaccgacaacgccgtcaagaaccactggaactgctccctcaagcgcaagctcggcgccgccgacgccgcgtccggttcggcggttgccgctgacgactgcgtcgccgacggcgagaccgaggcgcgccggggcaagatgatgatgatgagcatctcgcccgccgaca

SEQ ID NO: 76825 - DNA, 398 bp, Zea mays
  Clone ID: LIB3079-030-Q1-K1-F5
gccgccatgctggacatgcttaagtagaccggcgagccagacatggttgtaggttggtatcactcacatcctggctaccgatgctggctatcaggcgtccatatcaatactcagcagagtcttcgaagctttgaaccctagagcctgcgctgttgagatagaccccatccagagtgtgaacgggaaggtggctattgatgcattccgcctcattaatcctcacaccatgatgcttggccaggagccacgtcagacaacatcaaatgttgggcacctaaataagccatctattcaggctcttatccatgggttgaatagacactactattcaattgcaatcaattaccggaaaaatgagcttgaggagaaaatgctgttcaacttgcacaaatagaaat

SEQ ID NO: 76826 - DNA, 373 bp, Zea mays
  unsure at all n locations
  Clone ID: LIB3079-030-Q1-K1-F6
gggaaagctaccggtgaagcctttgttgagttcccaacagctgaagttgccaagacggcgatgtgcaaggataagatgactatcgggacgaggtatgtggagctgttcccgtctaccccagaggaggcgagcagggcgagaacccgaggcaggcattgaagaaacgaatggcttggctgaatgatctctggttgcatgtggctgcaatcgactgtagttttcacttcgcatgcttatctgtatcgcttttagattgtgttagttgtgtgtatttgacttcttatatgcgaactgaactgtaacaactntcctttgttggccggccgcacatgtacggcataatcatttatggattttgctacgtttgagtttc

SEQ ID NO: 76827 - DNA, 337 bp, Zea mays
  Clone ID: LIB3079-030-Q1-K1-F7
ctctctctcccgcggctgcactgcggcttggatcacatcctcgtcggagctaccatggctgggaagcttattgcaaacctgattgtcatgggctctacgattataggaagagctatgcttcaggcatatcgtaaagcacttgataatgcaaataaaactggtgtggcccatgaggcaataaacaatattcgtagagcaagcaaaacaatgaccgaacaggaagcgaggcagatactgggtgtctcagagaattcgacgtgtgtagagatcgtacagcgatactataactagtttgaaaagaaacggctatctgggatcttctacctacaatcgaaag

SEQ ID NO: 76828 - DNA, 297 bp, Zea mays
  Clone ID: LIB3079-030-Q1-K1-F8
gagaacctgtatcctcttgttgaacatctggaacgtgagcaggctgccaaggtcactggcatgcttttggagatggatcagacggaggttcttcacctgctggagtcgccagatgctctgaaagccaaggttgctgaagccatggaggtcctccgctctgcccagcatctccagcagagcaatgtttctactgagcagcagctggctaatctatcattgaatgatggcgtcgtcttcagctgaacgttaatgtttctgatgtttcggaagtgctgccagtttttgcttgaatactac

SEQ ID NO: 76829 - DNA, 387 bp, Zea mays
  Clone ID: LIB3079-030-Q1-K1-G10
caattcttggtgtccagggcttctctgctctgcccctgcattgtttgcagctgtgctacggattctttggatttgcagtggcagccaatctgatgagggacctcttgccaccaaagtacggcaaatgggttccattaccaatggcaatgggggttcccttcctagttggtgcgagctttgccatcgacatgtgtgtggggagcttgatggtcttcatctggcacatcattgacagaagtaaagcatctttaatggtgccagcagttgcatctgggttgatatgtggcgatgggctttggatcttccctgaatccttgcttgccttggccaagatcagtccaccattgtgcatggcattcaggtcttcacactagagtaacaaaatgc

SEQ ID NO: 76830 - DNA, 377 bp, Zea mays
  unsure at all n locations
  Clone ID: LIB3079-030-Q1-K1-G11
caagaccatcgaaactggaaatgatatacttttggaaacctttcgtaaagctgttgcgtcgcctgtacagccagcaaatttgcttacagtcctcaaagctgtgacaaacttgtttggcaactcatgcttgcaccagtggctgaggacccactgtgctgagatcattgattcggtgtcaaactgcaagtcttcttttagcaagaatgcacacttggcatatgccacgcttctactgaactacgctgttctttcgattgaatcaaaggaggaacagagtcaggcgcagattctttctgccgcccttgaaatcgccgaagatgacacccaagatttcgactcaaagtaccgggcacttgtcgcaatcggntctcttatgc

SEQ ID NO: 76831 - DNA, 373 bp, Zea mays
  Clone ID: LIB3079-030-Q1-K1-G12
gttcaagaaggttgccaatttccttgctcggttcaagtccatccccagcatagttgagcttgacagcttgaaggtgtctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccgagcctaatcactcctactgagctctatatttttgtaattttcatgtgcattccgattccgctgcgagggtcatgtgagcccgctagagaataattggaatcttcttt

SEQ ID NO: 76832 - DNA, 300 bp, Zea mays
  Clone ID: LIB3079-030-Q1-K1-G2
ggccgctcaagggctccacgctcgtcaccgaaggcgcgatgacagaagggtcagacgagtgggcgatctacggtggaactggagtgttcgcgatggcgagaggcgtcataaggagaacgtttcttgccgacacgagcggcgggaactccgacgagcttgccgtggaggttctctgcccggtgttccgcccggcggcgtttggctcatcgtcgtcacagccagcagcaaaggacatcagctccaccgtcgtcgtcaccaaggtcggagtgtggggtggagagggagggtcggcgcatgaca

SEQ ID NO: 76833 - DNA, 446 bp, Zea mays
  unsure at all n locations
  Clone ID: LIB3079-030-Q1-K1-G3
gccacgcgtccgacgacatccactctcctaggattccctccacagaggagatcgcaggccgcgtcgagaagatgctcgccgtgctcgacaccaacatcctctgggtgaaccctgactgtggtctcaagacacgcaagtacacggaggtcaagcccgccctgaccaacatggtctcggccaccaagctcatccgcacccagcttgccagcgcgaaatgaagtcgtttgatagctccatggtctgatagcgcggaatgagccagttgttttgaataatttgggtgttaccccctgttccatggtgttagtgttaggttagcctctcattggtgagatacgccgtttcaagatgtgttctaagtttggagtgtgtgttntcctttgggctatgtttctgggggtatgtgtgtgctttggttattaacaggaatgaaatatgcagtcttc

SEQ ID NO: 76834 - DNA, 62 bp, Zea mays
  Clone ID: LIB3079-030-Q1-K1-G4
actactcttacgactacattcactattctaatatcccctacacagatgacatctccgaccgg

SEQ ID NO: 76835 - DNA, 148 bp, Zea mays
  Clone ID: LIB3079-030-Q1-K1-G5
gccacgcgtccgaccacgcgtctcgatagcgctgatgttataattatcgacgggcacgtctacactattgtgactgttgtcaattcgcaactatttggtgacatcaatgttcttaagtctgtgccaattcaggtgactgacgatgtaa

SEQ ID NO: 76836 - DNA, 153 bp, Zea mays
  Clone ID: LIB3079-030-Q1-K1-G6
aaaaaaaaaaaaataaaaaaaaaaaataaaaaaaaaaaaaaaaattaaaaaaaaaaaggaaaaataaaaaaaaaaaaaagaaaaaaaataaaaaaaaaaaaaaaaaaaaaaaaaaaaaaaaaaaaaaaaaaaaaaaaaaaaaaaaaaaggtaa

SEQ ID NO: 76837 - DNA, 353 bp, Zea mays
  Clone ID: LIB3079-030-Q1-K1-G7
cccacgcgtccgagccaacaagatggccgcggacctgctcgtcatgggcagccatggttacggcttcatccagagggcgttcttgggcagcgtcagcaaccactgcgcgcagaactgcaaatgcccggtcctcattgtcaagaggcccaaggagtagaaggttcctcgcatgtaacgctgcagcttagccaataatgtttcatggcgaccatataggcatatatgtacacacttcacatcccattgcatggcagtgtcttccctagttcaacaactaactttctgcttgaataaagtgttcaaagtttagacagaatatgtactgtacatactatcttcttgcatttggtact

SEQ ID NO: 76838 - DNA, 401 bp, Zea mays
  Clone ID: LIB3079-030-Q1-K1-G8
gagggccccgccccgacgccctccgccgaggtgccccctgcccccagcgccgccggcgccgtctcccccgccgccggcaagtggttcgccgccgctgccgccgtggccgccgccgccgccgccttctactgagagaagggagatctgcactgccccgtgctgtaatttatttgttatccgtgttgagccgttgattccttctttgtttttcttttcaccattttttttcttccatccgaatatccatattccattcggcattcgattcagtaggactggcggcatctgttcgttcgtgttgctacagtgtaggaccgtggctcggacagattggttgggctggctcggtggtgttgtgctccggtcatccatttgtataataccctgttgagtctctttcg

SEQ ID NO: 76839 - DNA, 439 bp, Zea mays
  Clone ID: LIB3079-030-Q1-K1-G9
ttccgggctacgcgtacgcttccgcgcgagcgtgtacgtcgggagctccataaggtagcgaaggagcaagcggagaggagggagacggcgaagcaaatgttggagttgggtcaaaaggcgtacgggaaaggaatgtatggacgatcaattgaattcttggaggctgcgctcactatcatacgtccctcctctctactcggtggcgagatccaaatttggcttgcaatggcatatgaagccaataggaggcacaaggattgcattgcattgtacaaagagttggagagtagccaccccatgatcaacatcaggcgccaggcagctgagcttagatacattttagaggcacccaagttgaagatatcaaatgacgaggtggtcacaataccacaaattgggagcagcttggattggtatgcttgaacatggagtgaccaaa

SEQ ID NO: 76840 - DNA, 354 bp, Zea mays
  Clone ID: LIB3079-030-Q1-K1-H1
cggacgcgtgggctccaaggatggccagacccgtgaacatgctctccttgcgttcacccttggagtgaagcagatgatgtgctgctgcaacaagatggatgcaaccactcccaaatactccaaggcacgttatgaagagattgtgaaggaagtctcatcctacctcaagaaagttgggtacaaccctgataagattgcctttgttcccatttctggttttgagggtgacaacatgattgagaggtccaccaaccttgactggtacaaaagcccaaccctgcttgaggctcttgaccagatcaccgagcccaagaggccttcaaacaagcccctgcgtctgcccctccaagatgt

SEQ ID NO: 76841 - DNA, 368 bp, Zea mays
  Clone ID: LIB3079-030-Q1-K1-H10
cctccccttccggagaagaatgctgttgagaaattccggtttagcaaggagttcattgaattgcgtcgtcaagctttggatttatttgttaacaggatagcttcacaccctgaactcaagcaaagtgatgtcttgaggacatttttgcaggcagatgaagagataatggatagggcaagatcttatgagaccggtatttttaagaaaccatcagattttttacagatgtttaaggacgtacagtcaaaagtcagtgatgttgttctgggaaaagaaaagcccgtggaggaatctactcctgaatatgagaagcttaaaagttacatatttgagctagaaattcatttagcagaggcccaaaaacaagc

SEQ ID NO: 76842 - DNA, 361 bp, Zea mays
  Clone ID: LIB3079-030-Q1-K1-F12
caacaattctggatgtccagggcgtgggtttgaaaaatttcagcaaaactgcacgtgaattaattcagcgactgcagaaaattgacaatgataactacccagagactctataccaaatgtttattgtcaatgctggtccgggtttccggctactatggaacactgtgaagtcctttcttgatcccaaaactaccgccaagatacatgttcttgggaacaaataccaaagtaagctgcttgaaataattgacgccagtgaattgccggaattccttggtggcacttgtacctgtcctgaatacggaggctgccttaaggctgaaaagggaccatggaaggacccaaacatacttaagatagt

SEQ ID NO: 76843 - DNA, 188 bp, Zea mays
  Clone ID: LIB3079-030-Q1-K1-D11
acgcccccgctcctctcgtctctatcttcgactattccatcgcaggattcagcggccatgggcggcggcaacgcccagaagttcaagatggcgcgcgagaggaacgcctagaagaacaagggcggcaaaggcagccagctggaggccaacaagaaggccatgaacatccagtgcaagatctgcatgca

SEQ ID NO: 76844 - DNA, 229 bp, Zea mays
  Clone ID: LIB3079-030-Q1-K1-D2
catcaacaaaagacgggtcataaatttatgcttccttgttttgtggctaggcaaagcagtggtgatatcggttactaactgtagaatatacgtctgttgagatgtcctagtatgactggcttcggcgggcagctgatttgtgttttgccttttgttacttattgccaaatttatagaggttgatttgaggtgccaacaatttatagtaaaaaaaaaaccactgatacat

SEQ ID NO: 76845 - DNA, 246 bp, Zea mays
  Clone ID: LIB3079-030-Q1-K1-D3
cacgagacctcctgttttgtgtattattacagaattcatgcatggaggcagtatttgggacttcctttacaatagacgaggaaattttcaactcccggatgtgattagaattgcatctgatgtgtccaagggaatgaattacttgcatcagattaatattgttcatagggatttgaagtctgcaaatcttcttatggatgatcaggttgtcaaggttgcagactttggggttccagggttaaagac

SEQ ID NO: 76846 - DNA, 393 bp, Zea mays
  Clone ID: LIB3079-030-Q1-K1-D5
atgactactactcatatgtcatcaaaggtaaacctcccaaggatggaaatatcatttcagatgtcatcgcagacataagccatttcatcgaggagcttattgtcgttaatggggcgaaagcattcgtggtcgccaataactttcccgttgggtgtctggcatcatacctaagtaggttccacagtgacgaccatgaggactacgatgagcatgggtgccttaagtcgttcaatgagttctcccaaaagcataatgagcaactttattctgccatcggacaaatcagatactcttacccaaatgtgaaggtaatctatgctgactactacaactccaccatggaattcatcaagaagcctagtagatctggtattggtgaccctttagtagcat

SEQ ID NO: 76847 - DNA, 364 bp, Zea mays
  Clone ID: LIB3079-030-Q1-K1-D6
cacacacaccgcacctagccacctaccctgctgtcccccgtgccgtcgccgatggagtccttgggcgtgctgctgctccaccccttcaacgcgtacctggagcaggagctggaccgccgcttccgcctgtaccgcttctgggagacgccccgcgaggagttcctccgcgcgcacgcgggcgccgtgcgcgccgtcgtcggcaacgccagctacggcgccgacgccgcgctcatcgacgcgctcccggcgctcgagatcgttgcctccttctccgtcggcatcgaccgcgtctacctcgccaagtgccgcgaccgcgggatccgggtcaccaacacccccgacgtcctcaccgacgacgtcgccg

SEQ ID NO: 76848 - DNA, 399 bp, Zea mays
  Clone ID: LIB3079-030-Q1-K1-D7
acgggttgatgagcgtactattgtttttgttgctgatccaacctttggtaacataagggatgttaacattggtccatgtggtgatttagacgtgcgctcaggctttggtagtcaggtttcagggaagtatgggatcatgttctactggaaagaaaagggagaggacgccttaatcgaagctgctgagacggtaatatctcgatgtctaatgaaccccgccgggacaaataactgttcggaggtattatagaaagtgatgagttatgccgtacaaaggaacatggaaatgacagatgcatgtgtacagaagtgaaatactagaacaacatagaggctaaagatgtctcatggtctccagagaactaatgcttcactctttgaaatttagagcttttatct

SEQ ID NO: 76849 - DNA, 176 bp, Zea mays
  Clone ID: LIB3079-030-Q1-K1-D9
gtctactagcatatagcagttcatcaacgcgctcaacctaacacgacgtacggcgatgaggcgccgcggcagcaactgctcgccgattgcggctgctggcctggccctactacattcttctcgtagccgggtgcttccactggatgggaacggggggttgtcacactggctttttc

SEQ ID NO: 76850 - DNA, 341 bp, Zea mays
  Clone ID: LIB3079-030-Q1-K1-E10
acgattttgagcattcataagcacacctagcgaagcgcactagcaacgacctaacaacaatggctaccaagatattatccctctttgcgcttcttgcccttgttgtgagcgcagcaaatgcgttgattattgcacaatgctcacttgctcctagtgccattattccacagttcctccttacagttacttcaatgggcttcgaacacccagctgtgcaagcctacaggctacaacaagcgcttgcggcgagcgtcttacaacaaccaattgcccaattacaacaacaatgcttggcacatctaaccatacaaaccatcgcaacgcaacatcaacaacaattt

SEQ ID NO: 76851 - DNA, 402 bp, Zea mays
  Clone ID: LIB3079-030-Q1-K1-E11
gcggccgcagagatgatttggtatctctaggctatgtgcttgtgtattctctccgaggaagcctcccttggcagggactaaaagccgcaacaaaggcacagaagtatgacaagatatgtgagaaaaagatatcgactcctatcgaggtcttatgcaaatcctgtccggtccagttttcatcttacttccattattgccattcattggcatttgatcagcgacctgactatgcatttgtgaagcgacttttccgtgacttgattatcagccaagattatgagtttgattatgtcttcgactggacagttttgaaatacaaacaaggccacaaacaaaagcaaagtcctggggcacctattgctcgacctattcaagcacatggaccgaaacaagcaagtgtaa

SEQ ID NO: 76852 - DNA, 458 bp, Zea mays
  Clone ID: LIB3079-030-Q1-K1-E2
tgaccactgcctggaacacatcagcagcagagacagcccaatccagtacttcacaagcggaggcggttccaaggcatggagaggagtgcagaaccccaccgaagatgacctcaagttcttctacgacgggcaaggcttcatgtccctccagctagaccgtaaccaaaccaagttcaccttttacgatgtcgacgggaaggcgctgtacagttacacacggtcgagcctgatggaacaggccacaacttccaagcttccggttacgtcaacgaggaatgaagcaggggcgagtcaacatgcaccgcttggaaactgagatcgaatcagttcaagcgtacgtattaaatctcgagtgcttgatgtggttcatctgtcaagggcacatttttaaagtagtggttgtatcttttgtgttgaaatgtacaatgcattgggagcttaaaaaatggttgatgaat

SEQ ID NO: 76853 - DNA, 86 bp, Zea mays
  Clone ID: LIB3079-030-Q1-K1-E3
ttaccactgatctatacacatcatctttagttacagaccagttcaatactatactcgggcgggtcaatccaaaacctgggggggca

SEQ ID NO: 76854 - DNA, 132 bp, Zea mays
  Clone ID: LIB3079-030-Q1-K1-E4
atacaacatacatataaccatcgctatttcactacacacaaataaaatgcttaaacatgggcgggtaaattcaaaacttgggggcgcattctataccacaccttacaataccccattatataataccactat

SEQ ID NO: 76855 - DNA, 384 bp, Zea mays
  Clone ID: LIB3079-030-Q1-K1-E5
ctcgccgaccgcaccgggatgttcgcctgcccgcacaccggggtcgcgctcgccgcgctgttcaagctcagggagcagcgcgtcatcgggacgaacgaccgcaccgtggtcgtcagcacggctcacggcctcaagttctcgcagtcgaagatcgactaccatgacagcaagatcgaggacatggcttgcaagtactccaacccgcctgtgagcgtgaaggccgactttggcgccgtcatggatgtgctgaagaagaggctcaagggcaagctctgagcgcctgtgcctggctaatgcaatcaactgattggaatgcagtggtttcgtcggtatcggggggtcttttaggcttcagaaattctgtctgggttaggctatctgttt

SEQ ID NO: 76856 - DNA, 340 bp, Zea mays
  Clone ID: LIB3079-030-Q1-K1-E6
ctcacgcgtccgcccacgcgtccgcctacgcgtccgctagttctagatcgcgagcggtgcgtcctttatactagcacaggaatatttttttaataatttagaaatgaacttacttatatctgggtagccacctacatcattctaaaaacttgattattgcactataattcataacaaatctaaaagacggcactaccaatgatgggtagttactagaaagctggttgctttgtcaaattatgttagtataatagcaaccattgacgcagttgtaacagggttccaccgttacacgcatcttgctagtaaaacgggcacaactgtgctttttttaataacg

SEQ ID NO: 76857 - DNA, 455 bp, Zea mays
  Clone ID: LIB3079-030-Q1-K1-E7
cgttccggtattgaattctcggagtcaagccacgcgtcagcccacgcgtccgacctctagtaaaaactcacctctatgaacgtggatcttactattgctttgacccagaatcctgggacacaatacgcaaggacaactttgttctccactatgagatggtagagaaaaggccagttctgccttcaacatcaccaaaccttagatgaaaagaaaatctaggacggggagaggaacatagaaacatataacgatctgcaggaaggactaaggaggcaggaagtcgcagaacagaattggggatgtccaattaacaccccttgtaattactaaaactgtgagcgaatgttgcgtttttcttgcactccccccttcgccctcctaattaaactgcctaatgttcaggattagtttttctccagctttaaaataacaacgcatagattgttttgattgtc

SEQ ID NO: 76858 - DNA, 57 bp, Zea mays
  Clone ID: LIB3079-030-Q1-K1-D1
aataaattatcaaaaaaaaaaaaaaattatatattaaaaaaaaaaaaaaaaggacaa

SEQ ID NO: 76859 - DNA, 377 bp, Zea mays
  unsure at all n locations
  Clone ID: LIB3079-030-Q1-K1-E9
atggcgacagcagggaaggtgatcaagtgcagagccgccgtggcgtgggaggccggcgaaccgctgtccatcgaggaggtggaggtagcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctnctcaggatcaacgtcgaccgcggcgtgatgat

SEQ ID NO: 76860 - DNA, 237 bp, Zea mays
  Clone ID: LIB3079-030-Q1-K1-F1
gccacgcgtccggatgggagcggcgatgtcacattatagctccagaatatacgaccagggccgagaccgagggaaggacgggtcatattgtacaatcttgatccagctgctgagcacttcgactatcctgtagatatggatatcagagagctgatttcattggatgatgttatggaggagattggggtggggccaaatggcggtctcatctactgcatggagcaccttgaagacagc

SEQ ID NO: 76861 - DNA, 234 bp, Zea mays
  Clone ID: LIB3079-030-Q1-K1-F10
aaaaaaaaaaaaaaaataaataaaaattaaaaaagcaaaaaaaaataaaaaagaagaagaagagagaaaaaaaaattttgatcgcgagcggcctttctggcgagcttatactgtctttatttaggcttgcatcatcttgcacaccaacaagtattgtgattattgctccttttcagactttcatgctgatcactgcttttatttactctactgccattggttctcattcctcga

SEQ ID NO: 76862 - DNA, 392 bp, Zea mays
  Clone ID: LIB3079-030-Q1-K1-F11
ctgctatcctcagtggtgagggcaactagaaggtgcaggacctgcttctgcttgacgtcactcctctctctctgggtctggagactgccggaggagtgatgaccgtccttatcccgaggaacaccaccatccccaccaagaaggagcaggtgttctccacctactcggacaaccagcctggtgtgttgatccaggtgtacgagggcgagaggacccggacccgcgacaacaacctgcttgggaagttcgagctctccggcatcccaccggctccccgtggtgtcccccagatcacggtctgcttcgacatcgacgccaacggcatcctgaacgtgtctgccgaggacaagacgactgggcagaagaacaagattaccatcaccaacgacaag

SEQ ID NO: 76863 - DNA, 326 bp, Zea mays
  Clone ID: LIB3079-030-Q1-K1-B12
gctgcgtcaagtccacggttcgtacttttgaggcgcaatgtgggtcgttggcgcaggatgggatgaagcacatgcggtccttcgcaaacatctgcaacgctggcatccttcctgaagcagtgtcgaaggtcgctgctcaggcttgcaccagcattccttccaacccctggagttctatccacaagggttttagcgcctaagaatcataaggtgaggcgaaatatttcagccgctccaccgcaacgaactggtttacattaccagtcctcacgggggtcctagttcttgaaccatatgtgaagcagacttataccactattatagct

SEQ ID NO: 76864 - DNA, 208 bp, Zea mays
  Clone ID: LIB3079-030-Q1-K1-B2
cggcagtctgagttagtccgagtttaaggatagaaaatgtattttgtcctctttggggtagaaccaacaagaagagtggtgaatccctgacaacccgccgccgcgaaggaagaatccaaaatcggccgaatcccaaaggaagaaaccggggaccactcaatccccttgctattggggtacttattgaaccctgggcttagccccttac

SEQ ID NO: 76865 - DNA, 284 bp, Zea mays
  Clone ID: LIB3079-030-Q1-K1-B3
gggaccatggccaacgaacgccaatccaggtccggaggtgttggcaccttgttgagggccaacgccatgggtggtgagggccatcaggcccattcagctggctgtagctacgactgtggtggtggctgctgcagcagcatggtcatcgaatgctccaatgttaacaacttttactccatgtcctgcagctgtggctctaattgtggtcttggacgcagcagtggcatggtcatcgaatgctccaaggccaacaacgccatgttcgctagctctagctctagttg

SEQ ID NO: 76866 - DNA, 294 bp, Zea mays
  Clone ID: LIB3079-030-Q1-K1-B4
cttgcgtggttctcttcctgcgacggaagcaaacactgcccgagacatagacagcgggacgtcgagatggccgacggggaggacgccgccgacgcgcgccgccgggccgccatcacagactaccgcaagaagctgctcaactgcagggagctagagtcgcgcgtcggcaccgtgagagaaagccttaaaactgcaaagaaggattttaccaagactgaggacgacttaaagtctctgcaaaatgtggggcaaataattggagaagtactccgacctcttgataatgaacgcttt

SEQ ID NO: 76867 - DNA, 356 bp, Zea mays
  Clone ID: LIB3079-030-Q1-K1-B5
accacgcgtccggtaaaaccatcggctgctactacaagaataagagctcaagagtaggaaccatcaagcgtgagaccgtgaccttgcgattgcaagctgagatcaaccagatggtctcactcatgatcaacaccttctactccaacatggagatcttgctacaccagcttatctgcaactattacgatgcgctggacaatatcaggttcgagagtctcactgacaagagcaagctccatgcgcatcctgagctccaaatgcaccttgtcccagacaaggacacgaacacgctctgcatcatcgactgcggcatcggcatgaccatgtacgaccttgtgaacaacctctgtaccatc

SEQ ID NO: 76868 - DNA, 354 bp, Zea mays
  Clone ID: LIB3079-030-Q1-K1-B6
cccacgcgtccgatcaaaccctagccttctcctgcaagtaacagagctcaggagatggctccattgagagttagacggggaccttcttatttcaagctgacatcaaccatctgatcttactcatcatcaacaccttctactccaacatcgagatcttcctacacgagcttatctccaactcttacgatgctctgtacaatatcacgttcgagagtctcactgactagagcaagctcgatgctcagtctgagcttttcatccaccttgtcccatacaatgccacgaacactctctccatcatcgacaacggcttcagcatgaccaagtactaccttgtcaacaacctcggtacca

SEQ ID NO: 76869 - DNA, 326 bp, Zea mays
  Clone ID: LIB3079-030-Q1-K1-B7
gcgtgccaacatgcgggctaggaactacagcatccctgaagttgacaagttgaaggcgaagttcatagcgggaagaatcatcccagccatcgccacctcaactgcaatggccactggccttgtctgcctggagctttacaaagtcctcgctggtgggcacaaggtcgaagactaccggaacacatttgcaaacctggcaatccccctcttctccatggcggaacctgtgccacccaagaccattaagcaccaagacatgtcgtggactgtctgggaccgctggaccataaccggcaacatcacgctgagggggctcctggggtggc

SEQ ID NO: 76870 - DNA, 415 bp, Zea mays
  Clone ID: LIB3079-030-Q1-K1-B8
gccgaaagaagtgtatcggttcgtgcatgtgctgcgtgaaagacacgaggttgcctagtacgccaagatcttacagggagtcgagcacgggttcgcctgcaggttcaacaccaccgaccctttcgtcgtcaagaccgcagagacggccctcgcctacatggtcagctggttcaacaagcacctcaactgaatgaagcctgcactgtactcaccagactgaattcaataaaccactgcaatgctgtgatattacgtgtcgattcatggctccccacattgattcgtcatggctaagacctctactactggaatttccttcattctttgtctattcaaactctatgtattactgcatatgcttggtatgatcgcaataaagctcattaggggtatacacctcctggacgctttaaaa

SEQ ID NO: 76871 - DNA, 244 bp, Zea mays
  Clone ID: LIB3079-030-Q1-K1-B9
acgcgtacgcgtgggttttcccatcacgcatgccatcgagtacagtctctttttcgccaactgggggccatagaccagcgtgacgatggaggtccgcaccgacatgtacaacacctacctggacggcaccaaagactacctatctgtcggcatggcctctgtcccggcgatctacgcctacttagccgtctgctatgtcatgttcctggcaggttgactctacatcactctctacctcaaccga

SEQ ID NO: 76872 - DNA, 290 bp, Zea mays
  Clone ID: LIB3079-030-Q1-K1-C1
agttgcttcgcacactaaccgaagtcccaatcccaatggcgccaacctgccgtcctgggccggatgcggcgctcctgctgctgctgctgacggcgagtagcgtcggcgtcgcacgggcggcgccgcgggtgccggcggtgatcgtgttcggggactcgacggtggacacgggcaacaacaaccagatccccaccccgctgcgcgccgacttcccgccctacggtcgcgacatgccgggcgggccgcgcgccaccggccggttcggcaacgggcggctgcccccggacctc

SEQ ID NO: 76873 - DNA, 386 bp, Zea mays
  Clone ID: LIB3079-030-Q1-K1-C11
ctccgggccggcggcggcggcgccggaaagcgcaagaaggccgccgcgagcggcaagcccaagcgccctccctccggcttcttcgtcttcatgtctgaattcaggcaggagtaccaggcgcagcaccctggcaacaagagcgttgcggccgtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggataacgacgacgacgagtaaataggatt

SEQ ID NO: 76874 - DNA, 295 bp, Zea mays
  Clone ID: LIB3079-030-Q1-K1-C2
tgaaggttactggaatccttgctctgaaggaaggcaacccttcgaagttttcccagggggctcgtttgctcacagctgactatcaagttggttaatggttgtaccgttgtccgagtgttgatccacttaaatatattcgaatagcatatttttgtgacatggcatgctactggcatgaacctttgcaagtcatgggatggaagatcattttgggtttttgaaaacctttactatgtgcttctcattgatagcatgttgcacaaatgctctgatgtgttgctaccagagaaattag

SEQ ID NO: 76875 - DNA, 323 bp, Zea mays
  Clone ID: LIB3079-030-Q1-K1-C3
cccacgcgtccggactaattctgtttaaattatctttttcaaggagagagctctttgatcttcaagaaaggtagcatactttggcacaatttgctatggaagtggctagagaatcacaagtgaggaatgttgaaggatgaattggagcagaaaattaagtattggtggtgaggatgttgaaatctgcatggaaatttcctcaaaacctgagagcttcaaatgttattggctgcttcacgcgctctttgtttttcaaccatactgtgacttgtgttttgttctaggatgttgtggctataaacaagtggaggtttatggagcta

SEQ ID NO: 76876 - DNA, 59 bp, Zea mays
  Clone ID: LIB3079-030-Q1-K1-C4
cccgtcacgcgaacgccaccgctgccagcgtcggttacctacgctggcctgaggaaccc

SEQ ID NO: 76877 - DNA, 274 bp, Zea mays
  Clone ID: LIB3079-030-Q1-K1-C5
ctattggccgcactgaaccccgctgcttatttgcagcagcaaatactactacgaggtagccagctagctgcagcaaaccgtgcttgcttcttgacacagcaacagttgctggctttctaccagcattttgcggctaaccccgcaaccctattacaactactacaattgctgccatctgtccaacttgcttcgacagaccgagcgggctgctaccaacaacacatcattggtggtgccctctgttagattgcgtattgattgtaattcaatagta

SEQ ID NO: 76878 - DNA, 418 bp, Zea mays
  Clone ID: LIB3079-030-Q1-K1-C6
ggaaaagttacttctgcgggcatgttctttctaggctttcctgtgtatcggtgtgagcaaaataattcagctgctgctgcgaaggatcctgacagtgctttctttaaaagattggatggctttcaaccttgtgaagtaaatgaactgaaagcaggaagccattattttgctgtatatggtgacaatttctttaaaagtgcaagctatactattgaggttgtatctgctgaacccttctctgctcaaaaagagaagctactaagtgtggaagcaaagataattgcaaaacgatctgagctgtctaaatttgagtctgagtatcgcgaggttttggcaaagtttactgagatgactagcagatatgctcaagaaatgcaaacgattgatgaccttctaaaggaaaggaatgcaattcatg

SEQ ID NO: 76879 - DNA, 331 bp, Zea mays
  Clone ID: LIB3079-030-Q1-K1-C7
gtcatcgtgctacattgcatagcaaattgtaaaatcaatgttagtgctctgtgagtagttaagtgcatcatgcttagatatgctgctcagattaactaatgtacgatacaagtactgacaagtaatgagatagattgcacaaaatcatgaacttctttcaaattcatctgttttcttgctggtatacaaagaccaatatgagttatgcacgaaaattcatatgtttctgcttaaaagaagggaattcatttgtgaagtatgttatcttcagacttgcatatgatgattggtttctcgaatgatgtttctagggatgctcttatgtgaaata

SEQ ID NO: 76880 - DNA, 357 bp, Zea mays
  Clone ID: LIB3079-030-Q1-K1-B11
cttttccattggatcttaccgttgtggagtatgcatacgagaatttggttggtgcaatatcagattgattagaaggtgtagcttgtatgatttgtacgtataataatgtgctggatgtattgtaatacacggctatgcatattgcaacacctaccatttgccgttacctatcttgagtgcgtcctaaattgtaattgcagccaagcagcgaaatgtgtagaactaaagaaccctgagcgtcaaaaaaaaaaaatataaataaatgaatcaaaaaattgatatgataaacgcaaaaatatctactaatgaaatttccataataagttaaagggtccaaacttgttgggtttctaaaat

SEQ ID NO: 76881 - DNA, 367 bp, Zea mays
  Clone ID: LIB3079-030-Q1-K1-C8
cccacgcgtccgtagcaagcatgtatttgtggccgaagacactagaagtacctataggggatccctgaaaagcatcaaaaaggcctgttggaattctacttgtgaaggttgtgagagcccaaaatctgcggaagaaggatctgctgggtaaatctgacccatacgtgaaacttaagatgtcagatgataaacttgcattcaagaagacaactgtaaagcgcagcaatctcaatccagagtggggtgaagacttcaagtttgttgtgacagatccagaaaaccaggctcttgaagttaatgtcttcgactgggaacaggttgggaaacatgaaaagatgggaatgaacatgatcctacttagagaact

SEQ ID NO: 76882 - DNA, 315 bp, Zea mays
  Clone ID: LIB3079-030-Q1-K1-C9
cattaatcacccactctactactcgcagttactaccagcagcttgcttcaacagtcgaagagagcgagaggatggcgtcaccgaagccctcggcggcggccctgctcctcctggcggcggcggccgtgctggcactggcgcgcgcggacctgacgcaccacaactgcgtgaagaacaacaaggtgacggcgcacaacctgtgcagacaccacgtgacgctgacgctggaaccgctggccaacagcccgccgctgatcgcaggcacctacacgctggacccgcgcagtcacgccgagttgcccgtatgctcgtgga

SEQ ID NO: 76883 - DNA, 429 bp, Zea mays
  Clone ID: LIB3079-034-Q1-K1-G11
gcgaattcgatcggtcgggtacctgctgctagcgatatatagcagcagcagcagccagcagatcgtcgccggcacgatggccagctcgtcgtcgtcgtcgtcagctctggtcgtcctcgtggtggttctagccgcggcggtggcgtgctccgcgacgcgccccgtccccgcgcggcagcgggcggcggcggcggaggaggaggacgtgaggcggccggacacgctgcacgagggcacggtgctgatcccggggatggggcgctacgagatcggcagccactacattccggacatcggcgggctggaccacagcgttcccggcgccacccacgggcagttcatccccggcgccgacgacacctgggtgcccaacctcggcttcgaggtccccaaccccttccgacccggcgcggccactccatgaacact

SEQ ID NO: 76884 - DNA, 353 bp, Zea mays
  Clone ID: LIB3079-034-Q1-K1-G12
cccacgcgtccgaaaaaaaaaaaaatatataaaaaaaaaaaaaaataaaaaaaaaaaaaggaaaaataataagaaaaaaatagcctaaacaaaaaaaaaaaaaaataaataaaaaaaaatgagtaaatatatatagaaaggtcggctcctttcatggttcagacgtttatcaacttcgtttctggggtcttcattcttatttcgcgcaccctaatttgagtaagttgtccccttttaaaaaccttgcgtaatgtaaaaaatttgggtacccctagtttttccctttaggcacaaatcccttttcttgaattgccctaatctttgcacggcccataaatgtcggctttttaaaa

SEQ ID NO: 76885 - DNA, 218 bp, Zea mays
  Clone ID: LIB3079-034-Q1-K1-G2
caaaaaaacaaaactacatataaaactttaatttaaaaaaaaccaaaaacaaaaacgcacgtataatcaaccacataccaactacaaacatataactaaaaaaaaaaaaaatcttataaaaccctccatccttcactaaaccactataaacacattataaactccaatactcttcacccctctcatctcattccccacatttcccttccaacccttcc

SEQ ID NO: 76886 - DNA, 337 bp, Zea mays
  Clone ID: LIB3079-034-Q1-K1-G3
cccacgcgtccgagcaggtccatgggacgctctgtatggaggagggaataccccggcggtcggcttggcttccgtcttctacctggcagcaggtgtgctcgcagttctcaagctgccaaagctgtccaactcgtaccaatctgccgggttccatggatttggctgatgctcatgcccaaaacacccccgtctgccatgtaaaacatcacaccaacacttggccccattttgccattcgtttacagagaaatgattcttttttcctcgtacaactacagaataatgacagtgaaagtaggagtttaggtgagagaaagagagaggctaggtaggttga

SEQ ID NO: 76887 - DNA, 89 bp, Zea mays
  Clone ID: LIB3079-034-Q1-K1-G4
aaaaaaaaaaaaaaaaaatataaaggtttaaataaaaaaaaaaaaaaagggctgcacatgctagggatccaagtttacatgctccaagc

SEQ ID NO: 76888 - DNA, 410 bp, Zea mays
  Clone ID: LIB3079-034-Q1-K1-G5
gtattctctcactgcgataaattcctccgtctgtccttgcagcttatttcaaggtatgcaacatggctttcatgtggtttatcagcacgtaaagcttctgacaggagcccaaattcacctgcagatgctgaatgggcactgtctattcctatagaagatttcatatatgtaagttacatctgcaataatgtctgaactcgtcatgtcccaataggatctagcgtttttcattctgtactatggacctagctgcttaggactgaaattttgggtgctattgtcctatttattaacattattctatgtttctgtattaagtttatgcttagcttgaaatttctggagtttcgaagtagttataagatgactagttgcttcagaagtgctcagtaagtctgcaggaagtcact

SEQ ID NO: 76889 - DNA, 301 bp, Zea mays
  unsure at all n locations
  Clone ID: LIB3079-034-Q1-K1-G6
gacaaaaactacatatcagccttggcagcttttaagaaccgtgtcctgtatgcgaacgtctcgtacgaccacatggtcggctggcgaacgtcttcactaaggagagagaagaatcttataaagccctcacatcgttcactggatggctataagcacattgtgaatgtggaatactgttcgcccgtgtcatcggagggcccacatttcccttccaaggctgccagagctaaagaagctgcacagcgatcgccaaaccgagaaaataccgaggagtaccaccaaatgatggangaggagatgc

SEQ ID NO: 76890 - DNA, 421 bp, Zea mays
  unsure at all n locations
  Clone ID: LIB3079-034-Q1-K1-G9
gccgccttctcgctcgtcgccgtcgtcaccgtcgtgctcgtcgcggagccgcaccgcgtcagggtgctcggcagcgtctgcctcgccttctccatggccgtcttcgtcgcccccctgagcgtcatcttcgttgtgatcaggacgaagagtgccgagttcatgcccttcaccctctccttcttcctcaccctcagcgccgtcgcctggttcttgtacggcctcttcaccaaggacccctacgtcacgctcccgaacgtgggcggcttcttcttcgggtgcatccagatggtgctctactgctgctaccggaagcgcaagccggcgtccgtggtcgtcctgccgacgacgacggccgncgcagccgtggcacagcagctggaggcggagatggagctgcccctcgccgnccaccagcaccagc

SEQ ID NO: 76891 - DNA, 388 bp, Zea mays
  Clone ID: LIB3079-034-Q1-K1-H1
tgatcttttatgcagtacaaagcttccggaatcagtgaaattctacaacatttatgggattgattatgatactccacatactgtctgctatggcagtgaacagcatccggtttcaagtcttagtagcctcttatatgctcagggaaaatacgtctatgttgatggcgacggatctgttcccgcagaatcagcaaaggctgacggatttaatgcagtggcaagggttggggtggctgctgaccaccggggaatcgtgtgcagtcgccgcgtgttccggatcgttcagcactggctgcacgctggagaacctgacccgttctacgacccgctgagcgactatgtcatactcccaacactctacgaaatcgaaaagcatcgtgagaaacac

SEQ ID NO: 76892 - DNA, 432 bp, Zea mays
  Clone ID: LIB3079-034-Q1-K1-H10
ccgcaccccaatctaatcgacacctctccgagatgggccgcaagttcttcgtcggtggcaactggaaatgcaatggaaccacagatcatgtctagaagattgtcaaaaccctgaatgaaggacaggttcccccttcagatgttgtggaagtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcatggactaaaggtcattgcatgtgttggtgagacccttgagc

SEQ ID NO: 76893 - DNA, 513 bp, Zea mays
  unsure at all n locations
  Clone ID: LIB3079-034-Q1-K1-H11
tcgcccacgctgtcctggttgtgatatgatacctattatcttacaaaccagctgtggttgaatgtctcgctgggtcanntggctatgttgatacccaatcttgtcagaccgaagggagcctcttattgagtcttagtctattgggccattgaagccatccgagtaaggtctctaacaatgaaattctggagaattcatctttgtagaccaaatatgtaggtgggtccttcgtaatggtcatctcttatgtctgtttgtcaccaactcactcatcgtcgtgtgttcaatttaacttctgagtagataaccacgaatcgccagcaatgccttacgattcaacaagttgcatgcttcatacactcatgcgatcgccactcagcctggccaactcgtttcaagttgatgagttcgtgcccatgtcagtacgaatcaaattggtttttagtgccacgattatgaattgggaattactcttgttttctatttcgaagttctaatgatgaaatcaattgc

SEQ ID NO: 76894 - DNA, 412 bp, Zea mays
  Clone ID: LIB3079-034-Q1-K1-H12
cccacgcatccggcaggatatgatactttgcttacaaacagctgggtgaattgggctggtcatggctattgatacaactttcagacgaaggagctctatgatcttagttatgggcatgaaccaccagaaggtcctacaagatttggagattactttgtgacaaaatgtggtgtccttctaatgtcactctttgtctttttcacaaccaccatgtctgtttcatttactctgagagaaacacaatcccgcatgcttagattcacagtgcagcttcaacaccatgcacgccaccacctgccaacctttcagttgatattcgtgcatgtcatcgaatcattggattttgtgccgattatgattgggattctctggtttctatttgagttctatgatgatcaattgcttgcgtttc

SEQ ID NO: 76895 - DNA, 428 bp, Zea mays
  Clone ID: LIB3079-034-Q1-K1-H2
acgcgatcttttatgcagtacaaagcttccggaattagcgaaattctacaacattcatgggattggttatgatactccacatactggctgctatggcagcgaacagcatccggtttcaagtcatagtagcctcttatatgctcacggaaaatacctctatgttgatggcgacggatctgatcccgcagaatcatcaaacgctgacggatataatgcagtggcaacggttggagtggctgctgaccacccgagaatcgtgtgcagtcgacgcgtgttccggatcgtacaacactggctgcactctggagaacctgacccgttctacgacccgctgagcgactatgtcatacttccaacactcttcgaaatcgagaaacatcctgagaaacacctggatgtcacgttcgtaacggaagactgggagatca

SEQ ID NO: 76896 - DNA, 111 bp, Zea mays
  Clone ID: LIB3079-034-Q1-K1-H5
cagacgcgccctctaactgggcattaagacccgcccttttggtggttactcacagcgtgaccggtacacttgacagccacctagaccctgatactttcgatctctttactt

SEQ ID NO: 76897 - DNA, 437 bp, Zea mays
  unsure at all n locations
  Clone ID: LIB3079-034-Q1-K1-H6
gaaggacacaaaaacacaggtagggttaggcgacgcggcggcgagagcgcgagagtaggaggaggcgtcggccatgacggggaaggcgaagccgaagaagcacacggcgaaggagatcgccgcgaagatcgacgcggcgacgacgaaccggggcggcggcaaggtcgggcaggcggatcggctagggcaggacaaggggcgggcacgcgaagctggcgtgcccgctctgccgcaccccggcgcccgacatcaagtccatgcagatccaccacgaggcgcgccatcccaagctccctttcgagccggagaagctcgtcaacctgcactcctncacccccgccgccgccgaggccaccacctccaagcccaagcccggngtccgcggcagcctcaagaagtagctggctggcttgcctgcctgactgcctggggtaatt

SEQ ID NO: 76898 - DNA, 237 bp, Zea mays
  Clone ID: LIB3079-034-Q1-K1-H7
aaaaaaaaaaaaaacaaaaaaaaaaaatttataaaaaaaaaaaaaaagacaaaaagagtaggtacaaacataaaaacatgggcgattattgcaaatcctcccattctttctggctactgacttcgacttaatatgtcttttcatacaccacaatccattcaatttactcgccttggtacaccaacctgtttggtcagaacacggtgttgctcaccaacttggtctgcttgctcttcc

SEQ ID NO: 76899 - DNA, 421 bp, Zea mays
  Clone ID: LIB3079-034-Q1-K1-G10
ggagaggggaaaggcgagtcggcgtccgtccacgggagcttccctgcctctccggtccgcccccggttacctagcccgggccctgctacgcccatggcctcccgccgccgcacgatgagcacctctccggccgcgtccgccgccgagtcggctgcgccgactattgcctccgtcgtcgaggccttgagggcgacggacacgttggtggtcgacgagagggtcgcctcacacgaggacccggtcctagtagaggcgctcgacaaccctcgccaccggctcatggctctacgggtggaactggagataccaaactctatgcacaaccctcagctgcaggagttcgaattccagaactgtccgacttgttacctacgctgtgctggtcatcgtgttgcacaacattatggcttagagactatag

SEQ ID NO: 76900 - DNA, 386 bp, Zea mays
  Clone ID: LIB3079-034-Q1-K1-H9
cgacacttgcctgcgctcttgtctctttcctggcgaccactgggtgactgccggggcgccatggctgaggctgcatcttcaggcccttcactggctacgagcaccacctgaggattatggattgactggggcagaagcgcgccgatatgctcatggaggcgctgcttgcggcgcctgctgaggcagcattcgtcgtgggctacgttcgcgcggacttccaactcacgctgatagactacgccggcagcgtgcttctaacagcactggacactgtccacaactgacgctgcttcaagcgaaacccgcttaagtggctcgaccctgacgacgccgaacgccaccctggcccccatgtcagcgccggtgcagcagcaatgggaaagaag

SEQ ID NO: 76901 - DNA, 365 bp, Zea mays
  Clone ID: LIB3079-034-Q1-K1-E4
gcagctagttgctggtggtggtggtatcaagtctgtgaaagtgacctatgcatctgcgcgggcccctgatgatcttgacacgagacttctccgtgcaatgatcaccaagggattgattgaaccaatctccagcgtttttgtcaatctggtaaatgccgacttcaccgcaaagcagaggggagttcgcatcacggaggataggatcctgctgtacggctcacctgaaacacctatcgactacattcaagttcagattgccaatgtcgagtccaaatttcccagtgcgatatctgagactgtgagaaatcactgtggagggcataatgaaggatggtgttcctcatctaacaaaagttggagcattc

SEQ ID NO: 76902 - DNA, 440 bp, Zea mays
  unsure at all n locations
  Clone ID: LIB3079-034-Q1-K1-E5
cgcaaattgcaccaagaaatccatcgagaggccgtcgacaggggaattaatggggtcggcgtctagcagcagccaccggcgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctgaagaggagatgctgccgggagctggcggacatcccggcgtactgccggtgcacggcgctgagcatcctcatggacggcgcgatcccgccgggcccggacgcgcagctggagggccgcctagaggacctgccgggctgcccgcgggaggtgcagaggggattcgccgncaccctcgtcacggaggccg

SEQ ID NO: 76903 - DNA, 411 bp, Zea mays
  unsure at all n locations
  Clone ID: LIB3079-034-Q1-K1-E6
cggccctacttctgtctccacggctgccgacgagccgcgcggccgaactcactgcaggaggactcgcacagatcggtgagcgagcaagcgagagatggctgggaggctaaccgcggcagggtcccgcatcctgggcggcggcggcgcacgcgccgcggcttccgccctccgacaccgcgccggcatgggcctacccgtcggccgtcacatcgtccccgacaagcccctccccgtgaacgacgagttggtatgggataacggcacgcccttcccggaaccctgcatcgaccgccttgccccgcacatcggcaagtacgaggcgttggcgtggctgtgcggagggctagggttcttcgctgccctcggtatggctgctgttgtgaacgacaaggcctncaatataccatatac

SEQ ID NO: 76904 - DNA, 274 bp, Zea mays
  Clone ID: LIB3079-034-Q1-K1-E7
cccacgcgtccgcccacgcgtccgaccagaagctgactgtgtgatagatggacggaacgacgttcgaagacgacccgcaggacacgttcgagcaagagggtgatgaagaagactttgcagatgatgtcgatgagaactaagtctaacgatgcaccagtcaccttcctatggaagagtgtccatgtttaattctattgtactttgatgatgatactttttaagacactattgtctaaatgatgtaataaagttactctactctctttacgccttt

SEQ ID NO: 76905 - DNA, 436 bp, Zea mays
  unsure at all n locations
  Clone ID: LIB3079-034-Q1-K1-E8
gaaaggccaatctctagtggatgctgcttaccgaaaggcaaaatcattgaaggcggcgagcaaacgggcccctggtgcaaggaaaggaaagaaagagaagaatgaaaggcaacattctgagaaggctccgaacaggcatgaagagatgcgtgacctgttccaaaatgatatgagtgaatggaaacagggacgctcctcaaagaaaaataacaaatttgcgcccaaaaaatcaaggaactcttttaagagcaaagcaaggtacaagcggaagtagaagactcggccatctccgggtttatattacattcccttgtttcaattttgactgactgatcctgaagaaatatctgggatccagatgtttgcagttaattcaagtttgctttaaacatattctcatatcatgtattgaaactcaccgttttcaaaanaaaaa

SEQ ID NO: 76906 - DNA, 431 bp, Zea mays
  Clone ID: LIB3079-034-Q1-K1-E9
atacgtacccagattggcccaatgatcttgaagagaagcctgctgaggtttcatggtggatggatgctgtggagtctgctaaagcttatgggaatgacaatttcaagaaacaggactacaaggcagctctcagaaagtacaggaaagctctgcgctacttggatctttgctgggagaaagaagagatagatgaagataagagcacagcactgcggaagaccaagtcaataatactcactaatagctccgcatgcaaattaaagttaggagattcaagtggggctttattagacgcagattttgcactgcgtgaaagggagggaaatgctaaagcttttttccgacaaggacaggcacacattgcacttaatgacattgatgcagccgtggagagctttaaacaggcattggagtggagccaaatgatgctg

SEQ ID NO: 76907 - DNA, 229 bp, Zea mays
  Clone ID: LIB3079-034-Q1-K1-F10
actaggcgttgggttgtgccttttacttgtaccagctccggcactcaacacaggggaggcttatgtactgagagagagagagaaagatgtcagttgtagctcatcatctacacaaccagtctggtattctggcgtgggtaccgaacgatgtgttaaagatcttctgactgtctgacgagaactactgcctgtgcgttcgagacagtgccttagcgctggacgcagtcaa

SEQ ID NO: 76908 - DNA, 424 bp, Zea mays
  Clone ID: LIB3079-034-Q1-K1-F11
agccgccacgcacccgctgccggccaaaagccaatacgaatctccccgctgcgcggcggggcctctgcttacgcaatgcgggcctccgtcgaggaggccggcacgctcctggcgcggagcgactcagccggccgccgtcgtcgctccccgccgacggtgcagaccgcgtccccgaggcccggtagcctcaggcgccagtcgtcgctgatccgcgaggacatctggcacgccgactgcgagacttaccttgtatcgcgcctcaccttcaccctactgcagtacctcgggttaggtcaccgatggatgtcacaactgctttcactcacaatctatgcaattggacttatgccaggatttatacaaattggatattactattgattttcgagccaagtgcgtagaagtgtagtctatggagaccaac

SEQ ID NO: 76909 - DNA, 284 bp, Zea mays
  Clone ID: LIB3079-034-Q1-K1-F12
agatcggagagaagctccttccataattattgaaggttattgaacatatttgggagagtcactgtcctttggatgtctgctactcgtacaggtatagatctcgcattatggtgcactatgactctttgggacatacatatacatatgtgcaaactatacataccgagaatcctactcccagttcaatgactcgccagtaatttcagcatcgatatacatctggtacgactcattctaaatttaactcgtcttatgcgtcaccttaactttactgctatagctat

SEQ ID NO: 76910 - DNA, 116 bp, Zea mays
  Clone ID: LIB3079-034-Q1-K1-F2
aaaaaaaaaaaaaaaaaaaaaaaaaaattaaataaaaaaaaaaaaaaaaaaaaaaaaaagaatggaaaaatataatatattgtaaaataaaaaataataaaatataaaaaaaatta

SEQ ID NO: 76911 - DNA, 412 bp, Zea mays
  unsure at all n locations
  Clone ID: LIB3079-034-Q1-K1-F3
cccacgcgtccggattgaggagctgcctgccaatgttgctgaccttctgtgatcaatgtcaagaaaaaacaaaacaaaaaagggtggtgaggaacctggtaaggcttggttttgtcgaaataccgtgggagagggggtgataaggacggtggggtttctatgttgaagtcgtggtcatggacaatttgtgattttttctcctttatgccatgttttggaatttttgtagctgcctaggccttgtggtaatgtgctgctgtgggggttcattagtatgaagaggaagacgctgctggcgctgagtctttctctttattagtattttgtttaaaactatgtatgaccgaatggtggtatttaattgtgtcatncttgactcttattctgctgcaaccagatgtatcgtgccatg

SEQ ID NO: 76912 - DNA, 433 bp, Zea mays
  Clone ID: LIB3079-034-Q1-K1-F4
caacaagcaacatataaagtggcatccagtctcttcaatagagcaacaatggcgaccgagaggttttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggcaaacctttcttcctactctcagcaacaacaatttcttccattcaaccaactgtctacac

SEQ ID NO: 76913 - DNA, 431 bp, Zea mays
  Clone ID: LIB3079-034-Q1-K1-F5
cccacgcgtccgcggacgcgtgggcttacactgggagtgatggcaaatgcaagtgtggcaagtccaagattgttgcttcagttcagaacttcagtgttgtgtctgtggacgaggctcaaatttctgctaacctcatcaaacatgggccattggcaatcggcatcaatgctgcctacatgcagacatacatcggaggcgtgtcatgcccatacatctgtggcaggcaccttgaccatggtgttctccttgttggatatggtgcttctggtttcgcccccattcgcctgaaggacaagccttactggatcatcaagaactcgtggggcgagaactggggggagaacggatactacaagatatgcaggggttccaacgttcgcaacaagtgcggcgtcgattccatggtctctaccgtgtccgcagtccacgcc

SEQ ID NO: 76914 - DNA, 437 bp, Zea mays
  Clone ID: LIB3079-034-Q1-K1-F6
ctgaaagctatgatgactttttggcctctctcccagagaatgactgccgatatgcgcggtatgattttgattttgttactggggagaatgtgcagaaaagcaagattttcttcattgcctggtccccatcgacatcccgcatacgtgctaagatgctgtactccacgtcgaaggaccgcatcaagtacgagcttgacgggttccactacgaaatccaggcgaccgacccatcggaggtggacatcgaggttctccgggagcgggctcactgaagctggttctccttttgaagggacctgtggagggccgtgaaccttcagccagatgcaaattcaattatcaacgatgaagctcccgccgtggtgtttgttaataagttcctgtaagcatatcatttagtcgctatgcatgacactagctgaagcgctatctaagct

SEQ ID NO: 76915 - DNA, 322 bp, Zea mays
  Clone ID: LIB3079-034-Q1-K1-F7
ccgagcccttctatcacaagatgttcctatactcaccaagaataactgattgaagcgtgctgtgtcatatctgcaatcgctactcacaacactctatttaaaagcacgagcatcttgatattcttgtacacatcaacgtctagggtacatccttatactatgtacttcatctcccatcaccatattagatccaacctttacgtctactactgctataaaaactcgaccaatttctatgttgctaatatctctgatatcaggtcgcgctctgaatcaaactccaattccttatatttgcacttattgtgggtcgtcaatcttc

SEQ ID NO: 76916 - DNA, 437 bp, Zea mays
  Clone ID: LIB3079-034-Q1-K1-F8
gtatgactaagaagtgcctttcaaaattcctaaggaattgcttgttggcatggggttgaacagttggagtaacttacgcctgaccgctgagagttgctatgcagctacaggtgcattcagctcagctccggggcgaagccaggaattacatgtagggaggccggccgaaagagccatcttgtaaaaaaatgatcgcggttcaactggtttggttactcgcacttagcgtctgtctgagttaatacttgacaaaaaaaaaaaaaacaagcacagctcaactggttaggtttctcgtagtggtggtggtcgtttgggttaattcatcgacttgacacggttgctcctattttattttctatatgtattctagatagtgagggtttattggattttgatcgtagacgctaatcagaacctctactgaatggatgccttcg

SEQ ID NO: 76917 - DNA, 434 bp, Zea mays
  Clone ID: LIB3079-034-Q1-K1-F9
cttgctcttgccttctgttcttcacccgtttcagattttgaatcaaaggttttagtccgtaaggtgctgaagaagtgtgtcaagctgccagttctagctcatcatctagtaaaagagtctggcattctgttgtggttattgtctgttatttcagtccgtagcgaagtgtctgacggttctgaaagctcctgttctagagtaactgagttagcgttggaggtagtcaatggttcgatatcatcaagattgatcacagattggctccaagaaaccgcccttgagcagctctcaacaatatcatcatacctttctgttctaattaacaatgccaaattattgaaaggaaatgttcatttgttgacttcagctctaagtgtgattacatcaacaatgaggttgtctatgacaaggaagatataccaaccacattttac

SEQ ID NO: 76918 - DNA, 410 bp, Zea mays
  Clone ID: LIB3079-034-Q1-K1-E3
caggatgataggcctatagagcgaaagctttctaaccagcaaatttcttcaccaccagcgaactacgaagatgtcacaagagatggccaggacaatcttcacgatgacagaaatggaggaagtgttcctgctgctgtatcaagggtgccctctccttcagttcctgcaacaactgttcctgcagtacaggtgaatggggttcatgacagcactgttgaagatgtacctgcaccaccaactgctcatgccgagcctaatggatttgatgagtttgatccacgtggatctgtaccagattcttccccttctgtaaaccctgcatcagtagcgaatagcttggagatggatttggttggatcagatcctaatagttcgttggctttggtgtctgtgccttcaccaacgactac

SEQ ID NO: 76919 - DNA, 426 bp, Zea mays
  Clone ID: LIB3079-034-Q1-K1-C8
gccatggaaggaaccgacacctcttcagcttcacttataaagcaaaatcgtcagggaggttcagccttctgccactggaatgatcagcagagaacttattgctgatccagacccacccatacttccatcatcttcaagcctgaaatcgttgaccccagactctattgaaggaaaatctacacttcaccactatattaaggtcttccatgagtactatgtggagtacggacacaaggtgttcattgaactcaaggagcatgcggactatttgaagacagaaatggaagataaacagaaacgcttggaagcagtgaagaaatcacttatatccgtagaagccaaagatggagacatcaacaagaggatagatcgggccttcaaggtgtatgaactgttggagaagcgaatagatagcttcaagatgct

SEQ ID NO: 76920 - DNA, 431 bp, Zea mays
  Clone ID: LIB3079-034-Q1-K1-C9
gtggattacagctttgagtgcattggaaatgtttcggttatgagggctgcactggaatgctgccacaagggctggggaacctccgtcatcgtcggcgtcgccgcctctggccaggagatcgccacacgaccattccagctcgtgactgggcgtgtctggaagggaaccgctttcggtggcttcaagagccggacccaggtcccatggcttgttgacaagtacatgaaaaaggaaattaaggtggacgagtacattacgcacaacatgaacctggctgacatcaacgacgccttccacctgctgcacgaaggtggctgtctgcgttgtgtgctggcaatgcagatttgaaattcctaagctaagcagtttttgttttggaactagaactcctttttgcctcgttaggcctggacccgctgtataatgctatg

SEQ ID NO: 76921 - DNA, 320 bp, Zea mays
  unsure at all n locations
  Clone ID: LIB3079-034-Q1-K1-D1
ctttccctgtgactggcagaggatcaccgagatcgccggcgtggttgtctccttcgggcccaagccaattccgggggactggaatggcgctggtgcacacaccaactacagcaccaagtcgatgaggagcgacggcgggtacgaggtgatcaagaaggcgatcggcaagctgggcctccggcaccgggagcacatcgccgcgtacggggacggcaacgagcgccgtctcaccggccgccacgagaccgccgacatcaacaccttcgtctggggcgtcgcgaaccgcggngcgtcngtgcgggtggggccgcgacaccgag

SEQ ID NO: 76922 - DNA, 408 bp, Zea mays
  unsure at all n locations
  Clone ID: LIB3079-034-Q1-K1-D10
gttgatttggactgggagaacctgggttttgggattgtgcaaactgattatatgtatgttgctaagtgcgggacagacgggaatttttctgagggtgaaatggtgccttttggacctatagcgctgagtccatcttctggagtcctaaattatggacagggattgtttgagggcctaaaggcgtataagaaaactgatggatccatcctattatttcgcccagaggaaaatgctgagaggatgcggacaggtgctgagaggatgtgcatgcctgcaccctctgtcgagcagtttattgatgcagtaaaacaaaccgttcttgcaaataagagatggattcctcctactggtaaaggttctctgtatattaggcccttacttatgggaagtggggctgntcttggtctt

SEQ ID NO: 76923 - DNA, 364 bp, Zea mays
  Clone ID: LIB3079-034-Q1-K1-D11
tcgcaggaacacaccacgcgaagcacattatgtcttcaacctaacaacaatggctaccaggatagtatccctccttgcgcttcttgcgctttttgcgagcgcaacacatgcgctcattattccacaatgctcacttgctccaagttccattattacacagttccttccaccagttacttcaatgggctccgaacacccaactgtgcaagcctataggctacaacaagcaattgcagagagcgtcttacaacaaccaatttcccagttgcaacaacaatccttggcacatgtaacactacaaaccattgcaacgcaacagcaacaacaatttctaccagcactgagccacctatgcatggtgaac

SEQ ID NO: 76924 - DNA, 428 bp, Zea mays
  unsure at all n locations
  Clone ID: LIB3079-034-Q1-K1-D2
cgatcctatggagaatggtgatggtcaagatggtgccgaggagggcaacacatttccggatgaacaatatggttatccaaaagctgaatctgagaggtgggtttcctgcattaggatcttggatccaaggagtagggacacaacctgtctgctggaattgcaggacaatgaggctgctgtcagtatctgcactgtgaatttccatgataaggagcatggaactctactggctattggcactgccaaaggtttgcagttctggccaaggaggacccttgctggtggattcatccacgtatataagtttgtggatgaagggaggtcacttgaacttctacacaagacacaggtggaggaagtacctcttgcattgtgccaattccaggggcgattacttgcnaggtgttggtcagtgctcagactatatg

SEQ ID NO: 76925 - DNA, 357 bp, Zea mays
  Clone ID: LIB3079-034-Q1-K1-D3
atccatctaccacgcgcggccaaactcctgttcttccacctgctggctgctcctgccgcccgtgcgccccaaacccacccgcctcgccgtccccgcaggccgcagcctgctctcggctcccgccgccgtctaccgcgtcctgcggctgcggtgttgcgtcacctcgggttcgccttaacttccacaatcctcgccgtcctggtgctccgccgcccctccctttgtactcgcgctggagctgcagatccaccgcgacctggcgaccaattcctcctcccgctgaagaattggcgaccttggcctccgcccccgcggcgcggaggagtcaactgtggtagcaaccaccgcggaggctgc

SEQ ID NO: 76926 - DNA, 429 bp, Zea mays
  unsure at all n locations
  Clone ID: LIB3079-034-Q1-K1-D4
cggacgcgtccgcccacgcgtccgttttccccaaggcaaccaaaccatctcgattctggactggtggggaagtttcgctctcgccggcgtcgacggcctagggttcgaggaacgtccgtccgtccgtccggggaaggagcggtagggaggcggagatgatcgaggtggtgctcaacgaccgcctggggaagaaggtgcgggtcaagtgcaacgaggacgacaccatcggcgacctcaagaagctggtggcggcgcagactgggacgcgccccgagaagatccgcatccagaagtggtacaacatctacaaggaccacatcaccctcaaggactacgaggtccacgacggcatgggcctcgagctctactacaactgagccgncgnccctctctccctctcgtcagggtggtctgaattctgaagtcatg

SEQ ID NO: 76927 - DNA, 146 bp, Zea mays
  Clone ID: LIB3079-034-Q1-K1-D5
gcgtgacctaaaaaaaattgactggacctaatttaacaacgttgcaactgataaacccttgccgaaaccgaatataatcgactagcagcacacccatctttcttcccaacacttaatcaccaaaaatcgccaacggaacgcccttt

SEQ ID NO: 76928 - DNA, 426 bp, Zea mays
  Clone ID: LIB3079-034-Q1-K1-D6
ctgaaagtaggatatgtgagtagtgattttggtaatcaccccctttcccatctgatgggatcagtatttggaatgcatgatcgtgccaatatcgaggtcttttgctatgcactcagtcaaaacgatggtactgagtggaggcagcgtattcagtctgaggcagaacattttgtcgatgtttctgccatgacttccgataatatcgccaagcttatcaatcaagacaaaatacaaattttgataaatcttaatggctacacaaagggtgccaggaacgaaatttttgcaatgcagccagcacctatccaagtttcgtacatggggttccctggaacaacgggtgctgcatacatagattacttggtcacagatgagtttgtttctccatctagctatgcacatatatattcagaaaagctcgtccat

SEQ ID NO: 76929 - DNA, 227 bp, Zea mays
  Clone ID: LIB3079-034-Q1-K1-D7
tcctctaacactctcatacaaactcttggattttcaccttctccctgctccttacggcacggctccctaaacccacccgcctgaccgtcccccatgcctcaaccttctctcggcttccgtcaacatctacctactccttcgtcttctctgtttcatcacctatcattccacttaactttcacaattctcatcattctcgtacttctccaccccttcctttatactca

SEQ ID NO: 76930 - DNA, 375 bp, Zea mays
  Clone ID: LIB3079-034-Q1-K1-D8
tggtaagttcatgctatttcgacattttcacgggctgaaactttaaggtagggttgggttcctgagtcggttgggatggagcagctccgtcctagagattttagggaggctgatcgttcaacatttaaacacttgttagagtcactctatcctacatggaaccaattcaaacaataacaattgagagcggagcagctccgtcccaccatgcttcagtaccaaacactatctaagtaaatcctgatgtaccacatcttcattgcttgaacagagttgagatgagttccataggagtttgttgtgcaattgatccctcagcatgctaataagcaatgtgctttcttaggagtttgagtaaagcagtcaattttattc

SEQ ID NO: 76931 - DNA, 338 bp, Zea mays
  Clone ID: LIB3079-034-Q1-K1-D9
tcggagcctgatacgctattcccgttcagagtttacctaaacgatacttctcataacggccggaagcctaagatgcagaaaatctcagtactaagccgtagcttgacagatatgctgatgtccatgttgacattcgactgagatgaacatatacacgaatgcaattaacgtccacttacatacatctgatgaatcctaagatgacatatgtcttacaccttctgagattccccttttaacacatccaacttgtgaaagaccatctttatacgccaccatgatctcttgcagctaatcaaaatacacatggatcacgattaacacgaaaagatgatgaa

SEQ ID NO: 76932 - DNA, 312 bp, Zea mays
  Clone ID: LIB3079-034-Q1-K1-E1
gttctagatctcgagctgcctccctttttttttttttctttttcattttaattaatggggattgatttattataaatatttgcctgttcttttattattttatcttatttcttctttaatttttatttctcatatttttcatttattattcttttataatttttcttatattcttttttcatttttaattataaaatttttaaatttctttttttttttttaatatttttttttttctatcttttttatctttttatttatcttttctttttaattaattttttcttttcttttttaaatttttatcttttt

SEQ ID NO: 76933 - DNA, 438 bp, Zea mays
  Clone ID: LIB3079-034-Q1-K1-E10
ctttcctcaagaagtcgattcccttcctcaagaacccaagccctcaccatgacaggctggtcctctccttcccgaaaggcgctgagcaagatcgcttgcaatcggctgcagaaggaactcgccgagtggcaactcagcccccctgctggattcaagcacaaggactccgataacctacaaaggtgggtaattgaggtcactggagcggcggtcaccctttacgccggcgagacctaccatttgcatgttgactgccctgagcattatcctatggaggcacctcatgtcattactctcaatccagcgccaatgcatccacacatctacagcaacgggcacatctgcttagacattgtgcatgactcgtggtctacagcgatgaccgcgagctctgcctgtatcagtatcctgtctatgttcgctaattcgccagcaaaa

SEQ ID NO: 76934 - DNA, 113 bp, Zea mays
  Clone ID: LIB3079-034-Q1-K1-E11
aaaaaaaaaaaaaaaaaaaaaaaaaaaattaaaaataaaactaatgaaagataacagtgggggttcaatccttaccaaaatgctgtaaacgattatctatcgctatctaggtg

SEQ ID NO: 76935 - DNA, 424 bp, Zea mays
  Clone ID: LIB3079-034-Q1-K1-C7
gggttggaaggaaccggcacctcttcagcttgacttagaaagcaaaatcgtcgaggatgtggagcctcctgcaactggaatgatcagcaaagaacttattgctggtccagacccacccatacttccatcatcttcaagcctgaaatcgttgaccccagactctattgaaggaaaatctacacttcaccactatattaaggtcttccatgagtactatgtggagtacggacacaaggtgttcattgaactcaaggagcatgcggactatttgaagacagaaatggaagataaacagaaacgcttggaagcagtgaagaaatcacttatatccgtagaagccaaagatggagacatcaacaagaggatagatcgggccttcaggtgtatgaactgttggagaagcgaatagatagcttcaagatgc

SEQ ID NO: 76936 - DNA, 356 bp, Zea mays
  Clone ID: LIB3079-034-Q1-K1-E12
gccaagatggcgaccaaacacctggctctttgcctccttgttctctttagcataggcatgggcatggccaccgctgctgcaaaccgcaaactgggttatggccccgggggaggaggtggcggtggtggtagcggtggcggtggaggcggtggttacggaggaccaggctatgggtccggatcagggtatggtgagggcggtggcagcggaggtgctgctggagggtatggacatggtggtggcggcggcggcggtggtggtgagggtgcgggagctggtggctctgggtatgggtccgggcaaggatctggctacggagctggcagcaatgctgccggtggatatgggagtggcgg

SEQ ID NO: 76937 - DNA, 137 bp, Zea mays
  Clone ID: LIB3079-034-Q1-K1-E2
aaacagagaggacatgccatgtgtagcgtacaatagttttgactggttcgcacagctggtacagaaatactgtattgatatggacggcacgccggaggcagtgacaccaatggattaatacttgcaatattttcctg

SEQ ID NO: 76938 - DNA, 297 bp, Zea mays
  Clone ID: LIB3079-021-Q1-K1-C11
cccactcatctcttgtatcacataccattattgccttttttcttttgcgtgaccaaataattacagcgggaatatcttttaccttgtttggcatcttccacataatcaatttaaacctccacatttggggctaccacaataataattattatgatcaccacaataattcctattttcaccacattaattattaagttgatcaccacattatatacttcttatagcacattgaaggcatcttgtataatatcaagtacaatatcaccgtctaacactgctactagttcttctaccaca

SEQ ID NO: 76939 - DNA, 352 bp, Zea mays
  Clone ID: LIB3079-021-Q1-K1-C12
ccgtcactcaacacagcacaggcagctcgagagagagagagagagaaagatgtcgtgggtggggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttc

SEQ ID NO: 76940 - DNA, 427 bp, Zea mays
  unsure at all n locations
  Clone ID: LIB3079-021-Q1-K1-C2
gccggggctgctgctgtccacggtgagcacgctggacacgctagggctcgacatccagcggtgcgtcgccagctgcttcaacgacttccgcatgcacgcctcctgctccgagatgcagagggaaatgatcagcgccgacgcgataaagcaggagctgttcaagaacgctggctatggcggaggctgcttgtagaggggcatgtcatcatggcatgggaggaagaagaagaagaggcagcaatgaattaatcttaagcagctgtgggagcagcagtcgtagtatcagttcaggtccagtagcggaaaaagcaggcagggcaaagatttgggaagcctttttgcaatccatcntccccatcataacccacttcgatctatccattgtagcagtacgtgtccgtacgtcctatagcatcatgcaggatgc

SEQ ID NO: 76941 - DNA, 325 bp, Zea mays
  Clone ID: LIB3079-021-Q1-K1-C3
gggtcaactattgaatcagataacaatctaaataggtacagtagagtgcacacaagtggcaatagaagaacaataatcacgctgaataagtgggccccacatcacaatcctgcacatgattttaccatcttattcttaaaattattcttggaacaattggatctatatcattaaaagatccaaactttagatatataccatgaaccccacatgtcattgactcatgtggacccacatgtaagtgagatagtaatggtatggatccaaagtggtgatcttttaatggtatggatccaaatttcccattattcttttatgaacatta

SEQ ID NO: 76942 - DNA, 372 bp, Zea mays
  Clone ID: LIB3079-021-Q1-K1-C4
cccaaatcctctactagtatatcgggtttctattgcactaactggcattaatactacgctgaaatcactggacagcattaccgatccaagcacaattctaactctacataagagcgcctcacatcacaatcctgcacatcattttaccattttattcttaaaatcattattccatcaaatctatctatatcattaatacatccaaactttagatatataccataaacctcacatagtcattcactcatgttgacccacatctaaatgagatactaatggtatggatccaaaatggcaatcttttaatggtatcgatccaaatttcccattattcttttatgaacattatacttatcaagtcctacccattcc

SEQ ID NO: 76943 - DNA, 390 bp, Zea mays
  unsure at all n locations
  Clone ID: LIB3079-021-Q1-K1-C5
tccggacagcccgcagccccttctttttcatccgccttgctacaaccgcgtgcgcggacgcctcctccaggaaagcgagagcttctgcataagaacaacaacaaaagcttgatcagcttgggcctacaaaacctcaacaacncaagttatgtctgatctcgacgccagcttccatctgcctttgatccgttgctgagcaaatgctgagactctggtgctggtcctggaacgaagatatctgcatgtgcgcatcagcagcgcncggcagacagagtctgactacagtgaaggtctgaaaaagagttagcttcacaagatcctaaggatctgaaaaagaattctgctgcaatggtactgcagttcaggacccagagctaggccaggtcattc

SEQ ID NO: 76944 - DNA, 378 bp, Zea mays
  Clone ID: LIB3079-021-Q1-K1-C6
ctccccttggcagccagtatgacagattcaccatttctgccacgtgagaggctcgtgaagctgcaacatcatttccagaacatgaccaagctcacctacctgaaagggcgctacgatgtgatcacctccgatgccatctctcttgcacttgctgactccagcatgttcatgattggtcgtatagtttacaacatgtctcatggaattgggaaataggagttatctaccacgtgttaactagtatgactacttggcatggaagttccatccagactatgaagtcttctttgcttgctcaataatactgtcaaagaacaagttgactacatacatgcatcatatttctgtttgcatatgatgatactaaatgccatctac

SEQ ID NO: 76945 - DNA, 419 bp, Zea mays
  Clone ID: LIB3079-021-Q1-K1-C7
ctccccttggcagccaggatgacttattcaccatttctgccacgtgagaggctctgtaggctgcaacatcatttccagaacatgaccaagcacacctacctgaaagggcgctacgatgtgatcacctcctttgccatctctcttgcacttgctgcctccagcatgttcatgattggtcgtagagtttacaacatgtctcatggaattgggaaaaaggagttatctaccacgtgttaactagtatgtctacttggcatggaagtaccatccagactatgaagtcttcagtgcttgctcaataatactgtcaaagaacaagttgactacattcttgcatcatatttatgtgaatatgtgttgatattaaatgccatcaacttgaagatcagcattgttactattttggtttaatactccat

SEQ ID NO: 76946 - DNA, 435 bp, Zea mays
  Clone ID: LIB3079-021-Q1-K1-C8
ccaagatattagccctccttgcgcttcttgccctttttgtgagcgcaacaaatgcgtgcattattccacaatgctcacttgctcctagtgccattataccacagttcctccgaccagttacttcaatgggcttcgaacacctagctgtgcaagcctacaagctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacagcaggtgcttgcatccaacccacttgctctggcaaacgtagctgcataccaacaacaacaacaattgcaacagtttctgccagcgctcagtcaactagccatggtga

SEQ ID NO: 76947 - DNA, 188 bp, Zea mays
  Clone ID: LIB3079-021-Q1-K1-D10
cctgggcaaaagccacattaggacacgaatttaaatccaactaacacccacataccacttacagtcattaatcgtggtttcacgactaaacgcgacaagagccaatgtctgacgattgctgaccgacatgtacatgctgtaaaagatcccaatcagcttctaacaattctacatgatgactatgaaca

SEQ ID NO: 76948 - DNA, 232 bp, Zea mays
  Clone ID: LIB3079-021-Q1-K1-D11
cggctgcttcggtgagccgtgccacggaatcgggagctccaagtgggccatttttgggaggcagaattaagtgaaaaatagacataaagttcatccttgcagttactaaacatgaggacgaacaccttcaagtgatgttgcttgatgtatatttatgacacaacagtgtcgtaaattaaaaggagacgatcactgcgtttggaacaaattgtttgctctgataagtttgatt

SEQ ID NO: 76949 - DNA, 397 bp, Zea mays
  Clone ID: LIB3079-021-Q1-K1-D12
gcgcaaggagcaacggacgttgctgatgagacaacgccagcacgtggtcatggtctggaggtcgcgaccgggatgctcttcacgaggaagagcttgcttccagggacagccctaccggaaggtaccaagttctgcggccacggcttcctcgatcccgagaggtttgaactacgagcggatgcggatgccatcccgttcagctacagccagctcgacaccatcctgaggatgtttcggatccctcgggggtccaagaaggcagagcaagtcgccgtcacgctccggacatgcgaggctgagtccccagaggctcatgcctgcgccacctccgagcaggcggcggccgacttcgctgcctcctcgctcggggtcagggccagcaagctggtcgcgctcg

SEQ ID NO: 76950 - DNA, 358 bp, Zea mays
  Clone ID: LIB3079-021-Q1-K1-D2
attggaccccgcctgagggtgctggacagtttcatggtgtacccttggatgttaagggggttcatttcaaaggttccagaaagcgattgatgcttgaggcatggaatttctacagctcaacctctaagctgtctgatatgctatgcctaatcttgagaagtggccggacgaaatatgacttctgaacttttgggttaaaactgacacatgttgatactgttcaaagctgttgtatgttcaagtatagtacaaaaaaatgctgaccatgaggctgtcattgcaagaattcagatcagcataaaaaattgctagtagcattcaatatgtaacaaaaacatgtgagaacccatacgagaac

SEQ ID NO: 76951 - DNA, 370 bp, Zea mays
  Clone ID: LIB3079-021-Q1-K1-D3
ctcctccccctccggttcgggttcgggttcgtgaggttctccggggttcgggttcgggggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcggcggcggtgggtacggtggt

SEQ ID NO: 76952 - DNA, 295 bp, Zea mays
  Clone ID: LIB3079-021-Q1-K1-D4
cgattgcttcctccaccgaggcgggggaaagcgccgcccagatcgccgtaggcaagcggggatcactccagctttgagcataagggaggctcgtgaagtcagtagtcgtatctggcagtggcagcacagcgcaccatggaatggctgagctggagaacggtgtgttgtttatcagtgctgtgcaccgtgctgttcttgcgcccggtcgagggcattcgctttgtgatcgatagagaagagtgcttctcgcataacgtggagtatgagggggatactgtccatgtatccttcgtcg

SEQ ID NO: 76953 - DNA, 403 bp, Zea mays
  unsure at all n locations
  Clone ID: LIB3079-021-Q1-K1-D5
ccggccccgtcgagcgcctcttcttcttccgccacccggagccggcctccactctggcgctcctccgctcctcgctctccctcgcgctccgccgcttctacccactcgccggcaccatcaggccccacgcgcccttcctctgctcctacacccatggtaccgatgccctcaccatggtcgtcgccgagtcgaacagccccgacgatttcgacagcctcgtagccaggtcacgcagggacctggacaggatccgccccctcgttccgcagttgccgccgccgggggaagacggagcgttcgcgctcgccgccgtgcaggccactgtcttccgaggccgtggcctctgcctcggcgtctccgtccaccacgctgcctgcgacgatgcctncaccatgcatttcgt

SEQ ID NO: 76954 - DNA, 367 bp, Zea mays
  Clone ID: LIB3079-021-Q1-K1-C10
gccttatctcagacgtgcaggaccaagtagttatgattcactacggcgttccatccggaggcattcatcagaactctgaggcttcacagcatcttggcgcacgaccagcaccagcaggcggcaacaaatgacacagcaccgatggcgttcgttccggtgtgcgtgcagtgcggtacgcggagcaacccgtgccggtgcatggtggtcgggccgacgctggggttcctcgcgttcgtggtggccggagtcatcgagtggccgatgggggccgacgtgtacctgttccgtcaccgcatgggactacgcatcatggcgcacccggcctgcgtcgtgtgcccgggcgttaccagggccattccgatctaat

SEQ ID NO: 76955 - DNA, 363 bp, Zea mays
  Clone ID: LIB3079-021-Q1-K1-D6
tcgcgcctctctacgcctcggttttacccaccggaccccctccatgtcgcatcattcatcctgggtctgctccactccgcccttctacccactcgccgcaccatcaggccccacgcgcccttcctctgctcctacacccatgtaccgatccctaccatggtcgtcgccgagtcgaacagccccgacgatttcgacagcctcgtagccagctcacgcaaggacctgtacaggatccgccccctcgttccgcagttgccgccgccggtggaagacggagcgttcgcgctcgccgccgtgcaggccactgtcttccgaagccgtggcctctgcctcagcgtctccgtccaccacgctgcctgcgac

SEQ ID NO: 76956 - DNA, 356 bp, Zea mays
  Clone ID: LIB3079-021-Q1-K1-A3
aaaaaaaaaaaaaaaaaaaaaaaaaatttatataaaaaaaaaaaaaaaaaaaaaaaaaaggaagaaaaaaaaaaaaaaaaaaaaaaaaaaacatacaaatatagtatatccattcttactttcccatcctttctatccccttacactcttctttaatattcacctaaatttaacttacctaactcaatttttcatacccacattttttccaaaacccctctgttaacccactttattcccctcccttaatatccttttttcacaacctcttttaacagcgaacagtcctttccaaaaaccctttcccaactgttctttccaccttattcgcaactttaactccccatttgcccgcc

SEQ ID NO: 76957 - DNA, 296 bp, Zea mays
  Clone ID: LIB3079-021-Q1-K1-A4
cccacgcgtccgcccacgcgtccgcccacgcgtccgggagaacccagccgcggccaacagcgccgagtccgacgggctcggccgcttcgccgtcgatgagcacaacaggcgcgagaacgcgctgctggagttcgtgcgcgtggtggaggccaaggagcaggtggtggccggcacgctgcaccacctcacgctcgaggccgtcgaggccgggaggaagaagctctacgaggccaaggtctgggtcaagccatggctcgacttcaaggagctccaggaattcagccacaagggggacg

SEQ ID NO: 76958 - DNA, 278 bp, Zea mays
  Clone ID: LIB3079-021-Q1-K1-A5
acttcgtcttaattcccggctggacgccactcctccgcagcactctgctcctaacgctggttctctcttacaactgcaacaattgctgtcattcgacctacttgctttgacaaacccattatcattctaccaacaacccatcattgattgtgccctcttttacatctcttatcatttataaatcattactaaacccaaccttactcatctttgagaatatccacatattacaaactacatttataacaaataatcctttacctatcacccttcccaac

SEQ ID NO: 76959 - DNA, 231 bp, Zea mays
  Clone ID: LIB3079-021-Q1-K1-A6
cccacgcgtccgcataaatcgaacccttgttgctatcggattttcatggattggggcgggttgcacttaatgttctatatatagtactcaaaactatgcttggtgtctgagtgatgtacgtggaattctgaaactatggatcagctcttgtgtgcacttgctgaaccagatacccagcagtaagcttttgtatgttcgttttgagtggttggttaaccacatacttgttac

SEQ ID NO: 76960 - DNA, 395 bp, Zea mays
  Clone ID: LIB3079-021-Q1-K1-A8
cccacgcgtccgtgcaactccagtgctgctcactgccactgccagcagatcgagctggtccgtctcacaaaccctcttgctttgctgctgcacctgcaagtctgcaaccgcgcacacagagatgtcgacgacggtgagccgtgcgtccctcgaccagaagctcgccctcgccaagcgttgctcccgagaggcgaccctcgccggagccaaggcggcagcggtggcgactatcgcctccgcgatccccaccctggccagcgtgcggatgctgccatgggccaaggccaacatcaaccccaccggccaggcgctcatcgtctccacggtggctgggatggcctacttcatcgccgccgacaagaagatcctgtcgctggcgaggcgccactcgttcg

SEQ ID NO: 76961 - DNA, 412 bp, Zea mays
  Clone ID: LIB3079-021-Q1-K1-A9
cgccggcgttcgctcctcctctccgactccttcctcgggcaccgtggtgttcttcgtggagagggcaggccggaggcgcctgatgctgatcagcctggtcggaatcgtcgtgtggctcgccgtgctcggcggcacgttcctgggcgccgcacaccacgccccacccgtcagcgacctggagacccgactgttggcgaaccagaaccagacccagacccagacgtgtcccgagttcaacccgaacgtccgctggagctgcatggactgcctcaaggccgcgtacacgtgcggcttctgtgctcaccagggagacaagcttcttccgggggcgtgcttggcgctgaacaacgcgtctcggcatgcgtgccgcgcagaccaccgggagttctacacggaagggtgccccaacaac

SEQ ID NO: 76962 - DNA, 61 bp, Zea mays
  Clone ID: LIB3079-021-Q1-K1-B1
ccaagattgataacactcatctttcaacctatcaatatagtagtagttctttctttagagg

SEQ ID NO: 76963 - DNA, 360 bp, Zea mays
  Clone ID: LIB3079-021-Q1-K1-B10
cgcacatatctactatactatactctaggaagcaaggacaccaccgccatggcagccgtgtgcttgcattgttcgctctggtagctctttgtgcaagcgccactagtgcgacgcatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtccc

SEQ ID NO: 76964 - DNA, 419 bp, Zea mays
  Clone ID: LIB3079-021-Q1-K1-B12
cggataactaacatccttggtggtgataagagaagacagagaaccctgaaacttcctggggagctcaagggaacaatgaaatctttacgcatattgtcgggggttgagattgtggagggatcaacagctgcatcagacttcagttacttcactactctgaggaagctggcaatttacaggatccaccacaatgaagatatattcaaaaatttgctgtcctcgatccagtacctcagtggttattcactccaaactcttttaatcgttgatgagtcatctgaattcttcaagaccctggagtcaatgtcgccatcccatctaactgacctgagagctctggagctgtctggcaaattgctttaccttccaaagtggctcgacactcttcaacatcttgtgaagttaacgctttcaacaac

SEQ ID NO: 76965 - DNA, 413 bp, Zea mays
  Clone ID: LIB3079-021-Q1-K1-B2
atataatctctcttcgtcactagctcgtggtaataagggaagcttgatcatctttccgtacggcggtgatgaagagcagcacaatcgtcgcgcttctgttggctgttgccattctgtcctcgctgtctccatgctacgaagccggcggctgcatcgggaaacccaagaagtcaccgccgccgccgagaaggccatacctctcgtcctattccgaggaccaccagaactgccgcttgatctgtagctcgaagggtttcaaggacggtggctggtgtgacgaaagcgtcgagcacaaagtgtgctgctgctcccattagaaatataatatcgtatggtatgttgatgcatatatatgcatcatccatctacctgtgtggtgcaaaattctgaataaaactacctgtgtggtgcat

SEQ ID NO: 76966 - DNA, 357 bp, Zea mays
  Clone ID: LIB3079-021-Q1-K1-B3
cggacgcgtgggtaattttgtacattatgaatgtgttgtaatgtattaatctgtgcgagtagaaagatttttgactaaaggtgtcaatttggaggtgtaactgtacgttaatactaaacgcgatgccattgcaatttcagttttattttgaaatacatggggttttagtggcaaaaaaaaaaaaaaaaaaaaaataaaaaaaaaaaaaaaaaaaaaaaaaaaaaaaaaaaaaaaaaaataaaaaaaaaggaagacaattaaagacatccaatattaacgacaaaagccatgagaacaaaaaagtaataatggtggcctcctaaatgtaattacctttcctatgttgaacaatatata

SEQ ID NO: 76967 - DNA, 419 bp, Zea mays
  Clone ID: LIB3079-021-Q1-K1-B5
cccacgcgtccgcaatggccaacagaactgtgattgtagacaataacacctggaacgacactcatatagcaacagttggtacagcaatgtcgtccccagaaaaagcagcttgggaaatcttcaattctttagatgtcaaatatgtgcttgttgtctttggaggacttgttggataccctagcgatgatatcaataagttcctttggatggtacgaataggaggtggtgtgttccctcacattaaggagccagattatcttagggatggtcaatatcgcgttgatgctcaagccactccaactatgctgaattgcctcatgtacaagctttgttactacaggtttgtggagactgatggaaaaggctttgacagagtaagaggatatgaaataagaaagaagcatttcaagctaacacat

SEQ ID NO: 76968 - DNA, 348 bp, Zea mays
  Clone ID: LIB3079-021-Q1-K1-B6
caggaacaaggaaaaatgagtccatctttggtgagcttcacacccagattaagaacaagaaattgacagttgatgtcaaagcaaactcagaatcagatcttttgacagcaatcactgtcgatgagtttggtactccagggctaaaatcaattatcaatgtggttgttgcagaccagagttcagggaagcttgaattccagtacctacatgaatatgctggtgtgaatgcaagcgtcggacttaattccaaccctatggttaacctttctggtgcctttggaagcgaagcactatcagtccaggttgatggctgatttgataccgcgactagcgattttaacaatgaca

SEQ ID NO: 76969 - DNA, 280 bp, Zea mays
  Clone ID: LIB3079-021-Q1-K1-B7
cacaaacatgcaataatgacaacatttttggtgatctacacactcacatttagaagaacaaatatacagctgctgtcgtagcaaacttataatcagatctttagacaacatttactgtctatgactttggaactccaaagctaataccaattatcaatttagttcttccagaccacactacatgtaatcttgaataccacctcctacatgaatatacttgtagttaatgcaatctattaccttaattccacccctatttttaacctttctgattcctttg

SEQ ID NO: 76970 - DNA, 402 bp, Zea mays
  Clone ID: LIB3079-021-Q1-K1-B8
gcctcgcccgcccttcgctcgccgccgccatggggaggggaaagttcaagggaaagcccaccggccgccgcaacttctccacaccggaggagatcgctgctggtacttcaggtcgccctcgcacctttaagaagaaggaggaagaggaagaggaggaagaagaaagagaagagtcagaggaggaagaatctgaagacgagtctgatgacaaacctaaacataaaggtactgagggtattattcagattgaaaatccgaacttagtaaaagtgaagaatataaaggccaaggaagttgatcttggaaagacaactgaactctcaaggcgtgaaagggaggagcttgagaaacaaaaagctcatgaacgttatatgaaacttcaggagcaaggaaaaacagaac

SEQ ID NO: 76971 - DNA, 385 bp, Zea mays
  Clone ID: LIB3079-021-Q1-K1-B9
cgcacatatctactatactatactctaggaagcaaggacaccaccgccatggcagccgggatgcttgcattgttcgctctcctagctctttgtgcaagcgccactagtgcgacgcatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcact

SEQ ID NO: 76972 - DNA, 383 bp, Zea mays
  Clone ID: LIB3079-021-Q1-K1-C1
ccgataggtaaaaagaatatatgtgccactacctgatccaaatgtacgaaggttacttgggaaaaatcagctcaaaggacaatcattcaaactgtcgaaccatgattttgaaagacttgctgtggagaccgaagggtattctggaagtgacctgagagccttgtgtgaagaagctgcaatgatgccaataagagagctcggtccacaaaatattcttactatcaaagcaaatcagctgcgacctttgaggtacgaggacttcaagaacgcgatgacggtgatcaggccaagcttgcagaagagcaaatgggacgagctggagaactggaacgaggaattcggttcgagctgacggagacgcgcgctgtctgatgatgatgatc

SEQ ID NO: 76973 - DNA, 300 bp, Zea mays
  Clone ID: LIB3079-021-Q1-K1-A2
ccgacagtgccaaccttacttccagctttctattccagtagtcccacgcacaaacttggcgcagctgcctgcgcgcggccaactaccccgcgcgcggcagacggcatcaggtcgtgccatggacgacgacgccacggtcggatcgcggcagcgccagcagcagccgtgctcgccggcggctgctgattccagggccatgatggcggagctggacgcgccgctgcacgccctcgggttcgagatcgaggagctcttcccgtcgcggctcaccggccgactccccatcactcccatctgctg

SEQ ID NO: 76974 - DNA, 420 bp, Zea mays
  Clone ID: LIB3079-020-Q1-K1-G9
tctgcattcaatgcaaaaggagcgatgcaatgccctaactgtcggaagattgagaaaggtcgctggctttatgcaagtggacgtcacccccctgctgatattgatatgggtggatgggtgactagcgacaactatgatatcacctccgagcttccttttggatttcaatggtgtccctttagtggattcacccagctagcatcaatgttaggggtgcgtgaagctgagccaacttaccacacaactggagatcactcaagtgctgcaagcagttcacttgtttgcccatatcttgccctgcgtggttttctccatcctgttaatgtgccttctacttctaattctggtgctgaaagcacttcatttcatcggcactcaactggcttggaaggacatgtcactcctgatttgaacaatgct

SEQ ID NO: 76975 - DNA, 391 bp, Zea mays
  Clone ID: LIB3079-020-Q1-K1-H1
aacaaaaccaccaatgccagaagggactgacaggaagaatgcagatgcaacaagtgccagggaggtcagataggcgcggtacaaccaacacaggctacactgaacatgcagtacaggggcatgcatccatcgatgcaaatgaatcatggaatgggcatgtattcccaaccaacgttcggaggatattatggaatgaaccaaacacagctttacggcgttcatatgtctggttatggatatggtcagcaatctgggggctactatattccgaatgctgcatatgcctatactagtgcaaacgaacttgcccagaagatgaatgacctttcagttcaaaacggtgatccaaatggagccgcagcaaataagcagagcagacctgacgatgcac

SEQ ID NO: 76976 - DNA, 369 bp, Zea mays
  Clone ID: LIB3079-020-Q1-K1-H10
acacgagatagctccaaaatcacagctgagcaggttcacggcctcatgtcacaggtcataaaagacatccttttcaactctgttcacccgtcaagcaaggcaagcacaagtgctccaccagattcatccggtcctgagcctatggttgaagcctgagttccagcggaaggggacaatggatatttgtgttatgttatctgattcagaaggtgcaaaacaagttatcttttgagtacagaatcatcatgtaattatgagttgccatcttgggctgccactgagagggtgtgatttgggtccggttagcaatctcatgtattggatttcggatcagtattcgaagctttcataacgaggagccatcatctt

SEQ ID NO: 76977 - DNA, 405 bp, Zea mays
  Clone ID: LIB3079-020-Q1-K1-H11
gattcaagaggtctcgatcaagcgttaatgctttgccatctgacgtgtctactgtgaccagagaagtcacttctaaagtcatggcagactcgcagcaaaatagtctcacaagagccttgcacaatcaaggaaggacacaattgacagttcgataccatgataacagtgatgtgaagactactcaggatcttaccgtgtggtcttcaggaactgagcaacagagaaacaatattgctgcccagacaaagctatgtctggagggttggacgccaactagaagtcctgaaggctacaatcagatattctcggcatttaaaccactgaaagatatacataacccacttggtccttttcctagtcaaatatctgggactcactcaaatagctgggacacagctgatgctc

SEQ ID NO: 76978 - DNA, 400 bp, Zea mays
  Clone ID: LIB3079-020-Q1-K1-H12
ggaagggttggagaagaaggcacaagccagcggtgcatgtcagcttgttgagaaggacctcaaagaagaatttgttagtgaatatatatacccctgcctgcgtgcaggtgcagtttatgaaagaaagtatctgcttgggacttcgatggctaggcctgttattgctaaggcaatggtcgatgttgccaaggaagttggtgcggatgcagttgcccatggttgcactggaaaaggcaatgatcaggttcgctttgagcttacattctatgctttaaatcctgaacttaaagtggtggcaccttggagggagtgggatatcacaggacgtgaagatgctattgaatatgctaagaatcataatgtacctgttacagtttcaaagagatcaatatacagtcga

SEQ ID NO: 76979 - DNA, 413 bp, Zea mays
  unsure at all n locations
  Clone ID: LIB3079-020-Q1-K1-H2
gagcatgccatgtcatgctggtgcctgcaaatgctgtatctgatgaggaattccatggcccatgttgctggtgtctcaactgctgcaagttttggtggtcggttcttatttgagcccatcctggtcggtattggagcttgtacagaacaacaccgaagtgcatgatattcttgactgaataaaattaattgacgacacttgttttacgtaagggaaagatgaggataatttggagacataggtctaaccacccggaaatagtaagcgggattctctggtatgtnncttttttatatagtgtggcatgagtcgtgtcaacctcagctcagctgaaagggctcaagttcgtgccacaacacaactggaagagctgcngccgtggccaaaggaggaaatgccaaacaacagcaaca

SEQ ID NO: 76980 - DNA, 342 bp, Zea mays
  Clone ID: LIB3079-020-Q1-K1-H4
aaaagccaaagccaccaggccagcaacaatagaagcgagcgagcgagcagcagtaggcgagcggcgcgggcgaggagcagaccagcacccagcagccctcgtcggggggcgggagttgtagcttgatgaggcgtcgcctttgcgcgtgtgctgtgactgtgactctgccgctaacccggttgcatttctccatcttatccctctcccgcttctgcttcctcgtctcttacttcgttctgatcccgctggcgaggatgcattcgcatttgcggcactcaatgtagccctaccagaaggtggtgaagatcgtggacgtcactgtcagtgtggtgtacaatgtgc

SEQ ID NO: 76981 - DNA, 146 bp, Zea mays
  Clone ID: LIB3079-020-Q1-K1-H5
taaaaaaaatacaatattcaaaattaaattataaaaaaaaactatacataaaataagagccgaaaatataactaattaaaaaaaaaatacaacaactaaaaaactatctacaactccctacccattcactcttctacctctcctat

SEQ ID NO: 76982 - DNA, 264 bp, Zea mays
  Clone ID: LIB3079-020-Q1-K1-H6
aactgctagtcgaagataattaggtgcagcgtttatactaacataaaaccatgggttgagacatatcccgggtaggccgtaacacaggcagtctccgctctgttgctagtggcaagcgctgcctgtcctgtgtctgtttgtacgttgacaatttgattccgttgctcaaggatagaagaatattgatacaggagacccgaggactggtttgttttttgcaaaaaaaaaaattacaaataataaaactaaaatacaataaaaata

SEQ ID NO: 76983 - DNA, 408 bp, Zea mays
  Clone ID: LIB3079-020-Q1-K1-H7
ctgggagcggcattttcgctgccgggagcaatggagacgctggggaggcagctgctgccgcgaagcccgcccgaacctcctcgcgccaggcgagcagtactgtaagccacatctcgttcgctgaggatggaaccgatcctcccaaaaagcccacatcagtagctgaggtggcaaagcagcgtgagcttagtggcactcttcaaagcgagacggatagtaagacgaagaagcagatctcaaatgcaaagtccaaggagctcagcggccacgacatctttgctgatactctggattccaggtctaacagggcaaggaacccatcgaacggcagcacagcctcacacgcacctgccaaaaatacaaacgccagcaccttctcgtttggagatgccaacactgacagcacgc

SEQ ID NO: 76984 - DNA, 410 bp, Zea mays
  Clone ID: LIB3079-020-Q1-K1-H8
gttccgtgtggtaacactgttgctatggctggtctggatcagttcatcacgaagaaggctacactcactaatgagaaggagactgacgcttgcccaatcagagcaatgaagttctccgtctctcctgttgtgcgtgttgctgttcagtgcaaggttgcctctgaccttcccaagctagtcgaaggcttgaagcgtctagcaaagtccgatcctatggttctatgtacaatggaagaatctggtgagcatatcattgctggagctggcgagcttcatcttgagatctgcctgaaggatctgcaggaggacttcatgggtggtgctcaaattatcgttttcactcgcgtcggctacttacgcgaaacggatcttgagaagtcctgacgtactgtcatgagcaagtctcccaa

SEQ ID NO: 76985 - DNA, 413 bp, Zea mays
  Clone ID: LIB3079-020-Q1-K1-H9
tgttcatgcaacaacagctacccataagaccgtcgatggtccttcgatgaaggagtggagaggaggacgtggtgctgcccaaaacataattcccagctccactggtgcagcaaaggctgttggaaaagtcctgcctgagctgaatggaaaactcactggtatggccttccgagttccaacaccaaatgtctctgttgtggatttgacatgccggattgagaaaagcgcctcctatgatgatgtgaaagcagccatcaagacggcatcagagggtgcactcaaaggtattcttggctacacagacgaggatgttgtttccaatgattttgttggtgattcaaggtcaagcatctttgatgccaaggctggtattggactgagctctttcttcatgaacttgtgtctggtatgac

SEQ ID NO: 76986 - DNA, 388 bp, Zea mays
  Clone ID: LIB3079-021-Q1-K1-A1
cccacgcgtccgaagagagttgtgaaacactggaagtcatgtcttgatgtgtcttctgtggtcgtagcctacttaatattttgaatctggggttagtaacaagctcttgttgtttcattggattcctgaaaagttcagttgatctagttttctctgcaaagaacatgtgcatacctgtttcaggctaacaagttctttcgtcttctttggtaggttctccttgagctggcccgtagccggaacagaatgccgctgcccaaatcaatcgctcctcctggctcgattcccctcccacctgagcaggacacactgttggcccagaactaccaactcctgcctccgttgaagccgccacctcaatatgaggaaatagaggatgagactgaag

SEQ ID NO: 76987 - DNA, 379 bp, Zea mays
  Clone ID: LIB3079-021-Q1-K1-A10
agaacttgcaaatgatgatagaggctgatttacaggaacgtgctcagtctgcattacgggcacatattagttcaagagaagatatcaagatggagataaatatcccagaagattgtgctgcattaacaggacagttacaaccttttgtcaaagaagaagttttggtccctgtattcaatggaacttttccatctactgcacagcacttctttagtattcttttaagtgatgactcgaactacataacacagtatcgaacatttcagaaggataaagatataaatctgggccaatggcacattgcacatgagtatgatggccaggcgagggaacttaattgtaaatcaatatgccatagtccaatgtgccctccttattc

SEQ ID NO: 76988 - DNA, 308 bp, Zea mays
  Clone ID: LIB3079-021-Q1-K1-A11
cttcgatcgtttgattcatgtatatttttttacacaagacactcaaaaccaaacgcagattcattactttggagaacggttttttatggttattcgtgaggatgagaccctatcttctatcaaagaacgtatacagaaaaagcttaaggttccaaatgatgatttctcaaagtggaagtttgcatacatttcactcggtcgtcctgactattttcaagattcatatactgtatccctaaaattccatataaacatgtattgatcttgtgatcaatatcttgtactgtaacattctgacactgcttcta

SEQ ID NO: 76989 - DNA, 399 bp, Zea mays
  Clone ID: LIB3079-021-Q1-K1-A12
accgtgggcggttaccattgggcgatctacttctaccccgacgggaagaacccccaggagaactccacctacgtgtccggcgtcatcgcgctcgcattctactgcaccaacgtgcgcgcgctcttcgaactcactctcctctaccacacccgaaagggcaagcataaggagcactctcacttcaaccgctccctagagtccgggccgtacaccctcaacaacccaatatccatgtggggctacaaaagggtctttccgcatactactcttgaacaatcacattttcttaaagatgaatgcttgaacataaactgtacattggcatgttgtaatatcaactattgattattctaagccacattcaatatatgttccacactctgacataggctttcattt

SEQ ID NO: 76990 - DNA, 395 bp, Zea mays
  Clone ID: LIB3079-020-Q1-K1-G8
gagccatccctccgtagttagcttcttagagggactatggccgtttaggccaggggggttctcaactatgagttcccgaaaaaaaaaaaaaaaaataaaaaaaaaaaaaaaaaaaaaaaaaaaaaaagggcggctctcgcgatctagaacagcaagagaactcgggaaaagtagaatttacatggttgtaccttttatagctgaatgggttagagacaaaggacaccacattaaatcacaggttaatgctgcttcaggtgctatttctctaatacaacttcaagaagggatgaaaaagatggaagggagtgaggacagcgaggagcaacttatgaagagttttgaggagaaaaaagatgccatgctcagctcgctttggaaaatcaatgtggttg

SEQ ID NO: 76991 - DNA, 151 bp, Zea mays
  Clone ID: LIB3079-024-Q1-K1-G3
attgaagcaaacatggaagtcagcctgggactgactgaagaacaaattgttagtgaacgcaacagggaactgcttgtattcaaaattgtgctttcggagtgtggtactgctgttactcatcaaaactgaaaaaaatcgttcttaccatcat

SEQ ID NO: 76992 - DNA, 429 bp, Zea mays
  unsure at all n locations
  Clone ID: LIB3079-024-Q1-K1-G4
cccacgcgtccgggcgccgcttctccaacatcgtctgcaagaaggccgacatcgacatgaacaggagggccggcgagctgacgcctgatgagctggagcgcctgatgacggtcgtggccaaccctaggcagttcaaggtgccggactggttcctcaacaggaagaaggattacaaggacggcaggttctcgcaggtcgtctccaacgcccttgatatgaagctcagggacgaccttgagaggctcaagaagatcaggaaccaccgtggtctgcgtcactactggggcctncgcgtccgtggccagcacaccaagactactggtaggcgtggaaagaccgttggtgtctccaagaagcgatgagctctatatcaccctgagaaatcttggccgcactaccgtgttggtttgtgtccaaacagtcctgatg

SEQ ID NO: 76993 - DNA, 484 bp, Zea mays
  Clone ID: LIB3079-024-Q1-K1-G5
ctgcaaacaagactcatttggatccctgttcaagtgggaatgacactgtaagcgtgcaaaacgatgaagttgaatcctcaagtacggtttcctcgtgggcaaggacagagcaaggaactgagattgctcatcatacgccctttagtcaatttgatgttgtccaagatttctcggatcaccactatgcaaagacttcagcaggaaaggtcacaaaggattgggtgaaggcaatccaaagtgaatgggatcttctacagaaaaacctacctgaatctatatacgttagagtctatgaggacaggactgatctgctgagggctgccatagtcgggccagcaggaactccataccatgatggtctgttcttcttcgatgtccgttttccttgcgaatacccaaagtgcccaccagtacgtgaccactagacatccatcatcctgcctctgcctctctggtatagtttcttccattcaaagtgagcagc

SEQ ID NO: 76994 - DNA, 454 bp, Zea mays
  unsure at all n locations
  Clone ID: LIB3079-024-Q1-K1-G6
caagaccatggttgccgagaggaaagcggaggaagttctggacccaaagatggctgaaaagcgggtctcccaaaacgctgaaacgggcgctcctggtcgcgcttcgctgtgtcgaccctgatgcgaacaagaggcctaaaatggggcatgtgattcacatgctcgagatggacgatctactattacgagatgataagaagcccgggagagacgttcatcctcacggttcagacagatacagctccaaggaggaagggagcatcagcaagcgcgagcaccaccaccaccaccaccatcggcacagatgatacacagcaagcgcgagcatatgaggattgccattagagagtagcgacattaaccatgttccccacttgtttgccctcccgttcaatctcactggtctttgattgtattatatgtgagcatncatcattctgtgacgatacttgat

SEQ ID NO: 76995 - DNA, 486 bp, Zea mays
  Clone ID: LIB3079-024-Q1-K1-G7
cttcctttcgtcaactccacttctcttctccgcgtcacctcctcttcgccgccgtcgacgcttgacccggcagccagtcatggatgaggagtacgacgtgatcgtactaggcacggggctcaaggagtgcatcctcagcggtctcctctctgtagacggcctcaaggttttgcatatggacagaaatgactactatggaggagattgcacctcactcaaccttaatcagctctggaagaggtttagaggggaagacaagcccccagcacatctaggtgcaagcagagactacaatgtggacatggtgccaaagtttatgatggcaaatgggacattggttcgaaccctcattcacaccgacgtgacaaagtacttgtcattcaaagctgttgatgggagctatgttgtcagcatagggaagatttacaaggtccctgccactgatatggaggctctgaagtcccctttgatgggcctattcgagaa

SEQ ID NO: 76996 - DNA, 465 bp, Zea mays
  unsure at all n locations
  Clone ID: LIB3079-024-Q1-K1-G8
tgcttggcaggttagcctacgaacaatctgggagaaatactatgaagaggcccatgccatagtgtacgttattgacgctgccacagcatcgtcatttgaagattccaaatctgctctggagaaggttattcgccatgaacatctgagaggagcaccactcttgatagttgcaaacaaacaggatttacctggagccattgatgaggaagaattggctaaatttctgcataaagaactggatgagaggccatatacatttcaggctgtatctgcatatgatggcagggggatcaaatctggcatagactggctggtggaacaaatggaaaaaagcagacgtaccgagacactgcaggctcgtgctggcgtagctggacaaatttagaatgaggtgaatttgttaaagaacanagcattggataggacggcttccttcgtatcgcgtaagcagccatttgctgcatt

SEQ ID NO: 76997 - DNA, 452 bp, Zea mays
  unsure at all n locations
  Clone ID: LIB3079-024-Q1-K1-H1
ccttaaaactaccaggcctacactgcagaggaggcatatgctccacagaccagcaactatgtggcaccttgggcccagaccggagcatatccacctcagcctccggcatatgcatctggctatgcctaccctgcaccgncatgggtggcgcctacacatcctgttgattctaacccttttctttcggtcaattaccaagatccacgccctgctgccacttctgttgctcaaacagcaacatatgcacctnccccagcttcatatcccccttcaatatcttatgcacagtttgcaaccccccagtcaattcagcatagcaattctgtggcttcaccgagcaatggtcagattgcaaatcaagcacaaatgaatgtgaatcaacaaccaaaagattcttcggcagcatctagcagaccatactacatacctgataatctattcagtgatttgat

SEQ ID NO: 76998 - DNA, 460 bp, Zea mays
  Clone ID: LIB3079-024-Q1-K1-H2
ctccgatgggcatgtggcctcgcttttcccgaaccaccctgccatggagctgaaagacgactgggtgacctacatcaccgactctccgcagcctcctcctgagaggatcaccttcactctcccagtgatcaactcagcatccaacatagcaatagtgtccactggtgatgacaaagcaaaggctgttcacatagcagtttctgacatggccgaaggtcttgatgctcctacatcactgcctgctagaatggtccagccaacggacgggaagctggtatggattctggacaaggcggcggcatcattccttgactccaagaacgacgacgacgacgcttgctacgatcgtcacgagtgactaactctgaggatcgctggtcgctttgaaacgaatgaaccgaagtgtgtgtaaataggtggtggcgtatgatggaagacgcgctgttccccttttagctcg

SEQ ID NO: 76999 - DNA, 348 bp, Zea mays
  Clone ID: LIB3079-024-Q1-K1-H3
atgtcaagcttgctattcccgtttcaccctaacatatacctataacacgacattgtcaattatatcaccgaatctagctatcctgctcatgagaagatcaccttaacactcccacatacctattcagactgccacatatctatatactccaaccttcattacttaatccagaccatacacataacagaatcagacataccactatcacataaccctactacattacatcatattagactggtcacaactacacacttgaagcatttactgctcattgaccagtcacttattatgatactagctcactagatcgacaaacatcacgatatcatacttcatgacgataat

SEQ ID NO: 77000 - DNA, 460 bp, Zea mays
  Clone ID: LIB3079-024-Q1-K1-H4
aaggaattgggaacggaccccgcaagggggaagatgtgtgctccagaagagtgcaaagcatgctggtagtgctactggcagtgattcattacccactcctaacaaggtcttgcatcatgcactccattatcgagttgctggccatcagtctagcattcatcagtttgtgcccattattcgatggccacgaatcattccttctggttttggctatggattatcgcttgggattccatcagttgctcctcaccttggcaagggaatactgggcaagccaccaatcattccttctggttttggctacggattgtcgcttgagattccatcagttgctcctcaccttggtaacggaatactgggcaagccaccaagtaatataacacccttagatcaacggagctcaactcaactagtgcacgtacgggatccacaccagcatacatgtcagcaatcatgtggc

SEQ ID NO: 77001 - DNA, 482 bp, Zea mays
  Clone ID: LIB3079-024-Q1-K1-H5
attctagaagttcaagcatcccattgcagcaccgtggaaattcatccacatcacatgagattaggaatcatcagccaggatcaagctctcgtgcacatcagcagcaccccttaagacccggtcattcctctgtagacaggcagagctctggttacttggaccttcagtcttttatgcagaccatagcttcaagggaaggaggcagaccaatgtcagagatccgcaatgtcttcgatcagattcgtcaggggagaaatgcacgattggaggatttgcttctcattgaccggtcacttattatgagacgagctaatttgattgatagacatcgggatatgaggcttgatgtggataatatgtcctatgaggaattgctggcactaggtgaacgcattgggtacgtaaacacaggacttactgaagaaaagattttgagtaacttgaaacaatggaaatgtgtcttaaaatcatgggatgatcct

SEQ ID NO: 77002 - DNA, 319 bp, Zea mays
  Clone ID: LIB3079-024-Q1-K1-H6
acctcaccctggtctggtctcctctgcaagcgggcagcgctcctccaaactgaaccctatccgtggcacgagtgcacgtcggtggcagcaggagatggtggggacggcggaaggcggcgcggagagggcggtgcggcggtgggtggacgccgtcggcgggcgcctggtcctggacggcgggctggccacggagctcgaggccaacggcgccgaccttaacgacccgctctggagcgccaagtgcctactgtactacccgcacctcatgcggaagggccatatggactacctagaagctggggcgaacattataatcaca

SEQ ID NO: 77003 - DNA, 460 bp, Zea mays
  Clone ID: LIB3079-024-Q1-K1-H7
cgcccggccgcatcggccgagccttctaacagctgactcgtcctcgtcgctccggcgcggcgacgaggcacgcagccaccgcgcgatggccgacggctccagcagcagcggcggggcgcagaacgggggtgagtcggtggtgattgactacggccggcgccgcactacctgcggctactgccgatccttcgggcccacgagcatctcccacggtatgtgggctaacagtctgaaagctgatgactatcaagctcttcttgatcgtggttggaggagatctgggtgttctctttaccaacctgagatggaacggacatgctgcccctcatatacgatacgcttgaaagcaaatgatttcatttgttccagagagcaagctcgggtacttaacaagatacaaaggttccttgatggcgagctcgatccacagattggaagcccttagtgtaaggcaagttca

SEQ ID NO: 77004 - DNA, 294 bp, Zea mays
  Clone ID: LIB3079-024-Q1-K1-H8
caaaacagagcgcatctattgcgagcaatggttcatcaatttgcaagtcatgttccccaaaggatacagcaagtcaaacagctccaaagggctgacaaacatccaagcaaatgccgcggaggagaccagcacaaggcgtgctgcattggaggcgtcgattaacgaagtgctgttccagatcataaagttcgccaacgagaaaaaggaccacattcttgctatccctgacaggattttcaatcacgagatcatgatcccaagctcggattctggattcggatggaacacggacgt

SEQ ID NO: 77005 - DNA, 187 bp, Zea mays
  Clone ID: LIB3079-025-Q1-K1-A10
acgttgatatactgtgtactcccattttcctcagaatgatcaactacctgatgaataagtggaaaggatatatcataacttagataccaggtaccaaaaaaaaaaaaaaaaaaaaaaaaaaaaaaaaaaaaaaaaaaaaaaaaaaaataaaagataaaaaaagacaagataaacaaaaagctaaaag

SEQ ID NO: 77006 - DNA, 326 bp, Zea mays
  Clone ID: LIB3079-025-Q1-K1-A11
cccacgcgtccgcccacgcgtccggccggtaaccgtgagaattacatcaacgagctcatcagggggatgaattaggttcacgatcaagctctattgtgttctaagaaactttctgtgctctcccaattttacattattaggaagcggatgaatatgcatgcagttttgttgtttggaactagatgtgtatggaagaaacatgatcttttttctaaaaaaaaaaaaaaaaaaaaaaataaaaaaaaaaaaaaaaaaaaaaaaatataggacaaaattatttaaaagataaaaatattaaaactatatatataaatattaatagatat

SEQ ID NO: 77007 - DNA, 489 bp, Zea mays
  unsure at all n locations
  Clone ID: LIB3079-024-Q1-K1-G1
tcggccaagggttccggcccttccaagttggttgaaggcttgaaaaaaaagggaatccggttcccggggattggtcccaggattaaaagcagaaacaacagggataagcgtgtgcagcttctacaganatatgctcacacacatttcccttcagtcaagtacatggaatacgctgttcaggttgagacctacaccttgtcaaaagccaacaatttggttatgaatgtcgatggtgcgatcgggtcccttttcttggatcttctatctggaagtggaatgttcaccaaacaggagatcgatgagattgtggagatcggttatctcaatgggctctttgtgcttgcacgatcaattggcctgatcgggcataccttcgaccagaagaggctcaagcagccactctaccgtcacccatgggaggatgtactttacaccaagtgagaaagccattctttgcaaggcataataaagtattattatcgcctagag

SEQ ID NO: 77008 - DNA, 454 bp, Zea mays
  Clone ID: LIB3079-024-Q1-K1-E2
caaagcaatctcaagtgaatcaaaccgccagacttcgcagtcctcctccccactaccagagcatgcgcgttgccgcgacccgagccgccgccgccgctcaccctccgagcgccttcctgctcctcctgttactcctcggttgcgcgtccctcgcgatcggaggagcagccatggccggccacgtcctcggcggcgtgaaggagaacccagccgcggccaacagcgccgagtccgacgggctcggccgcttcgccgtcgatgagcacaacaggcgcgagaacgcgctgctggagttcgtgcgcgtggtggaggccaaggagcaggtggtggccggcacgctgcaccaccttacgctcgaggccgtcgaggccgggaggaagaagctctacgaggccaaggtctgggtcaagccatggctcgacttcaaggagctccaggaattcagccacaaggg

SEQ ID NO: 77009 - DNA, 481 bp, Zea mays
  Clone ID: LIB3079-024-Q1-K1-E3
cccacgcgtccgctaaaatatggatgagtgatacaacatgtgtgaacatgcttagacttggtaggtgtagtttctttcgcttttgtaagggctttagagactgaggtttacttgaagatacaatacacatgtgtgttgaggaacaagtggccatgtttttgaacacagtgtgacagaaccttaggaataggttggtgggaacaaattatggtagatctggtgagactgttactcgctacttcaacaaagtgctttgtgctattgcagagctaccagctgcacttattaggccaccatgcttatagactccatccaaaatagcatgaaatccaagatgggatccctactttaaagtgtgatattcagctattcaatattctacttcaagaattttcactatttaaacccataatacccttaattgtattttggctctgattggatacacataggattgcattggagctattgatggcacaca

SEQ ID NO: 77010 - DNA, 485 bp, Zea mays
  unsure at all n locations
  Clone ID: LIB3079-024-Q1-K1-E4
agtcagaatagctgatggtatagcccagggactcctgtaccttcacaacctctcctgaatacggcgcgtccatagggtcttgaaagcaagtaaaatcctgttagatttctgatctaaaccctaagatttctgatgttgggatggcaaggatatttccatcggatgccactcaagcaacagccagcagacttgtgggcacatagtaaggtggatacatggctaatgaattgcatctgatggccttctctcgatcaagtcagatgttttcagtttagtattaatggtgtatctgtatggtgttctacattatttccttccataaaacctgngaactgtggaaagacaggagatggaataagttcaatgatcaatcatttggtgatgactacgaactggaagagctgatgaaataccttgctgagttgctgtggtatttgtgtgtgttatgagaaaaaaaacaatggatcatcctacaatgcctgatg

SEQ ID NO: 77011 - DNA, 467 bp, Zea mays
  unsure at all n locations
  Clone ID: LIB3079-024-Q1-K1-E5
gctgaatcgcccaggcgtccacctgacccatcacctaggcgtcgtcctgattctccgcctatgcgtcgccgaccagatccttctcctgtcaggcgtggtggcacacctcctcgcaggagaccactgtctccagttagaaggcgttctccttcaccacctaggaggcataggtcaccgatgcgtccttcacctaggaggggacgtggcagtccttcaccacgcaggcgctcccctgggcctcttaggcggcgctcgccacctccaaggcgtttgaggagcccaccaagaaggccaccaccttcacgtcgctatagtcgatctccttctcgccgaccccttcgctccagatcgatttctccaagaaggggacgagggcctctcttgaggcgtggtangtcaggctcatcattatctcgatcacctacttcaccgncaagaaagggccaagaaggtatcaaggagtcgca

SEQ ID NO: 77012 - DNA, 457 bp, Zea mays
  unsure at all n locations
  Clone ID: LIB3079-024-Q1-K1-E6
gcggcatcagcctggtggagatgaactacctcgaggtggacttcttgttcggcatcgcctgggacctcaacgtcacgcccgccgccttcgcctcctactgcgccgtgctccagagcgagatggcctacctggacgacgcgcccgcgcccgtcgtcgaggcgcccccaaggctgcactactgctacggcgccgccggcacgtctgaccgccacgacgaccccgccgcggtcgcagcagccgccgcagcctgccaccgtcacagcagccagccgcagctcactgtctgatcgaccggccgtgcaagcgtgcccgaccggtggatgcagccgtttcttttcttttcttttctttgttgtcctggcggngcgcgctggctggtggtgtcgactcgtcttcttccttggtgatggtctgtcttggtacatatgtgttggtcgttcggtgctagtgagctctc

SEQ ID NO: 77013 - DNA, 469 bp, Zea mays
  unsure at all n locations
  Clone ID: LIB3079-024-Q1-K1-E7
cccacgcgtccgattttctctcactccatctcaagtcaggcacggtgacttgacgaggcccagctaagcacactacagcaccgggcgaggcggctaggccccctcaccgtccaccggcgactgggccggccgtcgctgccgccctgcctctccaccgtcgccggcgacgagcaccactaggtgtttttgagtctgttgcgagtgttgtggccatgtccatgttcaataggatcttcgggaagcccaaggagcaggccaactccaatgctttggccactctggacaagttaaatgagacacttgatatgctggagaagaaagaaaaggtgctggagaaaaaagcaaacgctgagcttgagagagccaaggagttctcgaaagcaaagaataaaagagcggctatccaatccttgaagaggaaaaaactntatgagcaacanattgagcagctnggnanattttcagttga

SEQ ID NO: 77014 - DNA, 175 bp, Zea mays
  Clone ID: LIB3079-024-Q1-K1-F1
ctccttattccccctcacccacccttcccaaaaaaaaaaaaaaaaaaaaaaaaaaaatttaaaaaaaacaaaaaaaaaaaaaaaaaaaagaaaattttcaaaattaaatatccaacttacttacacccatcttccaacatctaattcttttacaaccaatcctaaattccttcca

SEQ ID NO: 77015 - DNA, 473 bp, Zea mays
  Clone ID: LIB3079-024-Q1-K1-F2
agaacgggaaccaggagctcaagagcgacctcaaggacctgtacatcaacaatgctatccagagggatgttaccgggagcaggaaggctgttgtcatccacgtcccataccgcctgcgcaaggccttcaggaagatccatgtcagactcgtcagggagctggagaagaaattcagcggcaaggatgtggtaattgttgctacaaggaggattgtgaggccacccaagaagggttcagctgttctgcgccctcgcaccaggactctgactgctgttcacgatggcatcttggaggatgttgtctacccagctgagattgtggggaagcgtgtcagataccgtctggatggttccaagattatcaagattttcttggacccaaaggagaggaacaacactgaatacaagctggagacctgcactgcggtctaccgcaggctgtgtgggaaagatgtggtctttgagtaccctatg

SEQ ID NO: 77016 - DNA, 434 bp, Zea mays
  unsure at all n locations
  Clone ID: LIB3079-024-Q1-K1-F3
cccacgcgtccgctcgtccttgataagtgagcaagcggcaagaaccagcggcgcgcccatgtgggggagagacttatacttccacgacgagctggcgtcgctgttcgcgcagcggccggcgccggccggagaggcgatgatgacgcaccagcaccagcagcagcaacaggcgccggcgtcgtggttcgcggactacctgcacgcgggcgccccaggcatggggatggactacgacctgctgtgccgcgcgctggacctgccgctgccgggggacgacgtcgtcaagagggaggaggagctgctgctggtggacacaggcggtgaccgaggaggcttcgccgcgcccacgcccacgcccagcgggggcggcacggcgccggtcacgcccaacaccacgtcgtccatgtcctgctcgtccagcgaggcngcgggcg

SEQ ID NO: 77017 - DNA, 477 bp, Zea mays
  unsure at all n locations
  Clone ID: LIB3079-024-Q1-K1-F4
ctgtacccggtggccccgctgctgctgccgcacgagtcggcggcggactgcacggtcggcggcgacgacgtgccccgcggcacgctgctgttcgtcaacgcgtacgccatccacagggacccggcggcgtgggaggagccggacgagttcaggccggagcggttccgcgacggcaaggccgagggccggctgatgctgccgttcgggatgggacggcgcaggtgccccggggagacgctcgctctgcggaccgncggcctcgtgctcgccacgctcatccagtgcttccactgggacagaatcgatggcgctgagatcgacatgaccgagagcggcgggctcaccatgccccgggccgtcccgttggaggccacctgcaagcctcgcgaagccatgcgtcatgttcttcagcagctctgattggtctatgtgctaaacattctcatccctattctctcttgggtgtgttgcagtacg

SEQ ID NO: 77018 - DNA, 483 bp, Zea mays
  Clone ID: LIB3079-024-Q1-K1-F5
gtgatttgtctgaggatggtgattcagatattgatggctgccaaaatgtgaggaaagaagcgcgctctgctctaagtggacttcttaaggatgatgggattctggtgattccaactgctttggggtgccccccgaagcttaacgctaaggaactctcgtctgaaagctacaattctcagacactacgccttttgtctttagctagcatgtcagggtgttgccaggtttccattcctttgggtacacatgataagtgccccatttcagtttcgttgattgctaggcatggtggtgatcggtttttgttggacaccacacaaaccatgtatacaaccatccaagagcaagtggagatactagcgaaatctagtgtttcaagtaaacaggcgatgaatgaagaagcagctgaagctgctaaagagaaaggtaatgctgcatttaaggaaaaacaatggcaaaaagcagtaaatttctacactgaac

SEQ ID NO: 77019 - DNA, 329 bp, Zea mays
  Clone ID: LIB3079-024-Q1-K1-F6
gcgagggccccaaccagagctggaaggagctggcctgtggggacgaggtctacacaccaaggcggtacgctcctacttcgcctgatcaggctgaaccaggctactgtggataccgtgccgcggctgtagggggctacgcgccgacgcctacggctggcctaatggaaccaggctacggcgggtacccttctacagcagctgcagggggctacgcgcctcctactgcaggtgctcagatggaaccaggctacggactgtaccctactacgccatctgcaaggggctactcgccgacacatacgactgtgcctgtgcaggagcctgactac

SEQ ID NO: 77020 - DNA, 477 bp, Zea mays
  Clone ID: LIB3079-024-Q1-K1-F7
ggcggcgtccgacgagagtggaaatgatcgctctctccaagatagccctggtgtctgcggtggcgctgctggggctgggctgggcgtaccaggccacccgcccgccgcccccggcgatcttgggcgccccaggagggccgccgatcagctcacctagaatccggctgaaagacggccggcaccttgcctacagggaggaaggagtgcgcagggagaacgccaggttcaggatcgttttcatccatggcttctcctccaccaaggagagcgggttccccgtgtcccaggagcttgtggagcagctgggcatatacatgctcttcttcgacagagccgggtatggcgacagcgacgccaacccgaagcgctgcctcaagagcgacgccacggacgtcgaagagctcgccgacgcgctgcagctcggggacaggttctacgtggtagggtgctccgtgggcggctacccagcatggagct

SEQ ID NO: 77021 - DNA, 294 bp, Zea mays
  Clone ID: LIB3079-024-Q1-K1-E1
tcggcgcttcctggttctctacagatccttctcttcttctctcgggctttgtcgtcgtcgtcgtcgtgtcctgatctcgggcttctgcgaccttcatgggttgcaaaactgctgcagacacttggagcaacgaccgagtcgttgaaggttaagggtcctccttcttcttcatggcggacgtgtacaaaggcgaactcacgccgcttcaaaagcacgtcttcttttttgaccccaacaaggaccgggtcatctaccccttcgagacatacccaagggttccagctatcgggtgtg

SEQ ID NO: 77022 - DNA, 440 bp, Zea mays
  Clone ID: LIB3079-024-Q1-K1-C1
tcggtttttgttttttttgaatctagaaatggactttcttatttctgggaagccacaaacattaggcgaaaaactttattattgaactattactcataagaaatctaaaagaaggcaccaccaatgatgggttgttggtagaacactgctaggtttgtcaaagcaagttggttgaatggcaacaattgttgcagttgtaagagggtgccagcgttaggcgcaacgtgctggtagaacggcaacaactgtggttgtgtcaagaaagtagcagggctcacaccagctagctggctgaatggtagtagttgttgctgctgtaaataaacaggagagttcaatgctgccagttggttgaatggaagaaattgctcggggtaggcaacaggtagctggctgaatggtagttgttgttgttgcaaataagaagcagagttcaatgc

SEQ ID NO: 77023 - DNA, 371 bp, Zea mays
  Clone ID: LIB3079-024-Q1-K1-C2
ttctttatgttttttgaatctataaatgtactttcttatatctggaaagccacacacattagacgtaaaattttattatttaactataactcataataaatctaaaataagacaccaccaatgataagattttactaaaacacattcttatttttcaaatcaaattcatttaattgtaccaattgatgcaattttaagactgtgccaactatatgcacatcgtgctcgtataacggcaacaactatctatgtgttaacaatgtagcattacttacactagatatctcgctaaatcgtagtaattcatacttttgtcaatatgcattagacttcaattctttcaagagtttcaatcttacaaattactcctg

SEQ ID NO: 77024 - DNA, 467 bp, Zea mays
  unsure at all n locations
  Clone ID: LIB3079-024-Q1-K1-C3
cccttattcagatggaagtggtagaactggaaggtattctcccggttcaaggtatggtggtggggctggtggacgtggtgatcgctttggaggatcagatcgttttgctcgctatgatgatgatcgatatgatggtgggcgctatgtggacagcagggatacttattatggttccgggcgcgatcgctatgcaccggcagcagaacgctattctggtgacaggtacagtggtgcagatcgatatgcgtccagcggctttgccagagaaaggagctatgagagagatggagggaggtccaatggaggttactaccgtgatgaaccgaggggcactggtggctatggcagaggtggttcacgtggcggcggcggcggtgggcctgctcgctttggtgggagttaccgagataggcctgcttcatacgatcgtcccagcangggatgagcagctcgtgcttatgatgatc

SEQ ID NO: 77025 - DNA, 488 bp, Zea mays
  Clone ID: LIB3079-024-Q1-K1-C4
cctgatcgcgctgtgccaggccatcgacctgcggcacctcgaggagaacgtgaaggccgcggggaggaactgcgtgacgcaggtggccaagaagtcgctgagcctgaacgcccggggcgggctccacaacgcgcgcttctgcgagaaggacctgcagacggcgatcgaccgcgaggcggtgttcgcgtacgcggacgacccgtgcagccccaactacccgctgatgcagaagctccgcgcggtgctggtcgagcacgcgctggccaacggcgacgccgagcgcgccgcggagacgtccatcttcgccaaggtggccgagttcgagcagcaggtccgcgcggcgctgcccaaggaggtggaggccgcgcgcgcggccgtggagagcggcagccccctggtccccaacaggatcagggagtgccggtcctacccgctgtaccggttcgtgcgcgaggacgtcggcaccgagtacctgaccggcgagagga

SEQ ID NO: 77026 - DNA, 481 bp, Zea mays
  unsure at all n locations
  Clone ID: LIB3079-024-Q1-K1-C5
cgtctcccagatctaactgccccccgactcacgaatcccaaagcctccatggcgacgcaccggcactgcctcccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgncgaccccgccggccgcaccgtgccctacgtcgccgtcgtgtacgagcaggtctggacccgcacccgccagctcgcctncttcaacccggtgccccgcgcccactgaaaccatacgcacacgggtgggccgaagcgacgttctccgtcaa

SEQ ID NO: 77027 - DNA, 153 bp, Zea mays
  Clone ID: LIB3079-024-Q1-K1-C7
aaaaaaaaaaaacataaaaaataaaacaaaaatttaaaaaaaaaaaaaaaacaaaattaaaaacagaataaataaaaaaaaaataactataatataaaaaaaaactaaattcaatacactaaacaaacaatatacaacaatataaactaatat

SEQ ID NO: 77028 - DNA, 473 bp, Zea mays
  Clone ID: LIB3079-024-Q1-K1-D1
aacaccctggccgagttccttggacctgaagaacatggctcccagatggcacgaccatcttcagggttggtgcttaaatttccacggtcgggtgaccgtcgcctccgtgaagaactttcagctcgtcgccacagctggctccggcggtccatggggcgtcggagaccaggagacagtgatcctgcagttcgggaagatcgaggactatgcgtttacgatggactaccggcagactctgtccgcctttcaggcgttcgccatctgcctgaccagctttggcacgaagctggcctgtgaataaatgggtgccggtttaccaactatgttggggatcagattgtatggggtagtctgaactaggtgccctgagcacctcagatgggagaaaactggcgatatgatacacggcggacgttgtccctataaaccttgactcccttgaatcgccctaatgattgagatatatatatatg

SEQ ID NO: 77029 - DNA, 437 bp, Zea mays
  Clone ID: LIB3079-024-Q1-K1-D2
ggagccacaaggtcctaaagtagttgctccaactcctgaacaaatcacagctatcaaggctgcgtgtgcaaatgcccacactctcgaggaagctgcaaggctagaacaggtactaagcactggccaagttcctgctgaatttgcagtgcccaggcccgatgcaaacatggccgaagcttcagatggagccgagaagatggacacagatggtgagaaccaagagggcggtgaggctgatgggcagaaacaaggcgaaggaagcaccccaattcaggaggattgaagtcatggtgacatgggctgggtcatccattgtctgagttaggtttgccagttttcgtgggggtgcaagaaagagctagagccttgttgccgcagaactccccctctatggatcgcatgtggatgctaacaagattctggcttatttttgcagt

SEQ ID NO: 77030 - DNA, 490 bp, Zea mays
  Clone ID: LIB3079-024-Q1-K1-D4
cggacgcgtgggcggacgcgtggggcttggtatttaccctgccgtggatcctctggattccagagccagaatgttgtccccccatgttctgggtgaggaccactacaacactgctcgtggtgttcagaaggttcttcagaattacaagaatctccaagatattattgccattctgggaatggatgagctcagtgaagatgacaagttgacagttgctcgtgctaggaagattcagcggttccttagccagcctttccatgttgctgaagttttcacgggtgcacctggaaagtacgttgagctgaaggagagtgttaaaagtttccagggcgttttggatggcaagtatgatgaccttccagaacagtcattctacatggttggaggaatagaggaggtcatcgccaaggcagagaagattgccaaggaatctgcatcataaggggtctacaggcaacgcaaaattaacttttggaggtcaacgtgatgt

SEQ ID NO: 77031 - DNA, 488 bp, Zea mays
  unsure at all n locations
  Clone ID: LIB3079-024-Q1-K1-D6
gcttcctcgcaccggctccggtcctcctcccatcaccatcaccaccgtcgttcctctcacgaggcccgacacacgcaaaccgcacgaaccctggctggcggcgggatgacgcggcggtgctcgcactgcagccacaacgggcacaactcgcggacgtgccccaaccgcggggtcaagatcttcggggtgcgcctcaccgatggctcggccatccgcaagagcgcaagcatggggaacctctccctcctctccgcggggtcaaccagcggcggcgcgtcgcccgccgacgggcccgacctcgccgacggcggcgggggctacgccttcgacgacttcgtccaggggtcgtcctncgccagccgcgagcgtaagaaaggtgttccttggactgaagaagaacaccggaggtttttgctgggattacaaaagcttgggaaaggtgattggcgagggatttctcgtaatttcgtggtctcaagaacacctac

SEQ ID NO: 77032 - DNA, 369 bp, Zea mays
  Clone ID: LIB3079-024-Q1-K1-D7
gattagaacctctaaaatttcccccactcgcctgtcgaagcagaacctgtagcattcatggaggccagctgtacacggtagcaaggggaagatgggtgcggacgatctcacggcacgctgttccaggaagaagtttgtgacgcggtccttcaaggcctgtctgcagttccccgtcaacctgatcggactctacctcacgaagggccagtacgtgcagcgcgtgaacactgtcgcgtacgtctacctagtcgccgtgctggaatacctcgtcggcgaggttctcgaattggcaagaaacgccgcgaacgacagcattaacacgcgcatcatcccgctccacgtgctattggcgatccgcatcgacgagga

SEQ ID NO: 77033 - DNA, 432 bp, Zea mays
  Clone ID: LIB3079-024-Q1-K1-D8
cccacgcgtccggagatgttgaccatcatgtcttccctttcatttagtggacaggcgaccatgggaaggccaagctgaagatgtcatatgctgttgcgctctcatgtcccgaacatatttgtgttttttttgggaaagaaacatacaatttttgttctcattctagtatcgtctacctatgtcaaactacaatatgataggacccttgctaaataattgtttcgtttgctggtaaaatatacctaatatacagagagtaaaacaacaagagcagcgaaaaccgacgacgggcccgacctcgtcgacgaaggcaatggctacgccttcgacgacttacatgcaaaagttgtacttcgacagcctcgaacgtaagaaaggtgttcctttgcactgaagaagaacacctgaagttattgctgggattacaaaagc

SEQ ID NO: 77034 - DNA, 483 bp, Zea mays
  Clone ID: LIB3079-024-Q1-K1-B8
cccacgcgtccgcccacgcgtccgaagatctctccggaaaataaatgtcgcacacagtttgggtgagatagaggcttgtgttctgagcaagttatcaacaataggagaaaccttgactgttttaagactcgacggcctcgaaatcttcgcctcgaatctccaggcaattggttctacctgcaagaatctggtcgagattgggcttagcaaatgcaatggcgttacggatgatggtatcgtttcgctagttgctcgttgccgcgacttaaggactatcgacgtgacgtgctgccatcttcttacaaatgctgcccttgctgcaatcgccgagaactgtagaaagattgaatgccttcggcttgaatcctgccctttcgtaagcgagaagggactagagtcgatcgcaactctctgttccgaccttaaggagattgacctcaccgattgtcgtattaatgacgcagctttgcagcagttggcaag

SEQ ID NO: 77035 - DNA, 395 bp, Zea mays
  unsure at all n locations
  Clone ID: LIB3079-019-Q1-K1-C7
ggctcggtgaccgcgggcgacttcgtgaccgagacgctcaccttcgcgggaggcgcccgcgtggcgcgcgtggcgctcgggtgcggccacgacaacgagggcctgttcgtggccgcggcggggctgctggggctcgggcgcggcgggctgtcgttcccgacccagatctcccgccgctacggccggagcttctcctactgcctcgtcgaccgcacctcctccggcgcgggcgccgcgccgggctcccaccggtcctccaccgtcagcttcggggcgggctccgtcggcgcgtcgtcggcgtccttcaccccgatggtccgcaacccgcgcatggagacgttctactacgtgcagctggtgggcatcagcgtgggcggcgcgcgcgtnccgggcgt

SEQ ID NO: 77036 - DNA, 403 bp, Zea mays
  Clone ID: LIB3079-019-Q1-K1-C8
gtcctcacataatcatcttcattcactcactctcttcgatcactgtactgaagagagcagggccaagtcgaccgggatgtttgtagccgccctggccctggtggtggtgatggcgacgacgagcacaggcggtggcagggcggcagcgtcgtgcgatcccaagccgttggtggtgtgcgatccggcgttcatggacggagcgaaacccgcggcagcatgctgctccaccctgcgtgcgcaggatgcatgcttgtgcgtgtacgccaaagaccccaagtttgcaaaatacatcaacaaccccaacaccgtcaaaacctttacctcgtgcggcatagccatgcccaaatgctaagcaagcgctctgcgtagtcgtttcgcttgctcttgctcttgtgtgtaacat

SEQ ID NO: 77037 - DNA, 391 bp, Zea mays
  Clone ID: LIB3079-019-Q1-K1-C9
tgagacttcaattaatctagttaatctagtctcccttctactaaagactggggcatggccagaggatgttctttcacctctcagtgctttgcggaaagttgcacgatcattgtgcatcatcttgagctatgcatcttctgcaactgttgatcaaatatatacttgtgtgctgaatggtgaaaactcttccaagtcttcaatcttacacttagcattgctgatagaaggatttcctttggattcattgtctgatggtacaaaggaacttgctatgaataaaatgtttacctcttttgctggctatctggagagctactccaagaaccaccgatttatcaatgtgccaacttgttaattgggcgttttaggacttcctatacatgctttaacc

SEQ ID NO: 77038 - DNA, 238 bp, Zea mays
  Clone ID: LIB3079-019-Q1-K1-D10
gacagatcagagccacagctatcaccatcaccttgcacccaacgcccacggggactgacatatctaccatagttgccggcggcgacatcaccaccatagcacttgtccacagctgcatttacagcaccaacaatactctactcatgagcaatgccatctacagatacgttctgaacacatgagtgctaccgcacgaacatgatagcatgcatcatctgcggctggttaccgacatgca

SEQ ID NO: 77039 - DNA, 397 bp, Zea mays
  unsure at all n locations
  Clone ID: LIB3079-019-Q1-K1-D11
cgcagatcgagtcatcaagctagctatctccggagcacgcctagacacgccggcagcagtggcggctcagctggccgtcgcgtttctcgccttgttgtcctcctctgccttcttggccgtgtctggccagaagttcaacgccatcttcagcttcggcgactccatgtccgacaccggcaacctgtgcgtgaacggtccccccgccggcctgacgctcacccagccgctctacggcgagaccttctttggccgcgccacctgccgctgctccgacggccgtctcgtcgtcgacttcctggccgagaaattcgggctgccgctgctgaaaccgtctaagcatggcggctcagacttcaagcanggcgccaacatggcgatcattggcgcgaccaccatg

SEQ ID NO: 77040 - DNA, 250 bp, Zea mays
  Clone ID: LIB3079-019-Q1-K1-D12
cccacgcgtccgcttgtcttcacacgtagagaactttgacatgttaaacaggacaggtgacaaaagtaaagcagtcattattgcaaaccctcgcacttctgaattcgaggttgttagaactagcctgatgtcgtgtttattaaaaacactgaaacataatatagaccatccaagacctataaagatttttgaagttggtgatgttgtgatgctggactcgtcacgtgatgttggtgcctctaataatcgc

SEQ ID NO: 77041 - DNA, 213 bp, Zea mays
  Clone ID: LIB3079-019-Q1-K1-D2
cgacccacagccttccgcacattaatcttttcatcttaacccttttcgaagttgaaccaccccaagacccccttgaggtctttaaccccttgacccttgaccattttcaagttaaccatatttcgcttaaccacttccctgcttttaattccgccaaacaccccaaaattcttgcccaattccccgggcgcttcttccaaaaaccgtttccca

SEQ ID NO: 77042 - DNA, 364 bp, Zea mays
  Clone ID: LIB3079-019-Q1-K1-D3
cccacgcgtccgcccacgcgtccgctcatcactataatggatacaaatgactactctggaggtccccagcagttgaaggaacagctgaatgaaaggtaccctggtgcaaggcgtgctgtactgaagactggtgttgattttcccttcctgtctcgtgctgatgaggttaatctgtaccttcagctacatctgacacgagttggtgtagagccaaggtcagacctggtccaaggctttacccgaaatggcagcgctgggagttcaaaggatcaaaaagatggaggggacagctttgataatagtggtggagacaatggccaccatggttcaggtggcagtgatcatgacaggcggcattgtgcat

SEQ ID NO: 77043 - DNA, 370 bp, Zea mays
  Clone ID: LIB3079-019-Q1-K1-D5
gttctagatcgcgagctgccgaccttttttttttttttttctgcttcgcgtctggggtttttcttaattaatttaggcagcacatgaataaaggtcatgcaacgttcaacaatgttctgctgacctattatgctccaattcgtgaagaatcttctgatgattatgctatcatcttcttcaatcgcttatggattatcatcatgtcctgctcgctgctgcaccatttactaacgacgttctgctgctaacgactctaggagtttgtggtgtgacgacacttaatgaatcctacaagatgcttgttaccacattcttgtacgatgctcatggaattgaaaatctgctgctaccaacaaaggattacctttat

SEQ ID NO: 77044 - DNA, 286 bp, Zea mays
  unsure at all n locations
  Clone ID: LIB3079-019-Q1-K1-D6
gaaaactcagagcagggtgcccgaggggtaccagcttctgatcgagtcctttgctaggcggggataatatcgcatctgaaagcatggcatggcgatgcataatttgtttacttgatcacatcatgcatgtgtaacttatggatgtctcttggtgtataagtattgtgtgaattccttctttgccatcaaaatatatgtttattccttctaaaaaaaaaaaattaaanaataataatttatattaattaaaaacccaattaaaaaaaattttaaaaactatattatt

SEQ ID NO: 77045 - DNA, 270 bp, Zea mays
  Clone ID: LIB3079-019-Q1-K1-D7
cccacgcgtccgtagctagccagtgtccttgcgaagtgcaagcagcggagtgggctgtatttcctgatcaaataattttgcctatggcacattctgtggaaactttgacggatctttgcctgcttttctatgcgatgtaagctgctgaaacctgcactcatcaaatgttgtgtatgcagatggtaccatgcatttgtttccctgaatggcttcaaatgaaatgaatgttttttttaaaaaaaatctatttaattaatttaatttttaaaa

SEQ ID NO: 77046 - DNA, 117 bp, Zea mays
  Clone ID: LIB3079-019-Q1-K1-D8
aaaaaaaaaaaaaaaaaaaactaaattttttaaaaaataaactaaaaacaaaaaaacgaaggttacttataaaaacaaggcagactatttataatttctagtttacccaaactttca

SEQ ID NO: 77047 - DNA, 391 bp, Zea mays
  Clone ID: LIB3079-019-Q1-K1-E1
gttgttttcctgtaccttcttgacaatgacacttcatggatgatccttgctagctctggaggtggtgtgtgcattgaattttggaagattggaaaggcaatgcatattgaggttgatagaagtggaaaaattcccatgttgaggttccgagaccgtgaatcatatgcacagaataagactaaagagtacgatgccattgcaatgaagtaccttacctatgtacttttactccttgtggtcggttcctctatctattcacttaagtatgaaaagcacaagagctggtactcatggatactatattctatgacaagctgtgtgtacatgtttggtttcattatgatgtgcccccaattgtttatcaactacaagctgaagactgttgctcata

SEQ ID NO: 77048 - DNA, 353 bp, Zea mays
  Clone ID: LIB3079-019-Q1-K1-E10
gcagaagataaatcactacccttggttgatccttcatcagctttatgtgataatcagttcaatgatacctacctgttgagtgaacaaaagaatgtgaatgcatatggtgaacagatataccaagaggatttgatggagttgttgcccactgaccagatatgcagcggacatgaaaacattgatatggttggaaaccagtatccatctgaaaatgcaattcaaggtaccgaagataagaaattctctatagcgtcaacttcccagctgagttctcagaatttactgaatcaaagacaccacttagattccagttcaccaagcaatattacttcgaagtcctatccaggaaagtt

SEQ ID NO: 77049 - DNA, 382 bp, Zea mays
  Clone ID: LIB3079-019-Q1-K1-E11
cccacgcgtccggcaccgcctcctcctgccgcgcgccccgcggcgaacccgtgcaacgacctcttcgtctcagggttaaataaacgcacaacgtccgagggacttaaggaagcattttctaaatttggtcaggttattgaagcaagagtaatcactgataggatatctggatactccagaggatttggctttgtcaaatatgcgactgtacaagaagctggtgaggccataaaaggcatggatggaaaggtcagcgcatgtgtttgactgcagttaatttccagcttcactgttcatggaagacgttaaccacattgaatgttctttataatcctaaggccctattccaaacctctagagctaataattagtcagctaatat

SEQ ID NO: 77050 - DNA, 377 bp, Zea mays
  unsure at all n locations
  Clone ID: LIB3079-019-Q1-K1-E12
gccaataccctaggcctatgaaattgtcatcaaaatggacattcagctctgacactgtcctaaagactgctgaacaggcaccaagaaccccatcgtttgcagatcagttaatagaagctgacaatggtcttggcgaagtaatgaaaccacctgagaaatctttctgggctaaatattggatgtacatcattccgcttggtcttattgtcatgaatgctgttacggcagctgccaacataccagaggaagctgcanggcagggccaacctggagcacaaacgggcacctgctgcttgttcttggaagaagaaatgatggcttgctttcataacggagtaactatcttcacattggtttctggtttttttggggtattg

SEQ ID NO: 77051 - DNA, 257 bp, Zea mays
  Clone ID: LIB3079-019-Q1-K1-E2
gcctggagtaccgccacaaggtgcttaagcagatgaactcgagctgcagcctcagcgagatgctagactgtaaccacaagaagtttgccatgaaattcggtttggtcgcagcagtttaggtactcaacttttctctagtccaatccaaggtagtttgttttattctcaggtgaatctttccgtttgtaccgtcaggttgtgttgttcttttgaacatttgggcaatgataactaataattcaaggtcctttacaagt

SEQ ID NO: 77052 - DNA, 386 bp, Zea mays
  Clone ID: LIB3079-019-Q1-K1-C6
gcaacgagcgccgctccccttcaccccttcgcctccctccaaaactcaaattgacgtagcgagaagcagaagaggcgaagagtgataacgaacctctcccacatcgatttccccaaatcgcctggcgcgatgaccacggcaggagaggtggattcggcagcaggaggtgaggacctggagccgctcttcgactacaagcgagtgcagcccaggatgacgttctgctttgacgacagcgacttggaggtggccgacatcttcaaatactgcaacaagcgcccaaaggtccacacctccacggaggaggagggtaagcctgacgaggaggtcgccgctgccaaggtggtggtcctcgatgaggaggattggttgcaaccaccgtcacc

SEQ ID NO: 77053 - DNA, 421 bp, Zea mays
  Clone ID: LIB3079-019-Q1-K1-E3
gacaggaggaagaggaagaagaagcggcagcgagcgaggatgccgtgcctgaacgtgtggagcaacgtgaacctggagggggtggacacctgcgccatcctcgccgaagcctccaagtccgtcgccaacatcatcggcaagcccgaggcctacgtgatggttgttctcaagggttcggtgcctatggcatttggaggtacccaggagccagcagcttacggtgagctggtttccatcggaggcctgaaccctgatgtgaacaagaagcttagtgctggcatcgcttctatcctggagtcaaagctgtctgttcccaagtcacgcttctacctcaagttctatgactcgaagcgctcggactttggttggaacggctccaccttctagacttgaggtctgcagctgaaataaaagaaattcg

SEQ ID NO: 77054 - DNA, 417 bp, Zea mays
  Clone ID: LIB3079-019-Q1-K1-A6
gcagcacatcaagaacctcctcagtccatccaccccgttcttcttcaacaccctggacgacccctaccgtgagggtgctgactttgtgcgtggataccccttcagcctcagggagggtgctcacaccgccgtctcccacggcctgtggctgaacatccctgactatgatgctcccacacagctggtcaagcccaaggagaggaatgagaggtattgcattttgctctcgtcttttatctgacattctagcaactgccctgctgctgcatgaagggttgggtctaactcccttttttttcaggtatgttgatgctgtcatgacaatccccaagggaaccttgttccccatgtgtggcatgaaccttgccttcgacagggatctcattggccctgctatgtactttggtctcatgggtg

SEQ ID NO: 77055 - DNA, 375 bp, Zea mays
  Clone ID: LIB3079-019-Q1-K1-A9
ttgagttttctgaagcctggtgggtgggaacaaaagaagataatccggaggagctcagacttgagtttccaaaagaattccaaaatgatggcacgacagcagactgtgatttcagaggtggtgcaggtggtgccatcgatgaagcaactggaagcaaagctggaatggaaattgcagaacctcgttccccaaagtttgcatctgatgacgatgctcctgaagattcaaatcataaggatgagaataacacacagactatgagtggaacaccagttagacagtctgctaagaatgcatggaaaaccttgaaaaggtacacagacttatcttctggaggtgaatcgtctgacaataataatgaaactgatatatctg

SEQ ID NO: 77056 - DNA, 344 bp, Zea mays
  Clone ID: LIB3079-019-Q1-K1-B1
gatgaatctgagaagatgaggaatggctaaaggtctcacaagaatggcggtcaccgtggcggtcaccatcgacaccaccatgaatgacatagtaactctgcagaacctaatgacaggaggcaagtactgaaagatggccagagggcccttgaaggtgacagcgcatactgaagatatcccagcaaggtccagttaattgtccttattaaggacatgaagatcatttttttttcgttcctgatgttctcagataattattgtattgctgacaacatatctttgatttgtgaatatactaaacatgttgcctaaaaaaaacaagggaacaatgaataagaaccaaa

SEQ ID NO: 77057 - DNA, 243 bp, Zea mays
  Clone ID: LIB3079-019-Q1-K1-B10
cgcgaaagccgttgcgcttccgtacacgcgcatactcttgctccgtcgcgcgttagggtaggttagtacttagtactgaacttagtacaataacgcgcagccgttttgggcggacacggttctctaaaggcgaagactctgaagtgggcgaacactcggcccagcgggcgaacatgccggctccggctccgcgcacctgctgacacctttcgaagcactttcacgtgtgaaccgaagtcgtct

SEQ ID NO: 77058 - DNA, 406 bp, Zea mays
  Clone ID: LIB3079-019-Q1-K1-B11
gtctcgcctcgccaaggcaaggcttcctttcctctcccttcccgtccaagggggaaggagagtacccccaccagcatgcggccccctcttactccacgaccgccaccgtcttctggccgtacgcgactcgccgcagaaagagagccgaggacggcatcgacctctcgctggcgtcagatatggatctcgacgccgacgcgcagcgcgccgcagataagctgaaagcagtgtcagaggaacttggacatgagatccgggttttttcaagtgagaactttgctctacaaccgagcaagctgcctagtgcagatcatgaggaaggtgacgacttttatgagcttcagcctgctgattactacaacttgatttcaaacaggatgggagagctatctaaaatgctaaagac

SEQ ID NO: 77059 - DNA, 427 bp, Zea mays
  unsure at all n locations
  Clone ID: LIB3079-019-Q1-K1-B2
gcgtgactatatcatgagagtagtttgtgaagcgacacagtctccagaggtgaagatgagaggcaggccgcctttgagtgtttggtggctatctcgtctacttattatgataagctggcaacagacatgcaggatatatttaatataactgcaaaagctgtgaggggagatgaggagtcagttgcactccaggctattgaattctggagttccatatgcgatgaggaaattgatattctggatgagtacagcagtgaatttacagctgattccgatgttccttgctactactttatcaagcaggctcttcctgccttggtgcctatgttgttggaaactctcctcaagcaagaggaagaccaagacttggatgaaggtgcttggaatcttgcaatggctggnggaacttgtttgggcctggtggcaa

SEQ ID NO: 77060 - DNA, 431 bp, Zea mays
  Clone ID: LIB3079-019-Q1-K1-B3
cggacgcgtgggcggacgcgtgggcggacgcgtgggctaacgagtacaaagtacgaacgacgcacacacacaccagcaggcagccgcgcgcgggctcgatcgcaatggcgtccaaatcctccactgcggccctcttcctctacgcggctctcctgctggtcctggtgctggtggcggtttccacgctggcccaggcgcagccgacgccgccgccgccgcccagctcctcgtgccccttcaatggctccgtgccgctatccaacatcacagaggtccttggactgctcgcggagctggacctgaacactgccgcccagtgcctctgcaccgctgtggaaggtgtcacttccctcgtccgcctcctcctcggctccatcgggctcatgctgcccttcgacttcgagtgcaccagcacctaggcgcatgcatgc

SEQ ID NO: 77061 - DNA, 420 bp, Zea mays
  Clone ID: LIB3079-019-Q1-K1-B4
ggtcggtctgctctgtcagcatgagtggaggccaaagtccctcgtgactctttcagctgaggatgatccaaaggtggtaagtgcgccttcaaggatcggcgtggccatatcgctcaagccttgagatatgggtcaagtcaccttctgtaaaacagtacaagcgttacgtactgatactcgtgtccaagaacataaacttttggagcgatacctagaacaaccctctccattttagccttgtttttggtaagagccttgggcaaagaagtgttgtcagggagttggacttgttttgtggaatgtttccattaagagccaaccccacaccgaggattgcaaacacagaagtttgtattagtgcagaagtttcactctgcgatattttttccccatgttttcctagtcgacgcaaaatgattt

SEQ ID NO: 77062 - DNA, 433 bp, Zea mays
  Clone ID: LIB3079-019-Q1-K1-B5
agacatcaccacaataggcttacatgacctgcgttcacgtttgggtatcattccggaggatccgacactctttcaaggaaccataagatataatctagaccctcttgggcaattctctgatcaacaaatatgggaggttctaggcaaatgtcagcttcttgaagctgtccaggagaaggagcagggattggactcacttgttgtggaagatggttcgaactggagcatgggtcaaaggcagctcttttgtttgggacgtgcacttctaagaagatgccgtatcttagttcttgatgaggccacggcatctatagacaacgctactgatgctatccttcagaagacgatcaggacagagtttagagattgcactgtcatcactgtcgcacaccgtatacccaccgttatggactgcgatatggtacttgcaatg

SEQ ID NO: 77063 - DNA, 333 bp, Zea mays
  Clone ID: LIB3079-019-Q1-K1-B6
accactcgtccgggaaccttacctatctgctgccgccgccgcctaattcatcctggctgggctctagctgctatctgggtgcgacttcacatactctattcctgaatggacgaataatatataacatgcatgtacagctagcgaccatgtctgaatgacatcttcgttgctagctgatgctgctactgctacctgtcactttggtgttctaaaagactctgatgaagcgttctgaatgtctgcatttcaagtttgctatgtgacgttaaaaaaaaagccgtatcttagatcttgatgaagccacggcatctatagacaacgctactgatgcta

SEQ ID NO: 77064 - DNA, 367 bp, Zea mays
  Clone ID: LIB3079-019-Q1-K1-B7
ttgcaaagctcctcctcgatccattgatcactgcaccggccggcggcaccgcgcgggcgggggctagccaacgaggcggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgcttggccccgccgcgc

SEQ ID NO: 77065 - DNA, 429 bp, Zea mays
  Clone ID: LIB3079-019-Q1-K1-B8
gctaccggcgcctccaccctccgcctggtgtccttcgccgtcgacgagcgcacaccagggtacagtacgtattgctcgtgatttgtgtaactacggagcaagctgcatacagcacaagatagaagatgggtatccttgagaggatcaaggagattgaggccgagatggctcggactcagaaaaataaagcaacagaatatcatcttggacaactgaaggcaaaactagcaaagttgaggacacaactattagagcctccaaagggttccagcggaggtggagatggttttgaagtcacaaagtttgggcatggtcgtgttgcacttattggatttcccagtgttggaaagtcaactcttttaacgatgttgactgggacacattctgaagctgcatcatatgagttcacaacgcttacttgcattcctg

SEQ ID NO: 77066 - DNA, 69 bp, Zea mays
  Clone ID: LIB3079-019-Q1-K1-B9
aaaaaaaaaaaaaaaaaaaaaaaaaaattaaaaaaaaaaaaaaaaaaaaaaggaaaaaggagcattcaa

SEQ ID NO: 77067 - DNA, 435 bp, Zea mays
  Clone ID: LIB3079-019-Q1-K1-C11
catacatctcacttcgccaaaaaaatttcgtcaacagttgaagttatacccgtggcagaactactcttgggtttgctccttgcccttgctattctagggacaacatcggctgctggttgtgtacaagacgcggaagacatgaaacgagagtgcaagcagtttgagctattcccagcgaacccaaagttgccaccgtcggcagcatgttgtgctgtgtggaagagggcagatgttccatgcctatgcaaatatgttaacaaggaagtagagaaggtatggtgcatggagaaggttgtgtacgtcgccaactattgtaagaggccgtttcaacctggctacaagtgcgggagttatacagttcctcttagtatgtaaaaggagtggttgggacatgtggtactctcttctagaactttaatttgagatttgtaacat

SEQ ID NO: 77068 - DNA, 304 bp, Zea mays
  Clone ID: LIB3079-019-Q1-K1-C12
aaaaattcctcgcctgattgattttgacaacaaacgtgcatatttccggtgtaaaagcaagcatcagtatgatcatcatcatcataatcctgttagaatttctgtgcgtcgttcatatattcttgaggactcctacaatcagcttaggatgcgctctcctcaggacttgaagggtagactcactgttcattttcaaggagaagaaggaattgatgctggtgggctgacaagggaatggtaccaatcgctttcacgagtcatttttgacaagagtgcccttctatttacaccagtcgggaatgat

SEQ ID NO: 77069 - DNA, 392 bp, Zea mays
  Clone ID: LIB3079-019-Q1-K1-C3
cccacgcgtccggcgaggaggcgtgccatgccagcggtttgcgatgacggcaccggcggagaaggggaagaaggccaagaccgatgccgacggcggcgaggagaacgagcaaatcgacggcgcccttgtcttctccatcgagaagctccaggagattcaggacgagctcgagaaggttaatgaggaagcaagtgacaaggttatggaggtggagcagaaatacagtgagattcgcagacctgtctatctcaagaggggtgacattatcaagaccatcccggacttttggctcacagcgtttttgagccatcctctactaagtgagcttctgactgaagaggatcagaagatattcaagtacttggactccattgatgtcgatgattctgatg

SEQ ID NO: 77070 - DNA, 414 bp, Zea mays
  Clone ID: LIB3079-019-Q1-K1-A4
cagaagtaaatgaatctggaagtgttttggctgttgatgcactctcgcaagttaaacgtgggctgcttccagtccttgatcgcaacccttacctttctgaaggcacaagacaggctgcagcaacaaccgcttccctcgcaaagaagtatggagcagatattactgtagttgttattgacgataaaccaaaggagtctgtcccagagcatgatactcaaatgtcaagcattagatggcatctctcagaaggcggattttcggagtttagattgatggagcgtcttggggaagggcagaaaccaacagttatcatcggggaagttgctgatgagtgggacttagacctggttgtgctaagcatggaggcaatccactccaagcatgtcgatgggaatttgctcgctgaattcatcc

SEQ ID NO: 77071 - DNA, 437 bp, Zea mays
  unsure at all n locations
  Clone ID: LIB3079-018-Q1-K1-G7
tggcttgngacctttgggctgatttatgtgcttggggaaaaggaccggtctcgagggcatacggagaccatcggtcctagcgtcttagcaagagagtagactcataagacagtcctagcgaattcacgtcttaacactatcggctaaacttccgtgagttctgctacgaacttattaaaggccggagatgaactacacgtccttcataaggtagagaaagacggaacttccgagctcccagtctgctgcgtaaaggtgccggaggacgtacctaataagtccgagggacccctacgcaataaggttgaaggagtaacgcactcccctttctagacctcctcgttatagaaggtaactgaagtcgtcaaagtcgtcaagaaagtgttcgatgtccctcatgtctcttgctcttccgaactgatcggaactgctgcggc

SEQ ID NO: 77072 - DNA, 326 bp, Zea mays
  Clone ID: LIB3079-018-Q1-K1-G8
ggcttggacctttgggctgattagtgcttggccagatagctcgaggcataagtaaagagcatagtgaatataccacgactgtggtcggcagttgcgtctaatgcgctactacattcggaaaggactcggtcaccatcctcgacgaggttccgagtccgaacgagtccgtaaagcgtgtcgtaacttcaggcattatcacacacagtcgacgaactggtcctcactcggtatccggacggtcgtcgaaacatacctgtcgcacttaagagactcattcgcaagaggtcgcgacgacaatacgagagtcaactgtcgtagtaactccg

SEQ ID NO: 77073 - DNA, 408 bp, Zea mays
  Clone ID: LIB3079-018-Q1-K1-H1
ttggaactttgggctgatttatgtgcttgtttatgtgcttgttctttcgttggtatgggtgttggtggttgcgcttgctatatggcgcttaagaggtaatgatagacagacgaaaaacggaagtacgactcgcactgggaagacgacgaattagtcctaaaactaatagacttgaaggaccggtgaccgaagtcctagaggtgaagcccctaataagaccccattagtataagaagcctcggggcgtgcgactcatgcgagaagtcactcggcacaacgaatttatagttactaaacgtcgatttattaaagttaaagttaaagttagcactggaagccgccaatactctaaggtgctaaaccgtcgacgaaacgtacgtatgttaaaaaaagaaattattaaagtag

SEQ ID NO: 77074 - DNA, 248 bp, Zea mays
  Clone ID: LIB3079-018-Q1-K1-H10
cccacgcgtccgacccgcggcagcatgctgctccaccctgcgtgcgcaggaggcatggttgtgcgtgtacgccaaagaccccaagtttgcaaaatacatcaacaaccccaacaccgccaaaacctttacctcgtgcggcatagccatccccaaatgctaagcaagcgctctgcgtcgtcgcttcgcttgctcttgctcttgtgtgtaacatatccagcttatgaataaattatgtggatcagttaatt

SEQ ID NO: 77075 - DNA, 420 bp, Zea mays
  Clone ID: LIB3079-018-Q1-K1-H11
ggcggcggtgctgctgctgcagcacggtggagccgcgagcgccggcggcaacttctagcaggacgtggacatcacctggggcgacggccgcggcaagatcctcgacaacggccagctcctgacgctgtccatggacaggtcctccggctcgggcttccagtccaaggcccagtacctctacggccgcttcgacatgcagctcaagctcgtcccgggggactccgccggcaccgtcgccaccttctatctttcgtcgcagggttcgcagcacgacgagatcgacttcgagttcctggggaacgcgagcggggagccgtacacggtgcacacgaacgtgtacagccaggggaagggcgggcgggagcagcagttccggatgtggttcgaccccacggcggccttccacgcctactccgtgct

SEQ ID NO: 77076 - DNA, 384 bp, Zea mays
  Clone ID: LIB3079-018-Q1-K1-H12
gcacgcggcggtggagagcgcgtcgtccacgtcgtcgtgcgtcaccgacgcctccgggaccatcggccaggacgatgacggcgacgaagggatcagtggcagctgcagcgtcgcctgctctaattgagaccgactagaacaaacaagagttggctagcccgcccgtcgaccaaatcacgggcgccgtgtcctaattgccgtagcaccctctcagtctcagtccctagtagcaatcaatagagagaagaagcttgagcttcaacaaaccgacaacaacatcataaaaaggctaagcgctttgctgccatgttatgttgttgctggagctcgtcgcgaatccagagtgttaattagcgagagaatcaatcagatcccttccagcgc

SEQ ID NO: 77077 - DNA, 92 bp, Zea mays
  unsure at all n locations
  Clone ID: LIB3079-018-Q1-K1-H3
ttggaantttggggtgatttatgtgnttgtttatgtggttgaaaaaaaaaaaaaaaaaaaaaaaaaaaaaaaaaagaaaaaaaaaagggaaa

SEQ ID NO: 77078 - DNA, 414 bp, Zea mays
  unsure at all n locations
  Clone ID: LIB3079-018-Q1-K1-H4
ggacctttgggctgatttatgtgcttgtttatgtgcttgaggatttccgtcgatcataatacttagaaggagagtatttcttatccggcgtcgtgctccacgggcggcacgtagactcccgcgaaaatttccatcggtaagattactatctccgaggcggagctcctagacattaccgataacgctaaggttaagacttaggataaggagggtactttgttggattagtagtgctccactcccgttggtaagtagtcggaggacggatgtatttccgtggaccataatacctagaaggagagtatttcntattcggcgtcgtgttctaagggaagaacgtagactcctgcgaaaataccgatcggtaagattactattccggaggccgagagtcctgatattaccgacaacgcg

SEQ ID NO: 77079 - DNA, 437 bp, Zea mays
  unsure at all n locations
  Clone ID: LIB3079-018-Q1-K1-H5
ggcttgngacctttgggctgatttatgtgcttgactatctttacgggcggtcctttttaccacggcactgcgaagggcgatcattcgacgactaagggtcgtcgcgcgggcttaaagaagagggcggcgatttcttgttagctttcttcgaagtagatcctttggtcggtgtcggaggagactaagtctaagcctactgatatactgcttaaacccgggtatggctgcccttagatcattgacgagaagtagaggcctcccggtaagtctaaggtgcaaggcgtcgtggcgtagtgataagctttaccctctaaaactactaaatcgcgacatccccgcccgcaattccgtcgcatcaagccccgcagttggacggcccgggagtacggcttggctcctcacggaccgccttacgtcctcgaaatcgtacgctcacg

SEQ ID NO: 77080 - DNA, 433 bp, Zea mays
  unsure at all n locations
  Clone ID: LIB3079-018-Q1-K1-H6
ggcttgngacctttgggctgatttatgtgcttgtttatgtgcttgtttatgtgcttggaagtccacaatagaagtcgacggacattagtgctatccaacagtcttagaataaggacactgatgttccacagaactccgctccaccagcactagaggcttcgttgaggtagtcgccgacgtggcatacgtaacctcgaaggattctgcttgtaaggtcactaacgaaatatacgagtcgaagtagccctttatttcctgcgcggaagcaggtaacgtagtccccgagctaccggacagaacgagggacgaaagtaagaaaaacataccaaagtcagccgatacggaacgtagtcatccgatagcagaccctcctaggaagtccttttaggacgccgagaggggcggaaacttaaattatctccaccccgacaga

SEQ ID NO: 77081 - DNA, 476 bp, Zea mays
  unsure at all n locations
  Clone ID: LIB3079-018-Q1-K1-H7
ggcttgngaactttgggctgatttatgtgcttgtataactaatcattcaacctctctttccgcacgtgagtcgtatcttacacccccgtgcgcaaggaaagcgaggtgaacggccggaccctgagaccctgatagaataacggcgaagtcggaacggccatctaatcggatcattcccgcgatagtaagggcgacacgctacactcagacaatccataagtctgctgtcgacgtctataaacccgggaagggtaccgagtccttatcagtctcctccggcacggtaggaacgaactcgtctaatacaccctcagggtccgactcatccaaagtacctatatgagaaagaaattagtaaagttactaggaccgaacgcgtcccctccgacggcggcgcatctaaaaccccgagaaagtcgcagccttgcctaagcagggtaaagagacacgcccaagctccaaccagtaatcatatc

SEQ ID NO: 77082 - DNA, 421 bp, Zea mays
  Clone ID: LIB3079-018-Q1-K1-H9
gctccagcaccggccaagctccgggcgacgacagcgaagtcatcctttgccctcggggcatcttcagggacccgttcaggaaggggcagaacatactggtcatgtgcgactgctacgagccgaacggggagccgatcccgagcaacaagcggcacggggccgcgaagatctttagccaccctgacgtcaaggctgaagaaccatggttcgggattgagcaggagtacacccttctccagaaggacaccaagtggcctctcggttggccgctgggcggctaccctggccctcagggaccttactactgcgccgtcggagcggacaagtcctacgggcgggacatcgtggacgcgcactacaaggcctgcctctacgccggcatcgacatcagtggcatcaacggggaggtcatgccggggca

SEQ ID NO: 77083 - DNA, 400 bp, Zea mays
  unsure at all n locations
  Clone ID: LIB3079-019-Q1-K1-A1
gtcggggtcgaaggtgtacacccttgaggaggtggccaagcacaacaccaaggatgagtgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgcccnccaagcagccgcactacaaccaggataagacccccgagttcgtcatcaagatcctncagttttttgtcccccttgccatacttggccctgctggtgctgtaaggatctacaccaagtcggaatct

SEQ ID NO: 77084 - DNA, 429 bp, Zea mays
  unsure at all n locations
  Clone ID: LIB3079-019-Q1-K1-A11
cccacgcgtccggcgacgactgcgaccgtcacaccccccctatgtgctaggggccagggtccgtcgggtccttggctggcgacgagcaactaccaggcgacccagtggtgtgttcgggaacgtttccgcgggcgggcggcggcccccagtggcgaagatgatctgactaccgacgtacgcagcacgaggcgttcgttgccatcttcttctcctttgagtatatgatactagcaacatccacggtatcaacattcgtgaagtatatattctatgttagtgacatgctaatggaaggtcaatgggagaaaaaggcagtgtatacattttacttggagctcataagtgaccttgtgcacttgtcattatacatgctcttcttcatagttattctnctgaactatggtgatcggcgaccgtgatcttccatgt

SEQ ID NO: 77085 - DNA, 358 bp, Zea mays
  Clone ID: LIB3079-019-Q1-K1-A12
attcccgtctgtacccactcatccacccactcttccttctacgatttcgattttcacaccccccctatgttctaggtgccagggtccttcttatccttcgctggctactatcaactaccattctacccattgttttgttctgtaacttttcctctctcttacttcttctcctcagtttctaatattatcttactacctacttactcatcactaatctttcttttccatcttattctccttttattatattatactatcaacatccactgtatcaacattctttaaatatatattctatgttatttacatgctaatgtaatgtcaattttaaaaaaattctttatatacattttacttt

SEQ ID NO: 77086 - DNA, 353 bp, Zea mays
  Clone ID: LIB3079-019-Q1-K1-A2
gcggccgcgagctctatggcttgtactgcagcctacctggcgcgcgggccctcacagagggagccagtgcgcctgctgtagacatgaccctcaatgacacgctcaactgagccgtctactggcatctattctacaagcacgtgtccaatctgatcatcaaggaccaggacgacatagatgtggataacctctacttcgtcgataagctcattgcctatgcggacactaagcacatgcacttgaagagccgcgatatctacaatactacatgggcaccatgcatcactaaattcacatgacacgaggctgcagattaccggatctacatgatctacaatgattgcaaggaggac

SEQ ID NO: 77087 - DNA, 437 bp, Zea mays
  Clone ID: LIB3079-018-Q1-K1-G6
tggctttggacctttgggctgatttatgtgcttgtctttttagttttgagactcgtctaataacggtgatgtggtgttatacttcgtcttgtgttgtcgttcctgcgctttcctctgtgtctgaggtcgcggagggttctgaagaggggttttgtgggtgttggtcgtcggcttcgtcggatgattcggttgcgtggctgctgtatctggttcctcctggtctgtcttaggtgtgtgggcctgactctgaaccttgttctgttgatgattttaagtctctgtcgtattgtcatggttagcattctcatgacggttctgcgtcgcctgtttgtcttattttatgccccggcggactagcggattagaatgtagcttccgaacccaccgacgtcgggtccgacacgacttcggtggtagaacttctcgttctcgactcc

SEQ ID NO: 77088 - DNA, 427 bp, Zea mays
  Clone ID: LIB3079-034-Q1-K1-B10
tcgatacactcacccatccaccggaaacgccaaacggccggtacacaactacacaagcgcggggcaaatatagcctgctgcttggtccttatcgcagcggccctgcttgcgctggcctcgtcatggcaacaggccatcgcctacgatcctagcccgcttcaggacttctgtgtcccagacaagaactcgcctgatcacgtcaacggattcccttgcaaggacccgatggcagtcaccccggacgacttcttcaacgcggcgatgatcatcgacaagcggatggacacgaacaacaatgtgaggtccaacgtcaccaacgtgaacgtggacagcttcccggtgctgaacacgctgggcatatcgctggcgcgcatcgactacgcgccgctcggggtgaacccgccgcacatacacccacgcgctaacg

SEQ ID NO: 77089 - DNA, 369 bp, Zea mays
  Clone ID: LIB3079-034-Q1-K1-B12
ctcatgcgtcccatgttctgctgcacgtctagatgcctgaacgtagcatccatcggggggtgctttgcacacgcctagaatgccatttatggacctacatgtcatgtataatgtatactcgtaacccaaaccaagaatagttgaaacggcaggcgctgtaaactatctaaactcactaactcttgcatgcaacctgatagctatggtatatggtcagctcacattcaaacactggccgtatcacataaacgtcaagactggtaaaaccttaaattgaccccactaaagcgtactggaatacatacacctttagaaaggtttcattaaaacttacaagtatagaccgatcaatctgcacaacagatgctc

SEQ ID NO: 77090 - DNA, 354 bp, Zea mays
  Clone ID: LIB3079-034-Q1-K1-B4
actagccctatcgccaacgactccgtgttcacccatcgctcaagctcctcacttcctgggagggcacaccgtaacgccaccatgaacttcaacatcacgaacccttccaccgtgtgccaaaagaagctggaaatcgatgactaccagaacctgcgtgccttttatgaccgaatgatatcccacgaagtcagtggcgatgctctgggtgaggagttcaagggctatgtcttcaaaatcatgggtggatgttacaagcaaggcttcccaatgaagcaaggaatcttgacttctggacgtgttcgacttctgctccatatggggactccctgcttacgtggttatggcaagcgtaat

SEQ ID NO: 77091 - DNA, 441 bp, Zea mays
  Clone ID: LIB3079-034-Q1-K1-B5
cccacgcgtccgcttcaactcatatggtagccgaagaggaaatgatgagatcgtggcggggggaacctttgccaacattcgtcttgtgaataagttcttgaagggtgaggttggacccaagacaatccatgttccatctggggagaagcttgcagtttttgatgctgctatgaaatacaagaatgaagggcatgacactattatcctggctggtgccgagtacgggagtggaagctctcgggattgggctgcaaagggcccaatgctgcagggagtgaaggctgtgatagcaaagagcttcgagaggattcaccgcagcaatcttgctggcatgggaatcatccctctatgctacaaagcaggggaggatgcagacaccctgggcctaaccggccatgagcgctacacggtccaccttccaaccaatgtgagtgagatcaa

SEQ ID NO: 77092 - DNA, 356 bp, Zea mays
  Clone ID: LIB3079-034-Q1-K1-B6
cccacgcgtccggtgaacgatatggcctccacgataccgtattctcccaaagtctacgcgtacgacagcttgcgagctgaacttggtgattgaccatataagattggatctctgaccgacaagccactatgatgaattgaacatatcttctaccagacaaaatcctggaaagctgttgattaccatgtttcattacgctgtaactaccttcatgtcatttcctggatcttgcgaatcatggattttccctacaataatgcaaccggttgcactggcaactattcctgaaacaaaaagcttaaagaggattcaaccgaacaaatcttgctggcatgggagtcatccgtttatgctac

SEQ ID NO: 77093 - DNA, 440 bp, Zea mays
  Clone ID: LIB3079-034-Q1-K1-B7
cccacgcgtccgggctattgcctctgccagaatgaacggagaatatcctgagggagtgggacagacagagtgtcagtattatctgaagaccggaacatgcaagtttggtcctacatgcaaatttcaccatcccagggaaaaggccggaattgcagggagggtgcagctaaacacattaggatatccacttctcccggtttgtattatcttgccagttacatgtcctcttctacatatgtctgtttgttttgctgaaaaggagtctactttacttttgtagaatgaaaaggagtgtgcgtattatttaaaaacaggacaatgtaaatatgcaaatacttgtaaattccaccacccagaacttttcaatgtggtgccttcgtcacgtggttcacctatttatacttctgtacattcctctgcaagcgctggtccacagtcat

SEQ ID NO: 77094 - DNA, 427 bp, Zea mays
  Clone ID: LIB3079-034-Q1-K1-B9
gtcctctacctggcgtacgcgccgcggcgggcgcgcctgcggactctggcctacttctgcctgctggacgtggcggccttcgcgctcgtcgtcgccgtcacgctcttcgccgtccgcgagccccaccgcgtcaagttcctcggcagcgtctgcctcgccttctccatggccgtcttcgtcgcgccgctcagcatcatcgtcaaggtggtcaagaccaagagcgtcgagttcctgcccatcagcctctccttctgcctcacgctcagcgccgtcgcctggttctgctacggcctcttcaccaaggacccctttgtcatgtaccccaacgtcggcggcttcttcttcagctgcgtccagatgggcctctacttctggtaccgcaagccccgcccggcggccaagaacaacgccgtgctgccgacgacca

SEQ ID NO: 77095 - DNA, 372 bp, Zea mays
  Clone ID: LIB3079-034-Q1-K1-C1
tgaaattattgtttctcctcctgttgtgtccttccgtgaaaccgttcttgagaagtcgtgccgcactgtcatgagcaagtcacctaacaagcacaaccgtctgtacatggaagcgcgccccctggaggagggtcttgctgaggcaattgatgatggccgcattggcccacgtgatgatcctaaggtgcgctcccagatcctctctcaagagtttgggtgggacaaggatcttgccaagaagatttggtgcttcggacctgagaccaccggcccaaacatggttgttgatatgtgcaagggagtgcagtatctcaatgaaatcaaagattctgttgtggcttgtttccagtgggcatcgaaaggaggtgcact

SEQ ID NO: 77096 - DNA, 409 bp, Zea mays
  Clone ID: LIB3079-034-Q1-K1-C10
attacatcagcacgcttgcatcagggccttatggtctcatatatgcctcttttgttccgttctttcttgacattccaatcacatcacggttccgtatttttggtctgaatttcagtgacaaatcattcatttacttagctggttatcagcttcttttatcttcttggaagcgctcccttattcctggtatatttggtctggttgctggttctctctatcgtctaaatgtgctcggcatccgcaagatgaagcttacacaggttatttcatcattttttgcaagatatttcgcccctttcccaggaagcacatctcgcccctccaggagtcttgttggaaacacaccgtcccatagaggccgtgctgttcagaatcagccatcaactggatttgcacctatcgtggaacc

SEQ ID NO: 77097 - DNA, 345 bp, Zea mays
  Clone ID: LIB3079-034-Q1-K1-C11
atggcatacacacgctagcgtattggacatatggtctcatttatgcctgtactgggatgttgtctcttgacattccgatcacatcacgatctccgtatttttcgtctgaatcccagagaccaataatcgatcatcttagctggttactagctgcttctataatgtaacaagcgctaccttattcatgagccatacccactgattactggttgtatctatgacataaatgtagctacacatccgcaacatgtacattacacacaatatgaacttatctgacgtaagatactccttccatttgctatgaaacacatgttgcccctgcaggattcttgctgtacacac

SEQ ID NO: 77098 - DNA, 367 bp, Zea mays
  Clone ID: LIB3079-034-Q1-K1-C2
ttcagttctagcatctgaatctggtaccgcacatggaaagggcaacactaagaaggtgtccggaagagacttccatgctgtgtctatggaagccaacaaggggactagttcaacgccattccagaaatctcgtgtgtcaaatgattgccatgtgaaacttaaaattaagtcttttaaagcgcctgaacttcttgatgaaactctagaaagtgcaactgttgactcactaatgaaaactgttatcgaggcactgactgctattatcagaggtggtctccatgttggtgatcttcaccatggaaagcaagttatagatgataataaaacgtcgattcaggctggtatcgatcaggaagatatgctggac

SEQ ID NO: 77099 - DNA, 426 bp, Zea mays
  unsure at all n locations
  Clone ID: LIB3079-034-Q1-K1-C3
tggcatcttacctttatcacccttgttcctccaacaatcatcagccctattacatcaggtacctttggtgcatttattggcacataacatcagggcacaacaactacaacaacttgtgctagcaaaccttgctgcctactctcagcaacagcagtttcttacattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacatttgttgccgttctaccagcacgctgcgcctaacgctggcacnctcttacaact

SEQ ID NO: 77100 - DNA, 318 bp, Zea mays
  Clone ID: LIB3079-034-Q1-K1-C4
tggactattaacgtacttaatttggctctcacaactatgactatatcatctgcactagtatgattacgtgcacaaagcgttacacatcattctacaccatctgctcctacaactccacctataaaatcttgatgaatcctttcactggcaccagcactttcgattccagtacctactttgcttgaaccatcttaattatatgctacaacttctaataccctacaagctgctgcctaatgtgcaccaccaacaatgtcatatgctcaacctactacacgcattaagctatcatgtctatctacagctactttaactact

SEQ ID NO: 77101 - DNA, 441 bp, Zea mays
  unsure at all n locations
  Clone ID: LIB3079-034-Q1-K1-C5
cccacgcgtccggtcgaattgcaagagaggttttagatgcagctgctcgtgtagttaggccaggaattacagacagatgaaattgatagagttgtccatgaagagacaattgctagaggtggatacccatctccattgaattaccatttcttccccaagtcatgttgcacgtctgtcaatgaagtcatttgccatggaattccagatgccaggaaacttgaggatggtgacattgtaaatgttgatgtaactgtatactataaaggtgttcatggtgatttaaatgagacatattttgttggaaatgtcgatgaagcttccaaacagcttgtacgttgtacctatgagtgcttggagaaagctattgcaatagttaaacctggagttcggttccgagaggtcggngaaatcataaatagacatgcttcgatgtcaggttta

SEQ ID NO: 77102 - DNA, 367 bp, Zea mays
  Clone ID: LIB3079-034-Q1-K1-C6
tcgcccacgctgtccggcccggcccaagggttgaagcacgtgactcaagaacagctctcgagcctgcggcggtactgactactacacgcgtgggctacgtacctacccgagggcacgagcggtactgtgccggacgtaccccgtcggcgacgagcaccgatctgcgctacgactacggcaacttctactcgtacaagacgttctacgacccggccaagcggcgccgcatcctgtggggctgggctaacgagtcctactccgccgacgacgatgtggccaaaggctggtctggaatccaggcgattccaaggacggtgtggctggaccccagcgggaagcagctgctgcagtggcctatctaggaggt

SEQ ID NO: 77103 - DNA, 358 bp, Zea mays
  Clone ID: LIB3079-034-Q1-K1-B1
cctagccctcgcgccgccgcctccttcgccacccagcgctcgagctcctcgctccctgcgagcgcgcgccgcaacgccaccatgaagttcaacatcgcgaacccttccaccgggtgccaaaagaagctggaaatcgatgacgaccagaagctgcgtgccttttatgaccgaaggatatcccaggaggtcagtggtgatgctctgggtgaggagttcaagggttatgtcttcaagatcatgggtggatgtgacaagcaaggcttcccaatgaagcaaggagttttgacttctggtcgtgttcgtcttctgctccatagggggactccctgcttccgtggttatggcaagcgtaatggtg

SEQ ID NO: 77104 - DNA, 424 bp, Zea mays
  unsure at all n locations
  Clone ID: LIB3079-033-Q1-K1-G9
attcctccccaccgcaagaccttcctctccctcccatctaccgatccattcctccccggcgccggccagccacaagagctccacctccacccgggctcgccgccggcggaggaccacatctgggagatgcaaagtggagcacgctgcgccactcaacatcgagatccgcttcttgggtcgacccttcgacagcgcccccctggcagacccgggcaacaacattgtgcttcgtggtgctgcagtggccgctggagacccgtcgacggggagccccccaagaccctctatcagctccaccgatgccatgagagcgcaagaaggctgaccccctatggctgcgaatagggccatggttgctgctggcactcgagcaagccgacgccgactatgaccatgtncccatgagtcaacagactggtgacta

SEQ ID NO: 77105 - DNA, 387 bp, Zea mays
  Clone ID: LIB3079-033-Q1-K1-H10
gatgatcttagactcccaactgatgagactcttgtggcccagatcaaggaagggttggaaagcggcaaggatcttgttgtgactgtccagtctgctatgggggaggagcagatctgcgcgcttaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcaaggatcgctgggtgttgcaccgtgtctgcattatgtggttacattctggaccctgtattttctatgcttttatgcccctactgtttagtattaattatcaataaatttgttttgggacggttg

SEQ ID NO: 77106 - DNA, 102 bp, Zea mays
  Clone ID: LIB3079-033-Q1-K1-H11
aacaaaacagattaaaaaaaaaaaaaaataaaaataaaaaaaaatataactaaaaataaggaagcgttaacttaaaaaatgggcagccgctgtttgtgctcc

SEQ ID NO: 77107 - DNA, 202 bp, Zea mays
  Clone ID: LIB3079-033-Q1-K1-H4
agcaccggcactccgccacagttcgaatattcctagcttgagattgcaagaggtctggaagaggagggtaggggagccgagcgctcagctctaattgtctccatctattgctaacagcagctcagacctcatgcaagggaggtacaatgccatgagcaaatgagatgttgaaggcagattcaaagaatgatgggtggctttg

SEQ ID NO: 77108 - DNA, 348 bp, Zea mays
  Clone ID: LIB3079-033-Q1-K1-H7
cccacgcgttcgcactaatatgatgtgtagtatatttgagtcaccttatgatgagtggtatatatatgattttaaaaatttgtaaaataaggtactgttggaggtgtttttttagaagttgagccctttatttagggcattgatttaagacaggcttggagatgctcttagtccattcacaatggaagtttaattagatattttataacattaattagtataccacataggatttgttggaggtgtttttttagaagttgagccctatatttagggcattgatttaagacaagcttgaagatgctcttagtccattcacaatggaagtttaattagatattttatgac

SEQ ID NO: 77109 - DNA, 328 bp, Zea mays
  Clone ID: LIB3079-033-Q1-K1-H9
ctccaaggtggtcaaggtcgctgactgcggacagctctcctagatctctctgatctgggctgtgcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattccaaaaaagctaaccttttgaagatgacctcaaggaaagatg

SEQ ID NO: 77110 - DNA, 209 bp, Zea mays
  Clone ID: LIB3079-034-Q1-K1-A1
tttcagttactacgaaaacatcacaatgaagggatagttctcttgaaaatctgaagaggctatagcctcacaatttgaaagtacatatacttgtagactgttacatccctatgaagacagcagaggatttgatgaaacctgtgctggtggttggcaatgtgaggctgacaaagggaagctgttgcaggaactcacgagtactgctggcg

SEQ ID NO: 77111 - DNA, 426 bp, Zea mays
  Clone ID: LIB3079-034-Q1-K1-A10
ctcctctcctttcagcactctctggacactataattgcccggttacgctccattctgagggtgctaacttctaactttagtatacatgaagactactgaaatgaccatcatctagcaagcagacgcatatgaaagggagaagatctacgtctaacgcaagcaaatccacatgtacgagcatttctgcataaatctggcgcaataattggactacacattcttcaagagcaatctgccttgtcgcggctagagtactaggatatcccactagaatcggatgacaaccccgacattgaaacctaccattcccagcgaacatcgaaagcgacttatgcaatgccatgctgctgccaaattgctccctgttggtgcttccaaccggattgcgagagaaactgttgacactgagcatggcaagagctcgat

SEQ ID NO: 77112 - DNA, 406 bp, Zea mays
  Clone ID: LIB3079-034-Q1-K1-A11
agaaagcctcctgcaagctgctcgtaaggcaccaataacagcctgtggttttcggattgagtgctacaaatgggctatcatagtgaggctgctgcttggagagattcctgagaggactgatttcatgcagaaaggaatgaagaaagcgctgataccttattttgagctcacaaatgctgacagggttggggaccttgaactgttcagggctgttgcagacaaatttacaagcacattcagcgcagacaggactcgtaatttgattgtgaggctgcgccataatgtcattcgaactggactgcgcaacatcagcatatcttactcaaggatctcccttgctgacattgctaagaagctaagactagactcttagaaccctattgctgatgcagagagcattgtatcc

SEQ ID NO: 77113 - DNA, 261 bp, Zea mays
  Clone ID: LIB3079-034-Q1-K1-A12
tctaaaaagcctactgcaagctgattagtagttaccaataacagcctatgataaaaaggagacggtgctacaaatgggctgtcatagttaggctacttattggaaagattactgtcatgactgaagtcatgcataaagtgaatgaagcaatctctaataccttatcatgagctcacatatgctcataagtttaaaaaccttgtactattcaagtcttttgcaatcaaatatataagcacatttactacatactggactcct

SEQ ID NO: 77114 - DNA, 321 bp, Zea mays
  Clone ID: LIB3079-034-Q1-K1-A2
catggccaggctggcgctggtgctcctcctgctgctggccgtggcggcgtccgcgtgggccggcgccggcgcgagccacctcgatctgggcttgggcttcctctcctccggggaccgccggcgggagtgccgcggcacggtggccgagtgcctggacgagtcagagggcctggacctgggggcggggcccgcgtccgtggagtcccaccgccgcgcgctctacggcggcggcggcgggtacatcagctacggcgcgctgcggcgggacaacgtgccctggctccggcgcggggccagctactacaactggccgcccggggg

SEQ ID NO: 77115 - DNA, 439 bp, Zea mays
  unsure at all n locations
  Clone ID: LIB3079-034-Q1-K1-A4
tgaccctctaggttttctgtgaaggatctggccactaggacccctcttgcccgctgtgacaggtcggggcccctctacaccttcggccttcatccaccggtgcgtctccattgtccgtcctggtctccaccacctgctccatcacttggcatcgccgacttggccatccacgacccgacgtcatgggcaaactcaccagtagcttagatttttaatgtagtaggggacattttgaggatctctgtcatacttgtcagctaggccgacatactcgtctcccattcactacttctagagctgagcaagtttttgatttggttcattgtgatctctggacctctcctgtacttagtttgtctgaatataaatactatctgatgattctggatgctntttccattttctatagacctttcctcttctgttgaagtttgacacg

SEQ ID NO: 77116 - DNA, 402 bp, Zea mays
  Clone ID: LIB3079-034-Q1-K1-A5
cagaaatcgatgagctgagccgtcaagttgctaggaaaacatcacaaggaagtaatgagctgttggaatatctgaagagtctagagcctcagaatttgaaggtacatatacttgtagactgttacatccctatgaagacagcagaggatttgatgaaacctgtgctggtggttggcaatgtgaggctgacaaagggaagctgttgcaggaactcacgagtactgctggcgaggatgtcgtctttgccatgaatgcgttcataaagcgcctgttggcggtctctgactcagagcagatgaaggtgagggtgagggaatggtatgcatggcagtgcttttgtttgatttgaacttgaacttgtgtgtgtgtgtgtgtgcagacagcagtctcggaaacaagtgc

SEQ ID NO: 77117 - DNA, 426 bp, Zea mays
  unsure at all n locations
  Clone ID: LIB3079-034-Q1-K1-A6
ggtaaaacaggaagtactgtcagtttccgagctacaaacaagctataagtttagaagggtaatttagaaatgtacatcaaagtctagtaatacattgttaaagataaatcaatactcaataagttcctcatgctttggatttggggataacatacctgttttatttacatgctaatatttggaccaacaaaaaataccttaggaacagccatttgagaaaaaaacaaagccttttagtcctaagcaagttagcatagcttagagttgcaacttctacatgagcacaataaacaganaagaaagagaaaagganaatanatatatatggcaccaaaagctattaccatgttataatatacaattaatgaccgaaattataaacattnttacaatcttagcaaacctntcacgtgtagtctgaatcga

SEQ ID NO: 77118 - DNA, 435 bp, Zea mays
  Clone ID: LIB3079-034-Q1-K1-A7
ggtaaaacaggaagcactgccagttaccgagctacaaacaagctataagttgagaagggtaatttagaaatgtacatcaaagtctagtaatacattggtaaagataaatcaatactcaataagttactcatgctatggatttgggagataacatacctgctttatctacatgctaatatttggaccaacaaaaaataccttatgaacagccatctgagaaaaactcatagccttttagtcctaagcaagttagcatagcttatagttgcaacttctacatgagcacactaaacagaaaagaaagagaaaaggaaaatatatatatatggcaccaaaagctattaccatgttataatataaatttaatgaccgaaattataaacattcttacaatcttagcagacctctcaacgtgtagtctgaatcgacagaaca

SEQ ID NO: 77119 - DNA, 439 bp, Zea mays
  unsure at all n locations
  Clone ID: LIB3079-034-Q1-K1-A8
cttttggagaaaatgcaagtcagaagattattgagcttgaagcacaaatacaggcaatgcgtgcagctgaagaggcactcaacctagagctaaaagaagctgaggcaagtgtaaaagctgctgagaagaaaggctcagaccttgagcaacaactcagtgagattgagagcaaattagttgcatcaagtgaagaaatagagttgctgaaagagcgtattcaacaagaagctgctgtatcagcagaaagaggaatgcagcttgaagaaacaatgaccagtgcagagggatacaaagaaaaaattaacgagctacaatcctccctagattcctcgatgtctaaaaaccagctacttgaacaagaagtcaaggagctgactgataaatgttcagagcatcaagaacaagcacattcagttcagcanagaagtctggagctgga

SEQ ID NO: 77120 - DNA, 431 bp, Zea mays
  Clone ID: LIB3079-034-Q1-K1-A9
cgaagaagcaaacaatgcacattataattcggtggctattatcgatgctgatggcgctgatcttggactctatcgcaaatcacacattccagatggaccaggatatcaagagaagttttatttcaaccccggtgacactggctttaaggctttcaaaaccaagtatgccaccattggtgttggaatctgctgggatcagtggtttccagagtgtgcaagagcaatggcacttctgggggctgaaatactgttttatcccactgcaattggatccgaaccccaggattgtaacctggattcccgtgaacattggaagcgggttatgcaaggccatgctggtgccaacttggtccctcttgttgcttccaaccggattggcagagaaactgttgacactgagcatggcaagagctcgataaccttctatggga

SEQ ID NO: 77121 - DNA, 308 bp, Zea mays
  Clone ID: LIB3079-033-Q1-K1-G8
acgcccacgcgtccggcgatgaagatcactgcgctcctggtgctgaagcctgggaccattggagcctggagctcctagtccggctgcgagtcatacccagatgcatgaaaactcgtgaacgcaatagacatcagacacttcggctactttcagcgcagagccatgcgtcagttcattgacttctaggctcgcaccatctgtcagctcacccagccatgccagcggcagtcccttcagcacgaaaaatacaaggtgcactcatacaatataaataggctgtgtactttgcattgatggatgatcattat

SEQ ID NO: 77122 - DNA, 56 bp, Zea mays
  Clone ID: LIB3079-033-Q1-K1-E7
aaaataacaaaaaaaaaaaaaaaaaatttaaaaattttataaaaaaaaaaaaaaaa

SEQ ID NO: 77123 - DNA, 202 bp, Zea mays
  Clone ID: LIB3079-033-Q1-K1-F1
cctacgcggtctgtgaaagacccatatcatggaccctatacgttccaaccagcaatggcaaattgggtcggtaccttttttaccttggtggctccaacaatcattagccctatttcaacaggtacctttggtgcatttattggcacaaaacatcaggggacaacaacttcaacaacttgtgctagcaaaccttgctgcctac

SEQ ID NO: 77124 - DNA, 420 bp, Zea mays
  Clone ID: LIB3079-033-Q1-K1-F10
gtgacttgtacggcgaccgaagccaccgccccagccacgccatggactctctcctcggcacgggcgccttttctggcgacgacgctgacttggacaaggcgctgttcaccgtgcccgacgcctactgcggcggacgggccggaggactattctcgctaccgcaacccaagtcaggccgcgccctgctcttgtactgcctaccggcgcccaaatccacccttgagacgcgtcttctgctgtgatatcggcgcccaaatgcggcaacgcccccacgttctcctgcatgccggcgcccaagacttacggaggaaaccctaagcgcgttgtacagaaccgaccgcagccgatcctgcagtacgcatgcgacagctccgacgacgacgaggactacgccaagaagcgccgcgccagctacaacga

SEQ ID NO: 77125 - DNA, 180 bp, Zea mays
  Clone ID: LIB3079-033-Q1-K1-F11
acactcttgccccagccgtccgacaaaacggctaccaaacacctgactctttgccggccgcgaaggtttagcattggcgggggcatcgccaccgctgccgcatacctcaaactgtgttattgtaccccacgaccagctgctctgcgtcgcaccgcgggtacctggacacctaccgtcacg

SEQ ID NO: 77126 - DNA, 384 bp, Zea mays
  Clone ID: LIB3079-033-Q1-K1-F12
ctccgcgatgccaagatggacaagagcaccgtgcacgacgtggtgctcgtgggcggcgccacgcgcatccccaaggtgcagcagctgctccaggacttcttcaacggcaaggagctctgcaagagcatcaaccctgacgaggccgtggcgtacggtgctgctgtccaggccgccatcctgagcggcgagggcaacgagaaggtgcaggacctgctccttctggacgtcaccccgctgtccctgggcctggagactgccggcggcgtgatgaccgtgctgatccctcgcaacaccaccataccaacgaagaaggagcacgtgttctccacctacttcgacaaccagccgggggtgctgatccaggtgtacgagggagagcgcgcc

SEQ ID NO: 77127 - DNA, 378 bp, Zea mays
  Clone ID: LIB3079-033-Q1-K1-F2
cccacgcgtccgggagggggagcaagcagcagccgtccgtggaagaagatgtcctaggtgctggggcatctgcactcggggtgggcggtggaccaggccatcctcgccgaggaggagcgcctcgtcatcatccgattcagccatgactgggacgagacctgcatgcagatggatgaagtgctggcagcagtagctgagaccataaagaactttgccgtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaggacaagcaa

SEQ ID NO: 77128 - DNA, 214 bp, Zea mays
  Clone ID: LIB3079-033-Q1-K1-F3
aggaatcctccgatggctcatcgcgttctcctactcctctgtctcgcgtcggccgccgcggttggcgccgacgtcgacgcgtaggacccgctgatccggcaggttgttcccggtggagatgacaacgatctggagctgaacgcggagtcccacttcctgagcttcgtgcagcggttcggcaagttctacaaggacaccgacgagcacgcgtacc

SEQ ID NO: 77129 - DNA, 285 bp, Zea mays
  unsure at all n locations
  Clone ID: LIB3079-033-Q1-K1-F4
tcacttttgctcnnctagtgcnncattatactcactatgttccttccgacctagnnttacttcaatgggctatcgaacactctagcttgtgcaaagcctacatagctacaacatagcgcttgcggcgaagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacaacaggtgcttg

SEQ ID NO: 77130 - DNA, 194 bp, Zea mays
  Clone ID: LIB3079-033-Q1-K1-F5
aggaatcctccgatggctcatcgcgttcttctactcctctgtctcgcgtcggccttggcggttggcgatcacgactactcgtaggaccaccttatccctcacgttgttaccggtggacatgacaacgatctggagctgaacgccgagtcccactacctgagcttcgtgcagcggttcggcaagttctacaatga

SEQ ID NO: 77131 - DNA, 217 bp, Zea mays
  Clone ID: LIB3079-033-Q1-K1-F6
agcttgttcatggagatgaagtggactaaggtgcaccgattcgtggtgtggaggattgaccagcggtagcgcgccgtgctggtagacagggtgggcggtcccggtgagggttacaaagagctcttggctgatctgacaggtgacaactgacattactccggttataacatctacttgcatagcgaacacaaatgttagaaaacctagaagttattta

SEQ ID NO: 77132 - DNA, 77 bp, Zea mays
  Clone ID: LIB3079-033-Q1-K1-F8
gttctagatcgcgagcgccgcccttttttttttttttctcttttttttttgttttttgtttttcttttttttcgcga

SEQ ID NO: 77133 - DNA, 381 bp, Zea mays
  Clone ID: LIB3079-033-Q1-K1-F9
gtgacctgcacatattcccaatttcttgctcagaagactccatgctgctgtgtatctggatcagcgtactataatggcacaattgtgaactgtccaacatgctcatgtggctgccagaacccaagtgggtcaaactgtgtgaatgaggattcacctaatctacaagctgcaattgatggccctggcaaatggactggtcagccccttgtacaatgcacttcccacatgtgcccgataagaatccactggcatgtgaagctcaactacaaagattactggagagtgaaaatcactatcacaaacttcaacttccgcatgaattacacgcagtggaacttagtatcccatcatgcaaactttgataatatcactcagatgttc

SEQ ID NO: 77134 - DNA, 380 bp, Zea mays
  Clone ID: LIB3079-033-Q1-K1-G10
accacgcgtccgccgaggactttcttgaggttgacatggaccaactgatggaagtcgggaagagctaccgcgtacatgtgatgcctaccttgtgctccatcaggaacggacggacgctcgagagctattgataccgtcgacaaggacgagcttcaggacgccgataggaagtacgccgccactggcactacgacggctcctggctcagcgtgcgactaactcaggagatgtgatgtgtagcaaatagcgcgcgcacaccagtcgtgaataaataaatagatccattaataaactaatcagatgaagggcaacgtacgacgacctattagtggtacgcgcggtagtagctagcagagtatgctccgacactgtgacgatct

SEQ ID NO: 77135 - DNA, 342 bp, Zea mays
  Clone ID: LIB3079-033-Q1-K1-G11
acgaatcatgcggcgaatgctgcacacactatatttcgtggagacgactggatctccggaatcgcggccctaccaggctacggccaagtctgcttcagcccctaagcctactcaagctcctccaaatggttgaatacggaaacccaatctttgtaaacaatttacttttaacgctcaggttttaatggaagtactcatgatccaacttattgatgctaacctacttcattcatcgacatgccactgctcgacgtcgggggctaaactataatgacgcccatagctcttgatcgacttgcatatctgcatattgaataccctatgctaattacggtattacaa

SEQ ID NO: 77136 - DNA, 400 bp, Zea mays
  Clone ID: LIB3079-033-Q1-K1-G12
ctgcgatcttcgtagcctccgtcgcgtcgagcatcgatcatgtcggcctactgcggagagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggagggaggcgtcctccctggcatcaaggttgacaagggcaccattgaggttgttggcactgataaggagaccaccaccc

SEQ ID NO: 77137 - DNA, 392 bp, Zea mays
  Clone ID: LIB3079-033-Q1-K1-G2
cccacgcgtccgatctattcctcacgagcgattgcggcggcggaagtaagaggcgagggggcactccaacgtgtggaactcgcaccccaagaactacgggcccggatcccgcgtctgccgggtctgtgcgaaccctcatggactgatcaggaagtacgggctgatgtgctgcaggcagtgcttccgcagcaacgccaaggacattggcttcatcaagtaccgctgaagtcagctgggcgggctatctgaatgccatctcttggacagtgtagtagaggcgatgccacaattttaattactgtcatttagatgttcccttcagaactctgctatttaagtccgccatgtttgtgatggagaactgaaagcttgtttgttatactgattatgag

SEQ ID NO: 77138 - DNA, 362 bp, Zea mays
  Clone ID: LIB3079-033-Q1-K1-G3
gttctagatcgccgtccgatcatgtgattcatcttttggcacagcggctaatatgctggtaattgtctacaaccatgacgtgcgttctcaaatgctcataccgcttagccgtaaaaattggtcgcgatattgaaggttctaagctacattgtaaaaggcaaggaactctgcatcttgtacacatactctagcatagatgcagaacgtagacctaatattgatgatgatcgatacgacttgcactgctactatctccaatgtttggccagagactactctcgatgtctacgagaaagatgagcatgactttggattctattgaagcttattgaagccgttggtgcagcttatcatgatgaact

SEQ ID NO: 77139 - DNA, 307 bp, Zea mays
  Clone ID: LIB3079-033-Q1-K1-G4
gaagaagtagaggtggaagaggatgagtaacggtgaagggaagttgtgatgaaacgtgcggttgtggaatgtatatgcagggcagcaggggagctgactgatgaatgtttgtgttgctttatgctgtctaagaaacggtacttgtctcgacgcttagagccagttagcatagcacatcgtgtgcagtatccggatgaagaattgggaaaaaacaatatttgtaagcgtcagctagacacaggcgaatcgtaataattggtattttgccacttgaaatgttgcatacttctgtaattaccgtttgtgt

SEQ ID NO: 77140 - DNA, 193 bp, Zea mays
  Clone ID: LIB3079-033-Q1-K1-G5
cattcgccgccgacgcctgctctctgctgccgtcgccatggggagaaggcctgcgagaggctatcgccagatcaagaacaagccataccccaagtccaggtactgccgtggtgtccctgaccccaagatcaggatctacgatgttggcatgaagagaaagggtgttgatgagttcccctactgtgtgcacctt

SEQ ID NO: 77141 - DNA, 363 bp, Zea mays
  Clone ID: LIB3079-033-Q1-K1-G6
acggcgtataccacgagcgcaccaaccaccaccaccatcctcatccttcgcgaggagggcccttcgtcggggaagagaacccgccaggagacctacccttcctcaatcctccgaccctccatggcctcctcctccctggccctccctccaatctctctcctcctcgcgctgctgctcctctccgccccctcgccgtccgcctgcgcctcgctttccttcctcaccgcctcctccaacggctccgcctccacctccgccgacccggagctggaggacctggccccggagcccaccttcctcgaggaggtcatcgacgccgtctcggagaagtacgactgggatccggacgccgaggtcagggtc

SEQ ID NO: 77142 - DNA, 332 bp, Zea mays
  Clone ID: LIB3079-033-Q1-K1-G7
cccacgcgtccgatcatgtgattcatcatttggcaatgcggattatatgctcgcatcggtctacaaccatgactgcgatccgaatgctcacatcgtttagccgcaaaacgcggacgcgaaattgaaggctctccgctacattgtaaaaggcaaggaactctgcatctggtacacatactctagcatagatgccgacgcataacctactattgatgatgatcgatacgacttgcacttctactatctccaatgtttggccagagactactcttggtgcctacgagaaagacaagcatgactttggattctattgtagcttattgaagccattc

SEQ ID NO: 77143 - DNA, 392 bp, Zea mays
  Clone ID: LIB3079-001-Q1-K1-E7
gtcaatgaatgggatcctctccttgcagagctggaagagatgagatgaacaaggagctgcttgcgaagaatgagggaagcatcaagcgagctgtgatggagctcattgccagggagaagaaggacaagtgaagatcgtgtgctatctaagtatatattcgtaaataatgagacggctgtgccactgcggtgcagccctggtgcgtctcagagcttgcttatggtgaactcttcgtgttaggtttcttccttatatctgtcgtgtctgcggtgtcgatgaactatctagtatgtggagcgtgtgcgtctcagcagttaccctgccatgccacgtggactggctgtcgtgcctactgtctgttaccatgtatatatataaaaaatgatgcgtgg

SEQ ID NO: 77144 - DNA, 257 bp, Zea mays
  Clone ID: LIB3079-001-Q1-K1-E8
caatctgcaagaaaacagcactggacacctaaaaacatggctgcctttttccttaggaaaaagccggtagcggcagggcaagtggttgccatctaaccacaccctcccatgactagcaaagtatgttacacctttcccatcatcaacatacatgtgggaatctatactataggtggtacatggcacttgcctgaagccaatggctgtagaccatggagttttatcctttgtttttttcaatcttagatttgggattt

SEQ ID NO: 77145 - DNA, 407 bp, Zea mays
  Clone ID: LIB3079-001-Q1-K1-E9
ccgctttcggtggcttcaagagccggacccaggtcccatggcttgttgacaagtacatgaaaaaggaaattaaggtggacgagtacattacgcacaacatgaacctggctgacatcaacgacgccttccacctgctgcacgaaggtggctgtctgcgttgtgtgctggcaatgcagatttgaaattcctaagctaagcagtttttgttttggaactagaactcctttttgcctcgttaggcctggacccgctgtataatgctatgttgtgttggatggctgacgatggttactgctgtgttgctagcaatgtggtacttgatctgtatcacggatgcaaataagtgctgtttctaaaacactccctctcggtgaataaggggttgtttggtttgaggaatcattcca

SEQ ID NO: 77146 - DNA, 173 bp, Zea mays
  Clone ID: LIB3079-001-Q1-K1-F1
cgagtcctgccactgagagggcgttcttttctaataaaggttcattctaagaaactccggattatctgaaactactggaaacctacagccggctgtagttggatgcttttgcttgcgctgatatgtttatggaagcatcagtgttggcgatgaatataatgacgatcattcta

SEQ ID NO: 77147 - DNA, 465 bp, Zea mays
  Clone ID: LIB3079-001-Q1-K1-F10
gctcgaagttgaaaatatacccaatactgcagaaggtttaccttgaaagagggttgaggaaaccagaaattgatgcatttgcagaggagctgaggccgcatcaaaaagctttattaccagataagtcgactgtgcttgaccgagcaatgatcgagcataatctccttagtgccagtaaactttacacaaatatcagctttgatgagcttgggacattactggggattgatccaaggaaggctgagaagatagcatctcggatgatttatgaggatagaatgcggggctcaattgatcaggttgaggctgtgatacattttgatgatgacacggaagagctgcagcaatgggatcagcagattgctggactgtgccaagccctgaacgacatccttgacagcatgtcaagcatgggaataactattccggtgtgaataaatatctcatgctgtcggtcgatggtgc

SEQ ID NO: 77148 - DNA, 469 bp, Zea mays
  Clone ID: LIB3079-001-Q1-K1-F11
ctttgtttttgtctttgatagctctgagaacgagcttgccatgctcgaccgcgtacaagtgtttgttgaaacattggacagatgcttcaagaatgtatgcgagcttgacatcgtatttaacttcaacaaggtaccatatgtccatatgatcctactttttttatccttttatactagaatagtgtgcctatcgaggatgcatggtttctatcctgctgaaaattccatttatgattcttcaggtgcatgttttatgcagcagaaaaggtgggacacagaagctgcatcaccatttttgacagcagttgggttatctgtatcaaattacgcctttttatgcacatgtcatatgcagtgctgtgcatatctgaaagtttgagtataacaaatgcctgaatccaagaatccctgttatgcagaatagctataccattatctatccatctaattaattatcgtgggtgtaata

SEQ ID NO: 77149 - DNA, 457 bp, Zea mays
  Clone ID: LIB3079-001-Q1-K1-F12
atcagcttgaatctatggaacttatactgtcaaactttgattgcattagcgccatctgtagtcctcatggccacattcctaacactcataatctgcaatcgcgctatacttctaagtgctcaggaacctcatgccgtttcgccacactttgctcagtttctgatctttggccttgtgtcaactgctgccctccttccatggcatttcactcccaaccgagtattgcatctattacacttgtctggaaagaacaaaacctgtggttctctggcactcttaatcggtcttggtttaagctatatcgctgtacatttcttcatcattgcccatccgtatattctcactgacaatacacactataccttctatatttgcaggaacgttatccatgtcaactggatgatgaagcacatgttcattccactctatgagtactcatggcttctaatcatcaaca

SEQ ID NO: 77150 - DNA, 231 bp, Zea mays
  Clone ID: LIB3079-001-Q1-K1-F2
aaacatggctgcctttttccttagcgaagagtctgtaacggctgggcaagttgctgccatctaaccacaccctcccatgactagcatagtatgttacacccttcccattattaacatacatgttggaatccattccataagttgtccatggcactttcctgaatccaatggctgtagaccatgctggtttatactttgttttatgcaatcttatatttccgatttcaaatt

SEQ ID NO: 77151 - DNA, 371 bp, Zea mays
  Clone ID: LIB3079-001-Q1-K1-F3
gtcagctagctgctgcctacccccagcaatttcttccattcaaccaactggcagcattgaactctgctgcttatttacaacagcaacagctaccaccattcagccagctagctgatgtgagccctgttgccttcttgacacaacaacagttgttgccgttctacctgcacgctgcgcctaacgctggcaccctcttacaactgcaacaattgctgccattcaaccaacttgctttgacaaacccaacaacgttctaccaacaacccatcattggcggtgccctcttttagattgcctaatgagttatagttcaataatgaagttttttggatgatgtttgggctttccagaaattaagacagttcatttct

SEQ ID NO: 77152 - DNA, 429 bp, Zea mays
  Clone ID: LIB3079-001-Q1-K1-F4
ctttaccattcatatctcccagttgttgcatgggaaaattaactccagtaattctttcttgaggggtagaacaggagtgtcgttctcagattcaatgattatcaaacaacatgtactaattatattttagcaagctggcagttgatgtgattctctatgtttacattttgtcaaattaacgacaagagggttaagttttagaagcaactaccctgcactggttaataatatctgtgaggacccaagttggtcccagtcctcttcgattggtgctctgttcctgtgatttgaggaaagtttcagtacatcacattgtattttgattagtgaatgaagcatttagacgatattgttgcatgtgtgcattctctttcttacatttgagttaagctttcttatttgagctctatgatactatgtactcaatac

SEQ ID NO: 77153 - DNA, 403 bp, Zea mays
  Clone ID: LIB3079-001-Q1-K1-F5
cgagccgtgccactgcgagggaaggagggagagaaaaaggggagcccgatccaatcccaatcccctcccgccgcgtcacatcgccgccgtcctcgtgccccgttacctctaaaaccctagcggggagccgccgagccggggatgaagatccagtgcaacgcgtgcggggccgcggaggcgcgggtgctgtgctgcgcggacgaggccgcgctctgcgtcgcctgcgacgaggaggtgcacgccgccaacaagctcgccgggaagcaccagcgggtgccgctcctgacggacgccgccgtcgctgccgccgcagcggcgccggccgtgcccaagtgcgacatctgtcaggaggcttctggatacttcttctgcctagaggaccgtgcactactttgtagagact

SEQ ID NO: 77154 - DNA, 281 bp, Zea mays
  Clone ID: LIB3079-001-Q1-K1-F6
ttcccggtcgacccactctctctaaaataaaaaaaaaacaaaaaaaactacaaaaaaaaataaataaaaaacacattaaaggggggaaaaacaaaacaaaatacacatacaaaccacacatcctcatccttcccggagttcccacattctttccccccttccattgctatcattcctttccggtcctcccctattccatcgctccttaatgctgttccccacctacctgactttccccccctttgttcacaccttctttctgttccctctttgctttcccc

SEQ ID NO: 77155 - DNA, 376 bp, Zea mays
  Clone ID: LIB3079-001-Q1-K1-F7
ccggctgcaacgggggcctcatggactacgcgttccagtacatcgccaagcacggcggggtggcggcggaggacgcgtacccgtacagagcgcgccaggcgtcctgcaagaagtcgccggccccggtcgtcaccatcgacggctacgaggacgtgccggccaacgacgagtcggcgctcaagaaggcggtggcgcaccagcccgtgtccgtcgccatcgaggccagcggctcgcacttccagttctactccgagggggtcttctccggcaggtgcgggacggagctggaccacggcgtcgcggcggtcggctacggtgtcaccgcggacggcaccaagtactggctggtcaagaactcgtggggccccgaatgggg

SEQ ID NO: 77156 - DNA, 456 bp, Zea mays
  Clone ID: LIB3079-001-Q1-K1-F8
aacaatacctctctccggtgacagccgcgggatttcaatacccaactatacaatcctacatggtacaagaggccatccaagcaagcatcttacggtcattagcattaaccctccaacaaccatatgctctattgcaacagccatccttagtgcatctgtatctccaaagaatcgcggcacaacaactacaacaacagttgctaccaacaatcaatcaagtagttgcagcgaaccttgctgcttacctccagcaacaacagtttcttccattcaatcaactagctggggtgaaccctgctatctacttgcaggcacaacagctactaccatttaaccaacttgtcgggagcccttatgccttcttactgcaacaacagcttctgccattccatctgcaagctgtggcatacattgttgctttcttgagacaacaacatttgttgccattttacccac

SEQ ID NO: 77157 - DNA, 448 bp, Zea mays
  Clone ID: LIB3079-001-Q1-K1-F9
gaatttcttgttaaggccagagttgcttaccgacaagatcaatgagaaatgggggctcttagttctctgctctgcatctaatccaacagggtcagtatatccaaaggagttgcttgagaaaatagctgatatagtcaagaagcatccgaggcttttggttttatctgatgaaatttatgagcatattatctatcagcctgcaaaacacacaagctttgcttcactacctggaatgtgggaaagaacattaactgtaaatggtttttctaaggcttttgcaatgactggttggcgtcttggttaccttgcagcccctaaacattttgttgcaacatgtggaaagatccaaagccagttcacctcaggtgccagcagcatatcacagaatgcaggggttgccgctctgaatcttggctatgctggtggtgaagcagtatcaactatggtc

SEQ ID NO: 77158 - DNA, 459 bp, Zea mays
  Clone ID: LIB3079-001-Q1-K1-G10
gttgcgtgagcatcatcagtgcggcggcggccaccatctggagctggtctgggcgtcgtcgtcaaggttccggctgccgatgatgatgtcgtacgcgccgcataacgagcacttgctgcaggaacagacactgaacaacgctcgtccggctcctgagaagaggcagcgggttccgtcggcgtataacagattcatcaaggaagagattcgcaggatcaaggcgaacaaccccgacattagccacagggaagccttcagcacagcagccaagaactgggcacattatccgaacatccatttcggcttaaactccggccgaaagggtggcaagaataagctcgtggactaggctgtcgcggcggtggcggtggctccgaagaagatccaaggtttctactgatcgatgccggtcgatcgatggatcagcgctcgtcgtcatcaactggccggacgggtgtg

SEQ ID NO: 77159 - DNA, 428 bp, Zea mays
  Clone ID: LIB3079-001-Q1-K1-E6
caaaaccctaaagccagtgctccttgcaccttgccaccggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcactggcgaggcgaacgagcggtgccacaccgagcgccgcaagaccgtcacctccgaggacatcgtgtgggccatgagccgcctcggcttcgacgactacgtcgcgcccctcggcgccttccttcagcgcatgcgcgacgacagcgaccacggcggtgaagagcg

SEQ ID NO: 77160 - DNA, 463 bp, Zea mays
  Clone ID: LIB3079-001-Q1-K1-D11
ctttcatcagcctgcctgtccactgttggcttggtgacttcctccgctccggtccgctccgctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtcttcggcccggcggcggtggaccccaagctggccgctggtggcgcgccggacgccggcgcggatgctgcaggaggcacggtgctggaccagaaggtgtggttcccgccgctcgaggacgtcgagaagccgtcccccgtcgcgtgagccgcgcggcgc

SEQ ID NO: 77161 - DNA, 436 bp, Zea mays
  Clone ID: LIB3079-001-Q1-K1-D2
ctcgaaaagttggaagcacgccatcatatggtttcaccttcaagtgtgatgagagatctgaaaaaagacgagagttctattcgaagcttgaggagaagattcatgcaagagagttagaaataagcaatttgcaagccaagtcaaaggaaactgaagaagcagaactcaaaatgctgagaaagagtttgaatttcaaggcaacaccaatgccaagcttttataaggaaccaacccctgccaaggttgaattgaaaaagatccccccaaccagagctaaatcaccaaagcttggtcggtctaaaaacaagtccatatcagagactgaagaaaatactactacggaccaacctgcccgtctgagccttgactgaaaggtttctcaaaacggtgtgaaaaaaccaaccccgtcgagttcagcaaaagaagccccagagaa

SEQ ID NO: 77162 - DNA, 407 bp, Zea mays
  Clone ID: LIB3079-001-Q1-K1-D3
aacgagagacgccctaccgtcgattccatatcgtcgctccgatattctgatgccggaatcctgcttttccggctagcttaccgatacctcctaggtggtttccagtcctcacccttccaacctctactatctttttttgtgaatttacctccaccgaattcgggcagctcaccatttcttggagtttggtgtcctttctcgagtgtttccttcctccctcccgggttctactgctgagtggcatctttcttgtgcgacttgtccgttgaccacaggcggagaaatttgttctcggcacacattctctgccacaatggacgatggagctgatcctccctgccaactgctcttctcccacccggagatgcctgacagcttcgacgagttcttcaacagcgccacgacga

SEQ ID NO: 77163 - DNA, 392 bp, Zea mays
  Clone ID: LIB3079-001-Q1-K1-D4
atcagtagtaaccactcctcgtcgtctctctcgcggtctcgcctcctgcagctagctctcgccagaaagggaaaccgcatctgcttcagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcggccgacagcccgggcgctgcggctgcggcgggcgcggaggcgccgcgcccgagccgctacgagtcgcagaagcggcgggactggcacacgttcgggcagtacctgcgcaaccaccggccgtcgctggagctggcgcggtgcatcggcgcgcacgtgctcgag

SEQ ID NO: 77164 - DNA, 428 bp, Zea mays
  Clone ID: LIB3079-001-Q1-K1-D5
gcagcttctgcttgctctggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgtctccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgtgtcgtctgagccagcagcacgggctgtcaagcagggctccaacgaggtgctcctcgtcatcgaggcctacaagacgc

SEQ ID NO: 77165 - DNA, 409 bp, Zea mays
  Clone ID: LIB3079-001-Q1-K1-D6
ctgcgacaaacaaggatttactttgctgcatttggctgctttgtttaaccaaactgaaattgctcttattctcatggaccatggggcaaatgttgaaagcaaaaatgggcaaggggaaactcctttggactgtgctccggcaatgctgcaatacaaaatgcgccaacgggtggaagaactcgcggcttcggcttcgaagggaccactagggtgaactgtgctcgtgctagtttctgctgagttcctcctattccagtttgtgtcaaatgtggtgtcaagaataaaatagttaagtcagctgaaagcttcttgctggtgggacagtgtttggtccgccagtgtataccatctagaaacgttgaatgccagtcacggctcacgcgtgtgaaataatatatattcagcttca

SEQ ID NO: 77166 - DNA, 439 bp, Zea mays
  unsure at all n locations
  Clone ID: LIB3079-001-Q1-K1-D7
ctctacgcccggtaccactcgcaccaccacgcctccatcgtcaccgagcccatcacatgtacgttgcacacaccatcatatgcatgcatgcttgatgaccttcttctacctagctagcttcattagtgcactgcactgcacgcacgcagcggtgatccatccgttcgcggaggagctggtgtacttcaccctgttcgccatcccgctgctcaccatggtgggcaccggcaccgcctccgtggccgtggccaacggctacctcgcctacatcgacttcatgaactacctcggccactgcaacttcgagctcgtccccaggctgctcttcgacgtcttccctaccctcaagtacctcatgtacacgccatcgttccactcgctgcaccacacgcagttncgcagcaactactcgctcttcatgccgttctacgaccacctg

SEQ ID NO: 77167 - DNA, 402 bp, Zea mays
  Clone ID: LIB3079-001-Q1-K1-D8
tcgctcggcctctccgacaagatctggaacaacgggcccatcagcttccagctgcagtggttccagcaggtcacctccgccgtgtgcgggcaggactgcaagagctacctggccaactcgctgttcgtgttcggcgagttcgggggcaacgactacaacgccatgctgttcggcaactacaacgcggaccaggccagcacgtacacgccgcagatcgtgagcgccatcgcggccggcgtggagaagctgctggccatgggcgccacggacgtggtggtgccgggggtgctccccatcggctgcttccccatctacctcaccgtctacggcacctgcaacagcgccgactacgacgcgctcggctgcctcaagaagttcaacgacctctccaccaaccacaac

SEQ ID NO: 77168 - DNA, 315 bp, Zea mays
  Clone ID: LIB3079-001-Q1-K1-D9
aaaaaaaaaaaaaaaaaataaaaaaaaaaaaaaaaaaataaaataaaataggggaaaattggagaaaaaaaaattgataaaaaaacaaaaataaatgaaaattacaaaaagtgcaaattcaatataaaatgattagcaatttctagaacaaggaatacagtgccatgctttaaatgatataatatgcggtatatcccaactggtacacatcggaaaatacgtgaacgaaacaggcgcaatagtggataagctgcatgatatactaccgaaggacgtattgtacacatccattttatcaatattctggttatagat

SEQ ID NO: 77169 - DNA, 303 bp, Zea mays
  Clone ID: LIB3079-001-Q1-K1-E1
gctgctaggatgttacaataaacgctatccacagtaggcatacatgacagtctgagggatgtggatttcttgagtgcttagctcatgcatcatacatagaaagctctgtaaaattttactggtcaagtgatgcctaacactgaccggccatttaaattgaactggtcatcgtatagcatgtttgaaacgcgatctgaactggctactgatcactcgatatttgatgcccatctagctgctgatgtcactgatcaaatgctgcaggagctcttcttgagcaagtaccgatcggtgaaaggagct

SEQ ID NO: 77170 - DNA, 474 bp, Zea mays
  Clone ID: LIB3079-001-Q1-K1-E11
cggacgcgtggggtaacgctaagttagtttccacaaagcaagaaattagcgaggacacacgcaagaatattggcacttcacctagtccaaatggttctgctgtagtcaagaagcaaatgccaaaggagagcaaaaaggaagttgctactgagagaagatcaccaccaaagcttcataggagttcgccaacaccagcgaggacttcaccaacaaagctcagtccagcagcaaagcagaatggaaactctggtccagtttcttctgtatctactgttaaaaaaagagttagtgaaactatctcttgggactccctcccaacaagcctaatcaattcaggaaaggctgttgtccggaggaagaacattgctcttattgtagcggctgaggctcaaagggaagctgctgcagctgcgtatcttgtaaaaggccttgggtaagtaggcccatacccagatatttcatatgatatagtaa

SEQ ID NO: 77171 - DNA, 446 bp, Zea mays
  unsure at all n locations
  Clone ID: LIB3079-001-Q1-K1-E2
cggcggtgcagggcccgcggccggaccccgtccgcgccgcggtgctgcgcgccatccagctcggctaccgccacttcgacacggccgcgcactacgccaccgaggcgcccatcggggaggccgtcgccgaggccgtgcgcacggggctcgtcgcctcccgcgaggacctcttcgtcacgtccaaggtctggtgcgccgacgcgcaccgggacagggtgctcccggccctccgccggacgctcagcaatctccagatggaatacgtggacctgtacatggtgcactggcccgtgaccatgaaggccgggaggttcacggcccccttcacgcccgaggacttcgagccgttcgacatgcgggccgtgtgggaggccatggaggagtgccaccgnctgggcctggccaaggccatcggcgtgtgcaacttcttctgcaagaagctcgag

SEQ ID NO: 77172 - DNA, 419 bp, Zea mays
  Clone ID: LIB3079-001-Q1-K1-E3
cagattttcttgtcccaatacttgattttgttcctgagaagcgccctacagctgctcaattgcttcagcatccatggcttgatgttggtcccctccgacagcaacctaaaacacggccagagtcagcacggagtccaggtgatggtgtttcagagaagcaaaagaaagagaaagaagaaagagaggcaatggccgtagagttagggaacattgccatagatggtgcttcttccaggatggcaaatgacccccaatcaagcacaataaaacaaccgctacctcttctaagaagtgagctgcatttgatttcatgagttaagctgtaaaacttgttttcattcgagaattgctccatgagtgggaaacatatgttttttttaggtttgagatatggtaagatagctaccgagggaaaagaa

SEQ ID NO: 77173 - DNA, 447 bp, Zea mays
  Clone ID: LIB3079-001-Q1-K1-E4
gtttgtagctgggcttacagagctgacccctgatacagttcaagtacttaaatcggcagataaattagagaaggaccttgttaatatcgctgtagaagattctgtggatagtgatgatggaggcaagtcacttatcagagagatgccgccatatgaagctgaaaatgcaattgctaatctggtgaaagtgtggataaaagatagagtagacagactcaagggatgggttgaccggaatttgaagcaagagacctggaatccaggtgccaacagggataattttgctccctcttctgtggagatgcttcgggttattggtgaaacattggatgcatttttccaattgcctataccaatgcatccagctcttcttcctgatctgacagctgggctcgacagaagcctacaactttatgttgctaaagcaaaatctggctgtggaacacg

SEQ ID NO: 77174 - DNA, 387 bp, Zea mays
  unsure at all n locations
  Clone ID: LIB3079-001-Q1-K1-E5
gaagacatggaggcttaccgaatgaagaggattcaccatgacgatcctatgaaagattttctcaactgaaaagtgtggtagataactagatgttcatggcactgtatcacattggttgcaccgtgccttgcatcagtgttgtgttactgtagggtggctacgcctgtcctaaggatatggccagcagaccgtgcatgtggcagtgtgtgttgcacttaaattatgatatgggaggggtaaggctggagatagcttaaccagagtggtggtggtgctgtgatctagtggcagaatgtaagaaactggctacaccttttacaagctgcgtgttggagatgtatggngctgtttgcgttggattgaccgctgcagttgtaatctatagag

SEQ ID NO: 77175 - DNA, 444 bp, Zea mays
  Clone ID: LIB3079-001-Q1-K1-D10
gttcccagttcccaccgtgtagatggttctggtataaaatgtattgccatgggtgtaacagagattactatatacaggttcgtgatcaaactttgagcagaataaagagcaatattgaactcatagtagcgacaaatggtggaaatagggtggtggtgatcccacactccatgggggtcctctattttctgcattttacgaaatgggtcgaagcacctgctcccgtggggggcagtggtggtccgaactggtgtgagaaccatattaaagctgtaatgaatattggaggatctttcttaggagttcctaaggctgttgctgggcttttctcatctgaagccaaagatgttgccgttgctaggtataaggtaattgattcatttatttaaagcaaaagggaatagcaaaagaatggaatattattggatgctcgacaagcttggc

SEQ ID NO: 77176 - DNA, 422 bp, Zea mays
  unsure at all n locations
  Clone ID: LIB3079-001-Q1-K1-B4
gtttatcctatgcatgctggcgagaaatttaacatggttatagcgcctactctgaatttggatggcaccccagatactggctactatactcaggctggcagaaaaactctggcagacaattatgagtacgtcatgcaagggaagctttacaaaatctcagaagacacatcatccagccaaaacgctaaagtggagatgtatgcatcgttcggcgggcttcttatgctgctcaggggtgacccttccactgccgctagctttgagcttgatcagaggctctttctgctcatccgcaaggtgtaaaactgtggttgctgaccacttangtgtttgccttgctcgccacttatttaatttccatccgtgggtgaagctgttatatactggtgtaagtactggtttctgtatcgccatggatttat

SEQ ID NO: 77177 - DNA, 450 bp, Zea mays
  Clone ID: LIB3079-001-Q1-K1-B5
tcgaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggttaatatggaaattctttcagaggttttcccttactttgtccgtgtcaacaaacaattcgaaatacctcgactttttcagaacaggtccgagtcaaatagcaatgattcgaagcacttctttttccattacactatttcggaaacctaaggactcgatcgtatggatatggaaaatacaggatttccggtcctaagcggaaaaggagggaaacggatactcaatttaaagtgagtaaacagaattccatac

SEQ ID NO: 77178 - DNA, 429 bp, Zea mays
  unsure at all n locations
  Clone ID: LIB3079-001-Q1-K1-B6
cccacgcgtccggtgagaacggtggggagtaagtccgagagaggccattctgaagactcacttatgtgtggcgaaggtctaggtctattcacagagttatccgatcgagagcttagtctttacacaagcatccttgcgaggcacttcaatgacgactagggaaagcttccgcgcttcttgatacctcattaaaaaaaatattggagtcgttgatcttgtcttgcgtctctatcttaatcatgcttccacgctttacttattatttaactagtttgtgtgtttatttttctagtttagatcgctaggctaagtgatatgattgatacataggttgtgtaaccactcctttgcggttgcggtagggatatgaacacacatataggtaagcctagtggttagtgatatntgcatacctcgaagtcttgagtg

SEQ ID NO: 77179 - DNA, 401 bp, Zea mays
  Clone ID: LIB3079-001-Q1-K1-B7
ggcggccagcggaggagggcacaggcagcagctaacatccctcactctcggtacctgacctgaccacgagagcaacatgggcggaggacacgacatgcacgggcagcactacggccacaacggcggcgtgaagggcttcgtgtccaacctcgtccacggcggcggcggccatggccatggaagcggctacggccatggccatggaaacggctacggccatgggaatggcggctacggcggcggccacgggtacccttctcccgccgccgtcggcgcgtaccctcattcgcacggcgcgtaccctcacccgcacggcggccacgggtacccttcttccgtcacctaccccgcgcactcggcgcactacgggcacacggggtcgtaccacaccagccacaaca

SEQ ID NO: 77180 - DNA, 106 bp, Zea mays
  Clone ID: LIB3079-001-Q1-K1-B8
gggaaacatgggaacttcgatttctagatctctactgctatttttctccaaaaattgtaataaattttgatagtcattggtcatttagtggattttcttctaagcc

SEQ ID NO: 77181 - DNA, 476 bp, Zea mays
  unsure at all n locations
  Clone ID: LIB3079-001-Q1-K1-B9
aatcaacagaaagtgcaccgcaaaacaaagtagttaatgtgtctgaacaagagctcaacagtgagccggatcagcccggcagctaaattactgatcaaggaacatggactggatacatcatcactgagagcatcaggcccccgtggcacccttctgaaaggggatgttctggcagcattgaagtcaggtatcaattcaagttcaaccaaagaaaagaagtctccagctcaaccttcgtctcagccaactcgagattcccaatctcaagcatcctctatttcacaaaaggatgatacatatgaagatattccgaatagtcagatacgcaaggtcattgccaaaaggttgctcgaatcaaaacagacgactccacatttgtatctatccaaagatgttgtgctggatcccttgctcgctttcaggaatgaactaanagagctacatggcattaaagtttcaagtaatgacatcatcat

SEQ ID NO: 77182 - DNA, 214 bp, Zea mays
  Clone ID: LIB3079-001-Q1-K1-C1
tcgcggacgcgtgggtggagggatgtctagcgttgctatgagatggcactcgtgggtctgcgggctggctacatgggtccgttcctgtgttttccgtaaaataaaattataattctatataattgaatcatttaatttaaaaaacaaactaaaacacagaagaaaaagacatagacatagaaacagcttcaagtcatggccatggaaacggcta

SEQ ID NO: 77183 - DNA, 403 bp, Zea mays
  Clone ID: LIB3079-001-Q1-K1-C10
ctcacgcgcacgttcaacgtcagatgcagcgactgaagtgctgaccactacgcggcatgatacgaagattgctacgtatatgggatattcttgctgatacatttgtgtaagcatgcacgccctcgcactcacactgatataggagagaatttagatgagaataaggatgacagttaactaggcaggaaggcatgtatccatgactagactgaatacctgactgggcataattgcagctgttagggctagtgtgcagcctaatgtgcacaatgaagtttcattggaacaaagataattagaatataaatcctttgaaaaatgataatctctaggaaaaactcatgtgccaaactagccctcaaacatatgctgacaaggaatcagtccatgaatcacaggatca

SEQ ID NO: 77184 - DNA, 360 bp, Zea mays
  Clone ID: LIB3079-001-Q1-K1-C11
gcacaaagtgtgctgctgctcccattagaaatataatagcgtatgttatggggatgcatatatatatgcatcatccatctacctgtgtggtgcaaaattctgaataaaacctgaataaaacctgattgagcaaaagaaaaataaaaaaaaagaacgcacaacagaaagcacaaaagacgacacagcagaaccacaaccagatgagaccgatgataacacttcatatggagatcacaaagttccgaagacatcccattctgaaagataataaatctctcttataggcgatgtgtcgcataagcctgcagtgcatgaagactgtccttagcatccagtacatggccacatcacaactcctac

SEQ ID NO: 77185 - DNA, 409 bp, Zea mays
  Clone ID: LIB3079-001-Q1-K1-C2
gacactctaaactcaaacaaatacatatattgtcggcattagctcttacccttttcacccatgatgactaagtgccagaagcgcgcgagcatccaaggactttggctcctttccatggttcttctagcgtcgtcctctcttgtctgtgcaagcatggcggtagatgggcaaaccaaagaggacatcaacgcaacgagtgtgacgagcatgaacatgacgaggtcgtcgtcggcgagctacaacatgactggcggcggcggagaacttaacagaggtccgtgcgtcgtgagatctggattctactggtgccagaacattggctatccgaccatgtcggagtgcttgaagaactgcgaatcgtaaagcactggagtatagaaaaggaataaagtggtctctgctagcttaa

SEQ ID NO: 77186 - DNA, 311 bp, Zea mays
  Clone ID: LIB3079-001-Q1-K1-C3
ataattcacatgagggctatccaacttattaatcagctaggtccttcgagtcaatgggggccgcccatgatacagtatggactcccataatccatgcgacaatgacttcataggccatggacctattacatggcgtccatattggacgacccgcccagccaactgagatcgccactagcttcaagatcttggctatccaggacagcagctatatctcagggtagagttttcatcccaatggcagagtagtggtaaaccgatatgttttacgctttttatgaatgtagtataacgtatgaaaacttttctct

SEQ ID NO: 77187 - DNA, 226 bp, Zea mays
  Clone ID: LIB3079-001-Q1-K1-C4
ttcactcaagcattcatccaaaccgacgcattgtttgtcccagacgtggtgaattagcacccggggggtccagttgacctttgggcgattcactgcaaggacgaatgcatgctgaaacttctgctagcccgggccaatatccttatgttcgactcccaacacgggcggacccgtctgtaccaagccgtctacattggccacgttagctgccttcaagccatcctta

SEQ ID NO: 77188 - DNA, 421 bp, Zea mays
  Clone ID: LIB3079-001-Q1-K1-C5
gcgtttccctcccttcctgtcgccgcaggccgccagatgcaatttcgccctcgattcgaccccgattcgtccgtccgcgaccgggattccgtccgtcaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaatgctccctatgtag

SEQ ID NO: 77189 - DNA, 442 bp, Zea mays
  Clone ID: LIB3079-001-Q1-K1-C6
cggacgcgtgggcgcgatggcaccgagaaggaccgcctcttccgcgccatcgaaaccgtccccgccgtacgccgcaaggccgactgggccatgcgctggatcgacggcggggagcgctttgccgagcgcctcgttgccttcgcctgcgtcgagggcatcttcttctcgggctccttctgcgccatcttctggctcaagaagcgcggcctcatgccgggcctcactttctctaatgagctcatctcccgggacgagggcctccactgcgacttcgcctgcctcctttatgacctccttcggggcaagctcgatgagtcccgcgtccgcgagatcgttgccgacgccgtcgacatcgagcgtgagttcgtttgcgacgcgctccccgtcgcgctggtcggaatgaacggcgggctcatgagccagtacatcgagttcgtcggcg

SEQ ID NO: 77190 - DNA, 345 bp, Zea mays
  Clone ID: LIB3079-001-Q1-K1-C7
aaaaaaaaaaaaaaaaaaaaaaaaaaaaaatttaaaaaaaaaaaaaaaaaaaaaaacaaatgggggaaccaaaaaaaaaaaaaaagggggaaccaattttaactccgcggggagggggacgtcatatcccttccttgggtgctcctggttgccagtctttgggggtcgttttttggccgtttcgtctgttaaacccctggcgtgtcttcaccttttggcctggggggtcattcccgtttggcccggtactgtcttggcttcccggcccttttcggtcggcctggcgaacggttttccgcccgggacggtttatgggtcgcgccctgtaccggggctttttgcccg

SEQ ID NO: 77191 - DNA, 376 bp, Zea mays
  Clone ID: LIB3079-001-Q1-K1-C8
tcgcccacgcgtccgcccacgcgtccgcggggtgccgccggacgtggtgaatcggcacaagcagacgccgctgatgctcgcggcgatgcacggcaagaccgactgcgtgctgaagctcctgcaggccggcgccaatatcctcatgttcgactcccagcacgggcggacctgcctgcaccacgcgtcctacttcggccacgtcggctgcctgcaggccatcctcacggcggcgcggaccacgccggtggccaactcatggggtttcgctcggttcgtcaacgtgagagacgaccacggcgccacgccgctccacctcgccgtcaggcagggccgtcccggctgcgtgcaggcgctgctggagaacggtgccatcgtc

SEQ ID NO: 77192 - DNA, 463 bp, Zea mays
  unsure at all n locations
  Clone ID: LIB3079-001-Q1-K1-C9
gagctggagagttcttcaagaatggattcttcaagaatttttcctgtgacctgagtggagcacagccactactaacaatgaccatttctgaaactctgaagtatgagtacagcctaacttgtccaatttgcttggacactttgttcaacccttatgcgcttagctgtgggcatctgttctgcaaagcctgtgcatgtggtgctgcttctgtctacatcttccagggtgtcaagtcggcacctccggaggccaagtgccctgtctgccgagcggttggtgtgtttgatcgtgctgtgcgtatgactgaactagaattgctcctcaagagaagggacaaagattactttctgcagagactgcgcgaagagcgaagtgtgatggtgaagcaggccaaagaatactgtgactcacaggcaatgctatcgatggnngattgaaagctacaatgttcttaccagttcaa

SEQ ID NO: 77193 - DNA, 433 bp, Zea mays
  Clone ID: LIB3079-001-Q1-K1-B2
cagaaatgttccccacaaaccaccgtaccctcctgcccgtccaccgagacgtcaagcggatgaatactcggggagtgagagggaggagtcagagtacgaaacggatggcgaggatattgaacattcactgcctcgtggaagaagggaggacgagctggatgaggaggaagaatacgaggaagatgttgaagaagaagaagcgcctctgtcggatgaagaaatggaggtatgatatcttggcctagattcagattcttctgaagctaacatatcaaagaacggaacaatacttcatgtctttacatcagacaagaaggttcacggaaatcagttcagaggagggggcattggtgtagttcttttttcttcttctaaataatcaaaatgggactcgcgatgcatgcaccgaaacgtaagagagaatcagggggtg

SEQ ID NO: 77194 - DNA, 342 bp, Zea mays
  Clone ID: LIB3079-001-Q1-K1-A10
attgatcatactatggctgctgatctgaatttgatctatgtggttgcacgtgggttatagtgcttgaaccgtgatctacaaacgacatcacatggtacgcattgtaaaggatataaacgaatgaatgctagatgaagatgactgtagaatagaagcttaatatatgcaggcatttcatggatacaatgatgcaatggggtatgacatggcatgcaaaatcacaatttgagtatcatgactgtacatacataaacgtgtatagactatgcaaagattgtatagagtctcgattagagatcttgattctatacgatctcttgctcctgatcgtgagttgacttt

SEQ ID NO: 77195 - DNA, 477 bp, Zea mays
  Clone ID: LIB3079-001-Q1-K1-A11
ggacagagaagcccagcccagaatcggagtacatagctatcagggctccgctgtctccagttattcttccggaggctgagagatctgatgacctggggagctcatatgaggtggtgactgagtgtctaaaggatgaacctgaggagccaaccttgggcgccgtggagaaaccttaccaggccccctttgctagggtgacatcgctggagaatgcatcagacaacagtccattacctgaatcacttgcgcatgcaaatagcattaaggctcgagtgcctgagcctgtgtacacagtttcagttgagggccatgtggtaagtgaaaagcctcgaagcaaagagccaaaaggcttgaggaaacttttgaaatttggcaggaaaagccatgctgagggcgcaatggattcatcagttgacgaagcctcagcaggagatggttcgatgctgaagaatctcatttctcaagatgactctggtg

SEQ ID NO: 77196 - DNA, 457 bp, Zea mays
  unsure at all n locations
  Clone ID: LIB3079-001-Q1-K1-A12
accgccgccacttgcttctttgatttgatttcattcggttcgttcggtgcgggtcccgtcctggatctgttgcgcgagagcgcggcagcgcgcgagattcgcccccttctcttctcataggaagcaggaagcaagccgatcgctcgctgagcgccgccgccgatggccgtcgcggtgccgatgaagctctggagggtggagacccgcggcaaggccgccgccgcggggcccgacgaccccctgcgcgtcctggtgacggtgaccgtcctcgggagcgccggcccgttgcgcttcatcgtcctcgagggcgacacggtcgccgcgctcatccgcggcgcgcttcgctgctacgcccgcgagggccgcatgccgctgctcggcaccgaccctgccggcttcgtcctctccaccgncaacggcggatccggcgcacttcgagaagacgagaggatcagct

SEQ ID NO: 77197 - DNA, 413 bp, Zea mays
  Clone ID: LIB3079-001-Q1-K1-A3
cacatattatgtcatgcccaatgggaagcgtgcaaggtgtgctggtgatgtggataagtttctggaggcaaatccggagtacaaagaccgcatatctgcttcggatttcagctttgcgccacccaaggttgttgaggagactgtttctcacaaccctgcctggcaagctgccaaggccaagaagcaggagaaggcagaggcacaaaagtgaatgatactcccaacggtgcttgtgttatgtttagatgatagtccgctcaagatcatgccccatcctatctagtgtgtacttgtctatctcgactgaagtcgatgtttaggtctttttagctgatttggctctgcatgcttcgttgcaacggagcccctgcgtgtcaattcctggggaataaatgagatgttgaataagtgct

SEQ ID NO: 77198 - DNA, 438 bp, Zea mays
  Clone ID: LIB3079-001-Q1-K1-A4
aacaaccctcccgagcctaactactactcctaccatggcggctacggcgccgtcccggcgggctacggacctgcaggcgtctctggcgccggcgggtggggcgcgggctccggcggcggtggcgggtacgcacacggcggcgtggaagcgccgacggtgatgtgccaggacaaggggccctgctacggcaagaaggtggcgtgccccaagcgctgcttctggtcctacagccgctccggcagcggatacggagccggaggcggcggcgggtcctgcaccgtcgactgcaaggacaagtgcaccgtcacctgctgatggatcgacgggtagagctaactagctatctgctcatggctctccactcgatcgatgacgatatatactactacatacagtgtgtgtgcgctggtactatatatatatatatatatatatata

SEQ ID NO: 77199 - DNA, 413 bp, Zea mays; identical to SEQ ID NO: 77197
  Clone ID: LIB3079-001-Q1-K1-A5

SEQ ID NO: 77200 - DNA, 355 bp, Zea mays
  Clone ID: LIB3079-001-Q1-K1-A6
aaatcaactcagtaatttgcaataccttataaacttctctcaggtggatgtaattagaacaaagttcgaggataacatcaaagatctctatattttgcattcgaaatcttcaaaatatacggagcttggcctttcccgtttctgggggtatctgaactacaatgagtatcattctacgaaagtcagcaaagatatggacaacttctatttttgataggacattgcaagactgaagtaaggtttgcctttatatttgggcaatagctcactggccaccgggactagcttaccttgtgaggtacacaactgctgagtggtgagagttcttgtagatatacgctggtttgatcaaatt

SEQ ID NO: 77201 - DNA, 413 bp, Zea mays; identical to SEQ ID NO: 77197
  Clone ID: LIB3079-001-Q1-K1-A7

SEQ ID NO: 77202 - DNA, 389 bp, Zea mays
  Clone ID: LIB3079-001-Q1-K1-A8
ctgaaagacctgtacaagtcctttgtttctgagtaccctatcgagtcgatcgaagacccatttgatcaggacgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgcccgtctgagcg

SEQ ID NO: 77203 - DNA, 474 bp, Zea mays
  unsure at all n locations
  Clone ID: LIB3079-001-Q1-K1-A9
cccacgcgtccggcaacgtcgccacttcactcacgattggagtttcacctgggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaagtcccccaagaaccagcgccccaagtgcccctaggccctaccgctctaagggagggaggatgacccangatttcgctcgcgatcctgcacagcttctagtc

SEQ ID NO: 77204 - DNA, 435 bp, Zea mays
  Clone ID: LIB3079-001-Q1-K1-B1
cacatattatgtcatgcccaatgggaagcgtgcaaggtgtgctggtgatgtggataagtttctggaggcaaatccggagtacaaagaccgcatatctgcttcggatttcagctttgcgccacccaaggttgttgaggagactgtttctcacaaccctgcctggcaagctgccaaggccaagaagcaggagaaggcagaggcacaaaagtgaatgatactcccaacggtgcttgtgttatgtttagatgatagtccgctcaagatcatgccccatcctatctagtgtgtacttgtctatctcgactgaagtcgatgtttaggtctttttagctgatttggctctgcatgcttcgttgcaacggagcccctgcgtgtcaattcctggggaataaatgagatgttgaataagtgctgtagagtgtagacctgcttttt

SEQ ID NO: 77205 - DNA, 461 bp, Zea mays
  unsure at all n locations
  Clone ID: LIB3079-001-Q1-K1-B10
aggagataaggactatgaagcgatgcagaaattgaaaaaccttgcaaagaggcaggaatctgagaacatggccctcatacagaaaatcttgaaagatgagaaggaactggcgactcggcagcaggaggtgcttgatggaaactgcaagaagtacgacatgctggaagctctagtgcagaagggagacatcactaaccttgctcaacaatacggagtgaacttgaacgactgatgagtcattcgtgtctttttcccccttccccttggagcgatggcgcaactggtgtgatgatgatggaataggatagcatgccatagttttggtccggtatctggaccctccctctggtgtaaagactatcccaacttaggcttgggcttttcagccttctttggctctccaaaaaatctaaattagctggctctgagcctctgactntctgatcgatccaagctagctg

SEQ ID NO: 77206 - DNA, 474 bp, Zea mays
  Clone ID: LIB3079-001-Q1-K1-B11
cgcttgccgactacaacattcagaaggagagcaccctccacttggtgctgggtgtcaggggtggcatgcagatcttcgtgaagacacttactggcaagacgatcacccttgaggtggagtcctcggacaccatcgacaatgtcaaggccaagatccaggacaaggagggcattccaccggaccagcagcggctcatctttgctggcaagcagctggaggatggccgtacccttgcagattacaacatccagaaggagagcaccctccacttggtgctgcctctcaggggtggcatgcagatcttcgtgaagactcttactggcaagacgatcacccttgaggtggagtcctcagacaccattgacaacgtcaaggccaagatccaggacaaggagggcattccaccggaccagcagcggctgatcttcgccggcaagcagctggaggatggtcgcaccttggctgactacaaca

SEQ ID NO: 77207 - DNA, 430 bp, Zea mays
  Clone ID: LIB3079-001-Q1-K1-B12
agaggaagaagatgatgtcggaaggcgacgatctgcgtggtgggactcatggacgtgatatgatcgacgtcctgctaggcaacggcaacgacgagctcaccgacgagctgatatctgacaacatgatcgacttcatgatccctgcagaggactccgtgcccgtgctcatcacgctggccgtcaagtacctcagcgaatgcccacaggctctgcagcaactcgaggaggagaacatggagctcaagaggcagaaatcaggcgcgggagaaaccctagaatggacagactacatgtcgctcgccttcacacagcacgtgatcacggagacgctgcggatgggcaacatcatcaacgggatcatgcggaaggcggtgcgagacgtggaggtgagaggccacctggtcccgaagggctggcgcgtcctcgtcta

SEQ ID NO: 77208 - DNA, 413 bp, Zea mays; identical to SEQ ID NO: 77197
  Clone ID: LIB3079-001-Q1-K1-A1

SEQ ID NO: 77209 - DNA, 131 bp, Zea mays
  Clone ID: LIB3079-003-Q1-K1-D5
aaaaaaaaaaaaaaaaaaaaaaaaaattatttaaaaaaaaaaaaaaaaaaaaaaaaaagaagatataataaaaaaaaataaaaaacacataaataaaacaaaaataaataatatttaaaattacataaaat

SEQ ID NO: 77210 - DNA, 463 bp, Zea mays
  unsure at all n locations
  Clone ID: LIB3079-003-Q1-K1-D6
atcacgggttgctcctcctgatctcgatgaattcaagacaagagcaattgctgaaaggggacctggtatttctagtcaacctggtaatatcatccaccgaagggagcctagtgggaagttgtataattatgctgcagcttctaaaggggccaaggttctggatttcaataaggaggctaagggtgcttccaacatcttagataaagacaaagacaagtacctccgcaatccttgctcagcagaggggaagtttgtcatcatagagctttctgaagaaaccttagtagatacaatcgcaattgcaaattttgagcattattcttctaatccaaaagaatttgaactgctgagcagtctgacatatcccacagaaaactgggaaactcttggaagattcactgccgcgaatgcaaaacttgctcaaaatttcacttntcttgaaccaaagtgggctagatatttg

SEQ ID NO: 77211 - DNA, 455 bp, Zea mays
  unsure at all n locations
  Clone ID: LIB3079-003-Q1-K1-D7
gtcatcttctcctcctcagaaacccaccaaccccgtccagccgccggctgtctcggccgccgccgccgccgccgccgccctatcccggtccttcaggcgaaccaggttggtcatggccttcaacaagatcaaggtctccaaccccgtcgtcgagatggacggcgatgagatgaccagggtgttctggaaatctatcaaggacaagcttatattccctttcgtagacctcgacatcaaatattttgacctcgggcttccacaccgtgatgctaccgacgacaaagtcacagtggaggctgcggaggccacactcaagtacaatgtggctatcaagtgtgccaccattacaccagatgaagcangggtaaatgagtttggcttgaaggctatgtggaagagcccaaatggcacaattaggaatattctgaatggcactgtgttcagagaaccaatca

SEQ ID NO: 77212 - DNA, 464 bp, Zea mays
  Clone ID: LIB3079-003-Q1-K1-D8
cacaaacttagctgtgaacttgacactataagtggctcgttcctacccaattgtgctcgaatgcgctacttagaagcattgctagacagaggatcgaaagatgggttagtactgattaaaaaatggcttattgaagccttgcagcatgggaagctaacatctgcatccaaaggttggcaaggagccacttctgtttcagagattcgatctatggtgcaaatgctttcccgagaccagttgtcattgttaaaaaacaggggtgttatccagttagcactagctgctgaaatgactctacgggagcctcaaagttctcgctgggacgcctttacaagtgccgagagaatattaagtgtgacatctgcagagacacctcaaagtcttgccagtgagcttcgtgatttcatcaacactagcactttagttgaatcacacacacaaactacttcaatggagtcttcaca

SEQ ID NO: 77213 - DNA, 393 bp, Zea mays
  Clone ID: LIB3079-003-Q1-K1-D9
cgataacccagagacctcgagaacggctggaataaccgagagcgctccggaaatgtgggcgggtgagctgcggttggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagcaagagaaggtggagactactttcaagccaacatcagtggatataaagtttcatgatgt

SEQ ID NO: 77214 - DNA, 451 bp, Zea mays
  Clone ID: LIB3079-003-Q1-K1-E1
gaaatataaaaccctttttaagggacgatggccgaaaccaaactggtgctttttaccgtgtcctttgttgcaaacgctaaatttctcacgaattcttccgtcgtcggcggcgcagattgaatgccaaaaccctagctcgccctccccaattccccatttcggccacaccctccttgcctccacggctccacccctgcttcaggttacctgtgccagcgacgccggtagaagccatggacagctctctcgcgagcgcggcggcgatagccgatcagcgccagacgatcgagcagtaccggcacatcctcgcctacgtcctctcgtcttccccaccggacatctctcaggccaagcgcttgctcgaccacatggtttcggacgaagttccgctcgtggtgtcgcgtcaattgctccagacgttcgcgcaggaccctaggaagctggagtcgga

SEQ ID NO: 77215 - DNA, 369 bp, Zea mays
  Clone ID: LIB3079-003-Q1-K1-E10
ggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaaggctgttggcaaagtgcttcct

SEQ ID NO: 77216 - DNA, 145 bp, Zea mays
  Clone ID: LIB3079-003-Q1-K1-E11
gcgggggatagtcggaggcggagaggttgatttaccagccccaatcaccgccctcgggcatgggtataacagccgcgggcagggtataggccaccatggtctggccaccgcaggtgaccaggttcgcccgcctgaccacctacac

SEQ ID NO: 77217 - DNA, 266 bp, Zea mays
  Clone ID: LIB3079-003-Q1-K1-E12
ggccaactgcccagcgtgagtcgtgacctgcctgtcaatcgcttgagtcttgaccatgggccacacggaattagatatctgtggtgcactgattttgggctaacgacccgatttctatctaaaaaaaaaaaaaaaaaaaaaaaaaaaaaaaaaaaaaaaaaaaaaaaaaaaaaaaaaaaaaaaaaaaaaaaagagcataaaaagaaataacaattataataagcgtcacctaaaatcaaatcaatggccaataaaatacaacaaat

SEQ ID NO: 77218 - DNA, 406 bp, Zea mays
  unsure at all n locations
  Clone ID: LIB3079-003-Q1-K1-E2
gttgtagatcgcgacggccgccctttttttttttttttgacaaagcacaagcatcaacggtggtattccaatagataatgttatacatattatccataaaacaaagacgaacttgtgtaggctcactgcaacaaaaaggaatgaaacgatactgaaccacgcatgagttcaccataaggtacgcaaagacaaaacacagtaatacttcttgatattggtttatgcagttcacattccatttcatcttctactgggaaggaatgggctgcatctctggtgctgcagcaacgtcagccacggggtacctgaacacgcgggcgagccgctcagtgggcaccagcgggagataggtggccacggcgttcccgcgcttggcaccatcacgcaccgncgaattgtacctggc

SEQ ID NO: 77219 - DNA, 417 bp, Zea mays
  Clone ID: LIB3079-003-Q1-K1-E4
cgcgaaccagcagtccagcacacagcacagcacgactcgggcgcgccgcgcacacggagcggggtgcacgcctcgccggctcaccaatcgacaccctgtccaaccagcaccacccggcgtcgtcctccctggcggggggttaggctagctagagctgtacagcgcgagagcgacgaacggcaggtcgatcggcggtcgcacgtacgtcgtcgaccgagagcagagcaggcgaccgcggcgccagagatagttcgaatccgattccgacccatccatgggggttcacctgctgaagaagcagcactcgtcggcgccgtcgtcgctgggccgcggctccggctccgggtccgcatccgggtcgtcggtgtcggcgtcgtcgatgccgcccaaggggtgcatggcggtgcgcgtggtggg

SEQ ID NO: 77220 - DNA, 78 bp, Zea mays
  Clone ID: LIB3079-003-Q1-K1-E5
cccacgcgtccgaaaaaaaaaaaattttcttaaaaaaaaaaaatactaaaaaaaaaggaagtttattgacaaccgttt

SEQ ID NO: 77221 - DNA, 460 bp, Zea mays
  Clone ID: LIB3079-003-Q1-K1-E6
cgcgtgcgaaccaagcagaccacaacaagaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggaaaggctcggcgattacctgatcgagcagggc

SEQ ID NO: 77222 - DNA, 456 bp, Zea mays
  unsure at all n locations
  Clone ID: LIB3079-003-Q1-K1-E7
gctaacctttgtggcaatgacaaactgcatatacggttgaggggagaaggtggaatcagggcattgcttgggatggttaggtgtgggcaccctgatgtccttgctcaagttgcacgtggcattgcaaattttgcaaaatgtgaatctagagcagctactcaaggaaataaggtgggaaaatcactattaatcgacgatggatcgctcccttggattgtaaaaaatgccaataacgaagctgccccaattaggcggcacatagagctcgcactgtgtcatttggcacagcatgaagtaaattcgaacgacattatcaatgaaggagccctatgggagcttgtacggatttcaagggactgttctcgagaagatataaggaagttggcataccggacactgacatccagccccactcttcaagccgagatgangagactgggaataaaactgtgatga

SEQ ID NO: 77223 - DNA, 407 bp, Zea mays
  Clone ID: LIB3079-003-Q1-K1-E8
cacattttcaaaatatgaccaggcaaaagctcttggaaagacaactattgatgtggctggtattgctgccgggttgccatgtggtagtgaaagcttcctcttgatgtttgccagatggagaaaacttgagagggatttatacaatgaaagaaaggaccgttttgacattacacagatcccagatgtatatgattcctgcaagtatgaccttttgcataatgctcatctcaatcttaagggtttggaagagctattcaaagttgctcaaatactcgctgatggtgttattccaaatgagtatgggatcaacccaaagcaaaaactgaaaatcggctcaaagatagcgcgccgtttattgggaaaaatcctaatcgatctacgcaacactcgtgaagaagctatcagtg

SEQ ID NO: 77224 - DNA, 424 bp, Zea mays
  unsure at all n locations
  Clone ID: LIB3079-003-Q1-K1-E9
gttgcgtgagcatcatcagtgcggcggtggccaccatctggagctgggctcttcgtggtcctcaaggttccggctgccgatgatgatgtcgtacgcgccgcagaacgagcacttgctgcaggaacagacactgaacaacgctcgtccggctcctgagaagaggcagcgggttccgtcggcgtataacagattcatcaaggaagagattcgcaggatcaaggcgaacaaccccgacattagccacagggaagccttcagcacagcagccaagaactgggcacattatccgaacatccatttcggcttaaactccggccgagagggtggcaagaataagctcgtggacgaggctgtcgcggcggtggcngtggcttcgaagaagatccaaggtttctactgatcgatgccggtcgatcgagggatc

SEQ ID NO: 77225 - DNA, 435 bp, Zea mays
  Clone ID: LIB3079-003-Q1-K1-D4
gtcatgcgtctgggcgctatggactcagttcagacgtcccgaggttacagctacaacgggccgctgtacaggctcgacagtacgagcttcaccacgcgagaggacctaactgaagcgggctccacgacgttcgacggactggcgtgaccggacacttatgcacagtgctttacatgctggcaaaatcaacctgcacaccactgacgctggtggaacatggccaccggccacaccatcaggctgctccattgaccgagcttcgagagccgcctgttgccgtaccaggacccgtccctgaacgagaccttgctcgggcacctgagccggaactgcccgcacaaggtcacctacctgcggacgccgaatgacatgcacacgcacgtcgccttctacaacaagtactacgaccacctggtgaaccacgacgggctcttc

SEQ ID NO: 77226 - DNA, 365 bp, Zea mays
  Clone ID: LIB3079-003-Q1-K1-B9
ctcgacatggccgttaacctcgtcaacttcgtcacctacaccaacaagggcgagatcggtgtggccggcacgcgcatctacgtgcaggaagggatctacgacgagttcgtgaagaaggccgccgagctcgccagcaagtccgtggtcggagacccgttcaacccgagtgtcagccaaggcccccaggttgacaaggaccagtacgagaaggtcctcaggtacattgacatcgggaagcgcgaaggcgccacgctggtcaccggagggaagccctgcggcgacaagggctactacatcgagcccaccatcttcacggacgtcaaggacgacatgacgatcgcacaggatgaaaatctttggccgtg

SEQ ID NO: 77227 - DNA, 232 bp, Zea mays
  Clone ID: LIB3079-003-Q1-K1-C1
aaaaaaaaaaaataattaaaaaaaaaattttttaaaaaaaaaaaaaaaaaaaaaaaaaaaggggcttattataaaacatctgaccctattaaatacaccaaaataacatcttatttcttttttatagtcccctctaattaactctctcttcatcaattttcaccaccttaacttttaaaacactttaattcccaaccttttactcttctaaaaccatattcctttcacccct

SEQ ID NO: 77228 - DNA, 380 bp, Zea mays
  Clone ID: LIB3079-003-Q1-K1-C10
gctggcttctcctccccctcttaccaagtccttctcgggttagggttccttagggttgtgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctactgcggctgtcgcggcggcggcg

SEQ ID NO: 77229 - DNA, 403 bp, Zea mays
  Clone ID: LIB3079-003-Q1-K1-C11
cccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaaccagagctggaagatcctgccgtggggtcccgaggccaactcctccgcggcccacgcgggaggcccgcacgccgtgcgcgtcttctgcaaagccggcggcgaggactacagcctcacggtgcgcaacggcacggcgtgcctggcgcccaccaacccgcgggacgagtaccagcactgggtcaaggacatgcgccac

SEQ ID NO: 77230 - DNA, 383 bp, Zea mays
  Clone ID: LIB3079-003-Q1-K1-C12
cggacgcgtccggcagcggcaagtgctactgttgctccagctgctcctgcggcagcggatgcgactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccggcattatcgatccatggtcgctcctggggttcatgttcatct

SEQ ID NO: 77231 - DNA, 422 bp, Zea mays
  Clone ID: LIB3079-003-Q1-K1-C2
gaaacgtgtaagcagcaccattttctttaattctggatctgatgatggatatgtcgggagtgctgcaccatttcctgggaggatactgccggtagatctaacaaactttagtggagaacttctttgccaggcagatgcttttctatgttcggtcaatgatgtctccgtctctagtacagttgagccaaggccacggaatattgagattggtgcagagatgatccttaaacaaaaacttaggggccaggggatggcttttcttgttggtggtggatcagtcatgcagaaaatccttgctcctagagaggtgataactgttgatgctgcttgtattgtggctatgtcggccaccattaacttccagttgaagagccctaaccagcttagaagagcagtttttgggggtgataaccagctaacag

SEQ ID NO: 77232 - DNA, 441 bp, Zea mays
  Clone ID: LIB3079-003-Q1-K1-C3
ctgggtcagatgatgatgatgacgatgaatacgatgaagatgaagatgaagatgatggtgatgatgatgatgatgatgatgagggtggtgacgacgacgatgaagacgatgatgatgaagaggggggtgatgaagatgatgatcctgaggctaatggtgaaggggggagtgatgatgacgacgatgataacgatggtgatgatgatggtaacgatgatgacgacgatgaagatgatgacgaagatgaagatgaagaggatgacgacgatgaggaagaacagccaccttccaagaagaagaagtgatttgctctttcatggattcacctcagcttctccatgctgttagttgtgttggttagatcatggaacagctttgggacaaatgttgcttgtcatggtattatagtgtaggaaaccttgacatctgatgttaaaatcg

SEQ ID NO: 77233 - DNA, 467 bp, Zea mays
  unsure at all n locations
  Clone ID: LIB3079-003-Q1-K1-C4
cccacgcgtccgccgtctccacgccgcgttctcccgcacgaatccgcgctccggccaacgggcgcaagccctagccacccccgcccattcatggtgggcgggccgtgagatctctagggaggcttgtcggcttcgtcgggcgggaggggaggagatgggcgcccggaacagcgctgccgccacgccggtgctgctcaacgtgtacgaccttacggccgcgaacgattacctctactggctcggcttcggcgtcttccactccggaatcgaagtccatggcacggaatatgggtttggagcccacgactacccatccagtggtgtgtttgaggtggaatcaaagagttgccctggctttatctacagaagaacagtgtggctaggcacaacagacatgtctcaggaagaattccgctcgtttattggaaaacttgcanngtgatatcatggcgacacatatcatttaa

SEQ ID NO: 77234 - DNA, 217 bp, Zea mays
  Clone ID: LIB3079-003-Q1-K1-C5
gtagaatctgtctaaacagctaaggtttttactcgcctgtatgctagcggtgcatgagagcgcatttatgttcttgatgtaataacccatcatacttcagtcctcatctattgccatttgcttgataaaaaattggctatacatatgctccatggaatgaagtctctacatgactatcactctgtatcgattggttgtacacttgtggtcattatca

SEQ ID NO: 77235 - DNA, 440 bp, Zea mays
  Clone ID: LIB3079-003-Q1-K1-C6
gtcatcttcaaacgacgataatggctgggatggcttccagtctgcacaaccagtacctagttcagagaaaaaagattctgccaaaccagcagaaagcaagacccagtctacatctggaatggaagacttatttaaagactcaccagctgtgccattatcctcagctccagctgtttcccaagtaaacgctaagaatgatatcatgagtttgtttgagaagtccaatatggtatcacctttcgctgcccatcaacagcagctggcgctcatgtctcagcagcaagctcttctaatggctgctctcaaagctggaaatgcaccacaaatgatgattccagggactgccaatcagctaaatgctaacggaaccttgcctttccaaaactggacaaatctttatcaaaatcctgggtcgactccagcagcagcacagaatggtg

SEQ ID NO: 77236 - DNA, 361 bp, Zea mays
  Clone ID: LIB3079-003-Q1-K1-C9
gtctgtcattatcatttaaaaacgtatctagatgcattacggaagatttttagtttcgtttgttatatttgagaagttatatattgtatatacagagagatgcagctgtgtattatttgctgtagcttcgattgcgagacgcatggttgcagtcattttattgtagttagtttatatgatacgtcgttgtcaccgcatgaagattaactgctgtgccatatgaagacctcctgcctcatcacggtgtttgtatataagatcaactgcagtgcctacacggtggacggagtatttgtatgatgtgaaggtcactattcagcatcgtcagtatgaaatggctatggccttcaaagcttaaaaa

SEQ ID NO: 77237 - DNA, 411 bp, Zea mays
  Clone ID: LIB3079-003-Q1-K1-D1
accagttccggcatgttcctcgagaagaatcaggatgaagtagtaacgaggatagaggagaggatatctgcttggacatttcttccaccagagaatggtgaagccattcagatattacactaccagaatggtgagaaatatgaaccccactacgactacttccatgacaaaaataatcaggccctgggcggccatcgcattgccactgtgctgatgtacctatcaaatgtcgagaagggtggagagaccatcttccccaatgcagaggggaagctattgcaacccaaggacgacacttggtctgattgtgcaagaaacggatatgcagttaaaccggtaaagggtgatgccctgctgttcttcagtctccaccctgattcaacaacagactctgacagcttgcacggtagc

SEQ ID NO: 77238 - DNA, 285 bp, Zea mays
  Clone ID: LIB3079-003-Q1-K1-D10
gttctagatcgcgagtggccgccctttttttttatttttttttttttttttttttttgtttttttttttttttttttttttttttttttttttttttttttttttttttttttttttttttttttttttttttttttttttttttttttttttttttttttttttttttttttttttttttttttttttttttttatttttttttttttttttaatataattacttttgtaccaaatttatgtatttttatcaaaatacttctatcttcattaaacttctttttt

SEQ ID NO: 77239 - DNA, 307 bp, Zea mays
  unsure at all n locations
  Clone ID: LIB3079-003-Q1-K1-D11
ctgggaacccgcacaccgtcaagcctttcctctacaagccggccaccgtccctcntggttgtagttaaacaacacatcttgctggaacgcagaagatagaacatacaggaagaaaatatgtattcgtgccccgactccatatgaccatatataagtaaacactgtttgatgtaaatcaaagattcagctgtctatgggagctgttctagtgaaaaaaaaaaaaaaaaaaaaaaaaaaaaaaaaaaaaaaaaaaaaaacaaataaaaaaaaaaaaaacaaaaaaaagaataggacaaaaatacataat

SEQ ID NO: 77240 - DNA, 155 bp, Zea mays
  Clone ID: LIB3079-003-Q1-K1-D12
aaaaaaaaaaaaaaaaaaaaaaaaaattataatttaaaaaaaaaaaaaaaaaaaaaaaagaaaaggttaaataaaaaaaaaaacaaaacaaaaacaaaataaaaaaaaaaaaacataatcttgtccattttcatgtctcccaccttccttcccct

SEQ ID NO: 77241 - DNA, 450 bp, Zea mays
  unsure at all n locations
  Clone ID: LIB3079-003-Q1-K1-D2
gctgtatgagtacttaggagaggagtatcctgaggtgcttggttcaattcttggagccttgaaggctatcgtcaatgtcattggtatgactaaaatgactccaccaatcaaggatcttcttcctcgtctgacccccattcttaagaacaggcatgagaaggtccaagagaactgcattgatcttgttggtaggattgctgatcgtggagcagaatttgtgccagcaagggaatggatgaggatttgttttgagctgctcgaaatgttgaaggctcataagaagggtattaggagagcaactgtgaacacatttggttatatcgcaaaggctataaggccacaggatgtgttggccaccctgttgaataactngaangtgcaagaacgacagaaaccggtctgtacaactgtagctatngctatangtgctgaaacttgctcacctttcac

SEQ ID NO: 77242 - DNA, 408 bp, Zea mays
  Clone ID: LIB3079-003-Q1-K1-B8
acggcgagagacataaaaccagaaggatcacaaccgcgccataaagccagaaggtatcgcagttgcgccatattgtacagccgccatagtacttcccccctccctggccctaaatccagccagggttttcctcctccctcctgggtagccgtggccgcctgtagtccctccctcgtgtaattagaaccgtgtaccgagtcgagttcatttacccactgtttgaggttccagagagttgagatttaaattttaagtggcgccattgcccttcctttcttcctcccctcctaagtattaactttgttgcggccattgttgtcgtgactctggccatagatccttttatgtacatgcgaaatgtaaccaagggatatggaataagaacatgttcatcctgttgtagacaaa

SEQ ID NO: 77243 - DNA, 458 bp, Zea mays
  Clone ID: LIB3079-003-Q1-K1-D3
cggcttgatgcttggtattctgaccggagtggttccgtggagagcaccgctgcttacaggatgggagggctgtgtcggaggtgctgccttcctgaaacaattctaagatctatgcaggcatgtatcgcactctccgcggctggtgatgatctagattactctctagataaatgtgacgaacttgttgagttagttggttcagccgagtctggaatgatgcatttgttcagccagcagcagttgcaggagttcctgattttcgagagggaatatctcatatgtacaatggagtttgaggaggaccggttgccttgtgatggctaagctttttccccacttgctgactaatccatgagacatgaccggcatgtgcattttgtggcgccgtgacccaagaacctgctgtgatgtatcgctacaccatttcaaaagcgaaagatggaatttagtgcgtaacg

SEQ ID NO: 77244 - DNA, 339 bp, Zea mays
  Clone ID: LIB3079-003-Q1-K1-A3
acaaaacgtctgtacactcgtacgtcgatttgttagatatagtttgtatagatgactaggtgggggtaataaaggaaggtggatcatatgtgcttactgtagcgataaagatcagtacattgctacagcttctattggatgatgacattctggattcgcatactgcatactacgaagccggcggctagaatgtctaaactcatgtactatgagacgcagcagagaatgagatacttgttgtacaacttcaaggaccaccagaactgctgctcgatctacgcttggaaggagatcaaggactgcagctggtgcgactacagagttaagcacaaagggtgc

SEQ ID NO: 77245 - DNA, 447 bp, Zea mays
  Clone ID: LIB3079-003-Q1-K1-A4
cccgtttggtcaggttccagctctgcaggtatggtgacttgtacctcttcgaatcacgagcaaggtgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatgg

SEQ ID NO: 77246 - DNA, 452 bp, Zea mays
  unsure at all n locations
  Clone ID: LIB3079-003-Q1-K1-A5
gccgcaggatcagggagctcacgtctgtcgtccagaagaggttcaacttccccgagaacggcgtcgagctctacgccgagaaggtcgtcaaccgcggcctctgcgccatcgcgcaggctgagtccctccgctacaagctcctcggaggccttgccgtccggagggcctgctatggtgttcttcgctttgttatggagagtggtgccaagggttgtgaggtcattgtgagtggaaagctcagggctcaaagagccaagtccatgaagttcaaggatggctacatgatctcatctggtcagccagtgaatgagtacatcgactcagctgtgagacacgtnctcctcagacagggtgttctgggtatcaaggtgaagatcatgcttgactgggacccgaaagggcaggttggcccgatcacccctcttccggacctggtgaccatccataccccg

SEQ ID NO: 77247 - DNA, 444 bp, Zea mays
  Clone ID: LIB3079-003-Q1-K1-A7
tttgtttttttttttttttttttttaggctcaaacacaaaccggctttattgtgagtcgggaaaacacgggccccatcaagcgctcagagttccattacatggtatcagtgactttgctttactgtgatgttcaactccggataaaaacgtctcagttgaacacagacacccacaaaaagtcataggatacagagtgtgcttcacgtaattacatccatgagctggatgcctctcgtgcccgggctcggacgtgttcagctggacgcgacgaagccgatgctgaacccgaacgagatgcagctcagctcctcgttgtcgtccccgacaatcttcatgtagatcgtgtaggagcccggcggagtgaagcctggcagcgtctgctggtgggacagcacgaagtcgccggtcgctgggcaggaagtctctccgcagatgtcgcgggt

SEQ ID NO: 77248 - DNA, 459 bp, Zea mays
  unsure at all n locations
  Clone ID: LIB3079-003-Q1-K1-A8
ttttccgcctcctcgacgcaactcgtcgccgtcttctccaactcgcacttcgtccctcggcccacccaggggcggatctccacccggggctgcctgggctgcagcccctgtcggcagtcgcggcccagtccatcatcgcgcgacatgacctagcagtagcagcagacgtcctacgtccagccccagccgccgccgtttggctcctgcgttcgatctcgctgcgtcctggtcctgcgccctgcggtccagcctcctctccaagactccacttctccagcgcgctcgcccgcgccagccgccaggccgncaccggccaccgncattggccccaccatttgccgctcccgcctacgatgccgacgagtgaggtgtggagctggtccgattttgaaatcagcaagtacatcgctganggcaggttcggcagggtctacctcgcccgcgagaagcagagcgggt

SEQ ID NO: 77249 - DNA, 375 bp, Zea mays
  Clone ID: LIB3079-003-Q1-K1-A9
gcggaaggtaaggcggctctatgataccttccatgagccgttcaaacgggttcctgggcgaccacgaccaaacctcgtagtacccgataccccggaccgggagaaagcaaaaggccaaccttcgtctacagatggcagcagtttgcaagatgcggtagagaagccagatgcgtcgaagaagacgaagaaaggctctgatgtaagatcagccctcaccgttgcctttgccaagtattcggagaagatccgcagtcagggccgcgatgcgccaaacgaggccggtgagagtactggcggctcgaccgtggaagctgagagggcgggagactagatttagctgtaggatggttaacggtgcttgagtaatgctagttt

SEQ ID NO: 77250 - DNA, 362 bp, Zea mays
  Clone ID: LIB3079-003-Q1-K1-B1
aaggctcacactaacattgacatcaacgctggctgcacagccaactgcctagctaattgggctgatgctatcgatgacgagatcagtgtcaaggacggtctgatgaccactgtgcataccattactgatacccagactactgccgataggacctcatataaggactgaactaatgacaggactgctagaaggaacattattcccaacatcactggcactgctaatgctgctggcaaagcgcttgctgtactgaacggtgagcttaccggaatgtcgactcgagtgccaaccggcgatcgaaccgtcgatgattctactgttaagcttgcagagtcaccagcctatgatgagatcaatgatga

SEQ ID NO: 77251 - DNA, 368 bp, Zea mays
  Clone ID: LIB3079-003-Q1-K1-B10
gctcgattcgcgcagctgcatcaccggcgactgcggcgatggcacggaggagaaagagggacgccccgccgcggctggacgaggcagatcgcacgctctactccaccttctgcggcgccgccaactccctctcccagctctacgcgcaggccatggcccagcagaagctcaacttccatgccggcgagcgccacgccttagaaaagctctaccagtggatcttgaggaagcacgatgaagaggctaggctcactgtggctgaaataatgtctcatatccagcatgagatagactatgtaggtactgatgcacatgtctccccaagagtacctcagcatcctcagattgcaaatccattcgccaattca

SEQ ID NO: 77252 - DNA, 388 bp, Zea mays
  unsure at all n locations
  Clone ID: LIB3079-003-Q1-K1-B11
gcggggatgagctgaccagcctcaaggattatgtgaccaggatgaaggagggccagagcgacatcttctacatcactggtgagagcaagaaggctgtggagaactccccgttccttgagaagctgaagaagaggggctatgaggtgctgttcatggtggatgccattgacgagtattctattggacagctgaaggagtttgagggcaagaagctcgtctctgccaccaaggagggcctgaagctggacgagagtgaggatgagaagaagcgcaaggaggagctcaaggagaagtttgagggcctctngcaggtcatcaaggaggtgctgggcgacaggtggagaaggtggtggtctccgaccgcgtggtggactccccctgctgcctg

SEQ ID NO: 77253 - DNA, 375 bp, Zea mays
  Clone ID: LIB3079-003-Q1-K1-B12
gtgcccggcccggtccctctccactgcactgctctgcgcccatccatccttaaacccggctgcgcgcgtaggcctcgtcttgtccttccccagcacaacctctcctcctccttcgccaggtgcctcttcgttctcctctccgggctatcaggacgaaataactggccgcgctgcacgccggccgcctcgagaagaagcgctcgccccgcgcgcgcggctccgggctaccaggacgaaataactggccgcgctgcacgccggccgccgcgagaagaagcgctcgccccgcgcgctctgccgctggttcggccgtgccatcccgacgaggttcccccagctgtgcccgctcgatctccttccgcgcgcacgcgcacg

SEQ ID NO: 77254 - DNA, 463 bp, Zea mays
  Clone ID: LIB3079-003-Q1-K1-B2
caagatccgtgctgatatagagatgaaatgcttccagtttgatggagtgctccatattgagcgggctatgaagaaagctgaagctgcgggcaatgataactgtcctgtgaagattaagctagttgctcctccactttatgttttgaccacacagacccttgacaaggatcaaggcatttcagttctcactactgcagtcaaggcttgtacagcagagattgaaaagtacaaaggaaagttagtagtgaaggaaccaccaagagctgttagtgagcgggaagacaagctattcctcgaccagattgattccctaatggagcaaaacgcagaggtcgatggtgatgctgacagtgaagaggaggaagatacaggaatgggggacgtcgacattacaaattcttgcgtcgctgcttactaaggctacactggttgatttggatgagctttgctgtacagcaccagc

SEQ ID NO: 77255 - DNA, 459 bp, Zea mays
  Clone ID: LIB3079-003-Q1-K1-B3
gaaggatgtgccgaggccggtgacatacttctactctttctttcacctcatcttctccgtggccagcatgtactcggcaatgctcttgactggctggtcaacttcggttggtgagagcggaaagcttgtggatgttgggtggccatctgtctgggtcaggattgcaacccagtgggcgacggcaggtctgttcatatggtcgcttgttgcacccgtcctctttcccgacagggaattctaagttcaaccacggtaagcctggagcatcaaacgtgtctactgtggtagctaatatatcctatcaagtatgttgcctttaaaacatgctccgagtcggtgtttgcccactgttatcaagtttgtctacttaataacatgtgactttaggcattgtgccactatcttaacagtgaacgtgtgctgcttgtattgtgtatatactggagaatttaagaatgc

SEQ ID NO: 77256 - DNA, 296 bp, Zea mays
  Clone ID: LIB3079-003-Q1-K1-B6
aaaaaaaaaacaaaaaaataaaaaaattattttaaaaaaaaaaaaaaacaaaaaaaaagaaaggatattataaaaaaaaaaaaaaaaaaaaaaaaaaaaaaaaaaaaaaggacaaccaatctaaaaaacccaaccttaccctctcttactttcccaatcctaattccccttattttcccccctaaattcattccattgcccctccttatatatattcttaacttgaaaatcccctcctttacctctcttaatacctttccctcacttacttttttccccagttagcacattccctt

SEQ ID NO: 77257 - DNA, 399 bp, Zea mays
  Clone ID: LIB3079-003-Q1-K1-A2
atctgtgcctgacaatgccttgcctgaattccaccacactgattgtcggtgcgctgactgatgggaatcaggaacagaagaagatgtggagattgatgatgagaagaaatctgagactgctatgacaaatgaatgagcgttatgggcttggaatgataggatggcggatcagattcttttgctggtgagcaatgccactcaagcaggggcgccgtacaattttaacagcgctgctttgctattgaggagtctggttgttactgcatactcgggcacgcacgctcttttatcatctcacctcatcaccatcatcccacatggaccaatgtcgtctggcggctcctgattttggtctcttcgaactgtaatatctgcagtgaggtttttccatcagttttt

SEQ ID NO: 77258 - DNA, 391 bp, Zea mays
  Clone ID: LIB3079-002-Q1-K1-G6
tgcaagtttgtccattcgcattggtctgaatactgtagctactagcgcgagtgccgctgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctg

SEQ ID NO: 77259 - DNA, 383 bp, Zea mays
  unsure at all n locations
  Clone ID: LIB3079-002-Q1-K1-G8
gaccaattaactagcttcttctagctctagctaggctcgtctgctgcaagaaggtgacagcgcaggcatggaggggaaggaggaggacgtccgcctgggcgccaacaagttctcggagcgccagcccatcggcacggcggcgcaaggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctncaagtgcgccaccgtcggcatccagggcatcgcctggtccttcggcggcatgatcttcgccctcgtctact

SEQ ID NO: 77260 - DNA, 374 bp, Zea mays
  Clone ID: LIB3079-002-Q1-K1-G9
aaccaaataactaactaaatatataactataactaaactaaaatgaataaaagaaagggacaacacaagcatgagaaggaaaagaagaagacataacaactgagcgccaacaagttctcggaagcgccagcccatcggcacggcggcgcaaggcacggacgacaaggactacaaggagcccccgtcggagccgctcttcgagcccggcgagctcaagtcctgatccttctaccgcgccggcatcgccgagttcgtcgacaccttcctcttactctacatctccatactcaccgtcatgggcgtctccaagtccacctccaagttctccaccgtctgcatccaaggcatcggctgttccttcggcggcatgatct

SEQ ID NO: 77261 - DNA, 450 bp, Zea mays
  unsure at all n locations
  Clone ID: LIB3079-002-Q1-K1-H1
agccccaccagctctgctcagccaccaccatcctcctcttcctcgaacggtcgagcggccggaagcacgcaccccgccgccgcgtaccctcccctcacccgctttctatcgccggccgccgttctgcgcgacgcggattcgaatccggaaagcgggcgatgggggcgaagcgcgcggtgctggtgggcatcaattaccagggcaccaaagcggagctcaagggctgccacaacgacgtcgctcgcatgcgccggtgcctacgcgaccgcttcggattcgacgagtccggcatccgcgtgctcatagatgacggctccgcgccgcagcccacgggggccaacatccggcgggaactcgcgcgcctcgtcggggacgcgcggccccgtgacctnctctttttcactacagcgggcacggcatacggctgccccgcgagaccgggaatgacga

SEQ ID NO: 77262 - DNA, 358 bp, Zea mays
  Clone ID: LIB3079-002-Q1-K1-H10
cccacgcgtccgctcagaggtgggttggcttctcctcccccaccggttcgtgttcgggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgttga

SEQ ID NO: 77263 - DNA, 380 bp, Zea mays
  Clone ID: LIB3079-002-Q1-K1-H11
caccaccaccacaacaacaaacgcatgactctttcgagcaggaggcatatcgggtgaaatggaacaaatcaccaccaccacaccagcaatcgcaagactccttcgagccggaggcatatcgggtgaaatggaacaaatcaccaccaccacaccagcaatcgcaagactcctttgagccgaaggcatattgggtgggatggaagaaacatgcgcaaggagcaacggacgttgctgatgagacaacgccagcacgtggtcatggtctgcatgtcgcgaccgggatgctcttcacgaggaagagcttgcttccagggacagccctaccggaaggtaccaagttctgcggccacggcttcctcgatcccgagaggtttgaacta

SEQ ID NO: 77264 - DNA, 243 bp, Zea mays
  Clone ID: LIB3079-002-Q1-K1-H2
cccacgcgtccgaaaaaaaaaaaaaaaaaaaaaaaaaaaaaaaaaaaaaaaaaaaagaaaaggaaaaaaaaaaaaaaaaaaaaaaaaaaaaaaaaaaaaaaaaaaaaaaaaaaaaaaaaaaaaaaaaaaaaaaaaaaaaaaaacaaaaaataaaataaaataaaaaaaaaataaaaaaatgaaacaccataataaaaattattttaaacccaaaaaactcaattgctagaaattctaactggc

SEQ ID NO: 77265 - DNA, 442 bp, Zea mays
  unsure at all n locations
  Clone ID: LIB3079-002-Q1-K1-H4
gcaacatagaaagcacaatagtgtaccaacaatggcagccaaaatattttgcctcgttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaancacaactacca

SEQ ID NO: 77266 - DNA, 177 bp, Zea mays
  Clone ID: LIB3079-002-Q1-K1-H5
aaaaaaaaaaaaaaataaaaaaaaaaaaaataaaaaaaaaaaaaaaaaaaaagaaagaaaaaataaaaaaaaaaaaaaaaaaaaaaaaaaaaaaaaaaaaaaattaaaaaaaaaaaaaaaatttaaatttaaaaaatttttatttaatataaaaaaaaataaaaacaaaaaaataaa

SEQ ID NO: 77267 - DNA, 361 bp, Zea mays
  unsure at all n locations
  Clone ID: LIB3079-002-Q1-K1-H6
cgcaccgccgtgctgcttacagggaggtggcgctcgctgggaggcggcagcgcgaggctcgcaaggaggcaacgcgatacctgtaggcggcctcgttgagacgttgtccctatcgtggaggtcttcctctcgacccagcagccgtagcccagctgtagcccaactcagatctctgctgtaacgtcatccaataggctaaggagttccttggtgcttccggtgacaagcgaaaggaagtcatctgcagtatggaggaggcagataagctcagtggttctgctgcaaggctaaggagttccttggtgcttccggtgattctctntctgttgtaaagcagctatcctgcgagtgcctctacaca

SEQ ID NO: 77268 - DNA, 398 bp, Zea mays
  Clone ID: LIB3079-002-Q1-K1-H8
ctcctcgccagtcgcctcgtctctccctgccgcgtcgcctccagttccgcctccggcgcgcctcccgcctccgccgcgcctgacgaacgcagtataggactgtgcaggtagagaggaggagggtccggcgagatggggatgcgagataagaagcggaaccagaagcgagtgctcgcgcgccgtaccgcggcaccgcgcccaggcgagggcaaggatttcctgccgctggaaggaggccccggtaagaagcatctgaaggtgcagcagcctgaagagcccgaaaacacagccacaatcgtctacattgggcatatcccccatggtttctacgaggacgagatgaaagggttctttaagcagtttggggatattaagagggctaggatcgctcgtaaccg

SEQ ID NO: 77269 - DNA, 376 bp, Zea mays
  Clone ID: LIB3079-002-Q1-K1-H9
cccacgcgtccgggcacataaccgtgctctagttgaggagcgtgaactgttaagcggggaaatacaagctggaaaagatgaggtccgccacttgaatgtgatcattgctgacattaacactgagaaagaagcttatatcagtaagcttatggacaagaggaggaagcttgaagctgaacttggagcaagtgagcacttgtgtgatgaggtcaggcatcttcgtggtgaaattgacaagctcgttaccgctcggaaagaactatctgcagaggctgcatctctcgtggaagagctgaacagggagcaatctgttaaacagcagctacctgtgctgaaaacagaaattgatggtcttgcacaggaacttgttcacgtg

SEQ ID NO: 77270 - DNA, 378 bp, Zea mays
  Clone ID: LIB3079-003-Q1-K1-A10
cccacgcgtccgtctcactctcagctggtcgctcactcttgcagctccacccttcacgcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgaggctgctgctcctgctgatcccgaggagcttcccgcggccgagcagcaggcagccgccgagcccgaggccgctgctcctgctggtgccgaggagcccgcggcggccgatc

SEQ ID NO: 77271 - DNA, 388 bp, Zea mays
  Clone ID: LIB3079-003-Q1-K1-A11
gctttgactgcctgccatgttgctagccaagttcatatatcttccaaacctgttttggttttgacacggataaagactggtggttttgagtgggtttcgccagatgaaactgatagagctccatacagtgctgtggaggttgcagtgttatcagaatctcatgacctttgtattaatggggactgttttgaaatgctacaaagtactgaggctgttctccaggttatcccttatgtgaaggttttttcacgtgttgctccagaacaaaaagaacttgtactaactacattcaaaagtgttgggagggtgacactgatgtgtggagatggaaccaatgatgttggtgcactgaagcaggcacatgtcggcgttgctcttttgaatgctg

SEQ ID NO: 77272 - DNA, 381 bp, Zea mays
  Clone ID: LIB3079-003-Q1-K1-A12
gggtccacttcaagaacacaagggagacagcttttgcgcttcgcaagctgcctttgggcaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaagttcatattggatttgctgaagaatgctgagagtaacgctgatgtgaaaagcttggacgtggacaacctctatgtttcacacatccaggtgaaccaagcccagaagcagaggcgccgcacctaccgtgctcacagacgcattaacccttacatgtgctgcccttgccacattgagctga

SEQ ID NO: 77273 - DNA, 442 bp, Zea mays
  Clone ID: LIB3079-002-Q1-K1-G5
aaccccccttgtcgtcgcttcggttcaagcgaggaagagagagagagcgagagtggtacaaggggcgccggcggccgcattgtagagtacgtcgagcttgttcactgccgtcgcggcctcaaagcaagccacatcatcgatggcggacgcagctcacgtcttcctgctggtagcggtggccgccgcgctcgccggccgctcagacggcgcgtggtgcgtgtgccgtccggagctggcagacagcgcgctgcaaaaggcgctggactacgcgtgcggcgccggcgccgactgcaagcccatcctgcagagcggcgcctgcttcgccccggacaccgtcaaggcccactgctcctacgccgtcaacagcttctaccagcgcaacagccagaacccgcatgcctgcgtcttctccggcaccgtcacgctcagcaacagcgacccg

SEQ ID NO: 77274 - DNA, 392 bp, Zea mays
  Clone ID: LIB3079-002-Q1-K1-F11
gccaagtcgaccgcgatgtttgtagccgccctggccctggtggtggtgatggcgaggacgagcacaggcggtggcagggcggcagcggcgtgcgatcccaagccgctggtggtgtgcgatccggcgttcatggacggagcgaaacccgcggcagcatgctgctccaccctgcgtgcgcaggaggcatgcttgtgcgtgtacgccaaagaccccaagtttgcaaaatacatcaacaaccccaacaccgccaaaacctttacctcgtgcggcatagccatccccaaatgctaagcaagcgctctgcgtcgtcgcttcgcttgctcttgctcttgggtgtaacatatccagcttatgaataaattatgtggatcagttaattagtgggatgaaaa

SEQ ID NO: 77275 - DNA, 358 bp, Zea mays
  Clone ID: LIB3079-002-Q1-K1-F12
ctttatgatcaattcctttttatcagggtttcgagagtgaggttgctgaggctgcaaatgaagaacagaaaaccgagagcctgatgaggctctcctgggcgcttgttcactctagacagcctgaagatgtcaaccggggcatcggaatgcttgaagcttcattggacaggtctagcagcccagaggaaacaagggagaagctctacttgttagctgttggtcgttacagaactggggattatacaagaagccgacagcttttggaaagatgcttagagatccaacatgactggagacaagccataactttgcaaaggctcgttgaagaaaaaaccaaaagagatggtatgaatggcat

SEQ ID NO: 77276 - DNA, 396 bp, Zea mays
  Clone ID: LIB3079-002-Q1-K1-F2
gtgaccgggatacaaacggcacaggctgacgtggaggtgagcttcgaggtgtcgggggcggccctggccggtgccgagacgctggacccggcgctggcctacgacgcggagaagctgtgcggcgtgaagcgcgcggacgtgaggggcggcgtggggccgttcgggctgtgggtgctggcctccgccaaccgcaaggagagaaccgccgtgttcttcagggtgttcaagcccgccgccggcagcgacaagcccgtggtgctcatgtgcaccgaccctaccaagtcgtccctgaacccgaacctgtaccgtccgacatttgcaggatttgtcgacacggacatctcgaacggcaggatatccctgagaagcctgatcgaccggtctgtcgttgagagc

SEQ ID NO: 77277 - DNA, 455 bp, Zea mays
  unsure at all n locations
  Clone ID: LIB3079-002-Q1-K1-F3
caaacacgtatgtggaaggtgggtgaaagggtccgttcaaccaggccacaaggtggtcttggcccactgcatcccttcactgctggagtgtatgttgcactaatgatggctcagattgaggtccttaggaagaagggccactcttactcagagataattaatgagagcctgatcgagtccgtggactcgttgaacccgttcatgcatgctcgcggtgtggccttcatggtcgataactgctccacaactgctcgtttgggatctaggaagtgggcaccacgcttcgattacatcttgacccaacaggcgtttgtgactgttgacaagaaagcaccgatcaaccaagacctcatcagcaacttcatgtctgaccctgtccacggtgccatcgaagtctgcgctcagctgaggcccactgttgacatctcagtgaccgctgatgctgatntcgtgcg

SEQ ID NO: 77278 - DNA, 444 bp, Zea mays
  Clone ID: LIB3079-002-Q1-K1-F4
gaatgtttatttgaacaagtacagaattgagcttgaccctcagcttgaagccctcgttggaaggcatagcaggaaaccctggttaaagtttatgaacgcagataaccagcacctagtgtctcctgaggccatagatttccttgacaagcttttgcgttatgatcatcaggagaggcttactgcacttgaagctatgacgcacccgtacttccaacaagtgagagccgctgagaacagcaggacgcgagcgtgacaggcaaagagcgaagaccatctgctcttttatcagtcagtcaggttgtatgagatgagtagccgttgggtcacttggcagaaaataaacaatagcggtagagcctgtactgtacgtaacgtaacctcctcgaggagttgtgaggtttgggacgtgattgcgaacatggtatattaatgattgttcatgta

SEQ ID NO: 77279 - DNA, 455 bp, Zea mays
  unsure at all n locations
  Clone ID: LIB3079-002-Q1-K1-F5
cgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgncacctgagggccgtcttcctgatgccaccaagggttctgaccacctgaggcaagtctttggcaagcagantggtttgagtgat

SEQ ID NO: 77280 - DNA, 389 bp, Zea mays
  Clone ID: LIB3079-002-Q1-K1-F6
gcctggcctggcctgggtttggacgtatgtgcatgatgcattcattgcgttgcgttcaactgtggtcaacaagggagggagacagatgcagatgcagtgtgagatgtttgcatggaggcccctatagaaacaagtgaaatgtttaggcgcccttgtgcacatgctggtcgcattccttgcaagaataccaggggtggggccagaatggcatgagctgggtgttcctttctaactcttcttcttcttcttctcctcttcttctttatttacatttttcttttatgtgttttcgtctaattaaagttctggttttgtagttctaccgtgcaactcattgtaccggaaaagaatatatgaacaggaaatcccatatgatctttgccatcttt

SEQ ID NO: 77281 - DNA, 410 bp, Zea mays
  unsure at all n locations
  Clone ID: LIB3079-002-Q1-K1-F7
cagacattgcgactttgcgagagacaaaacctcccagataacgcccgcgcgctccccgatggcgtcgtcgtgccagaacgtggagattcccggcaagccgacggagacggggacggcgctgctggagacggcgacgggcaccatccaggggttcgcgccgctgagccagatccaccagcacctgtgcgcgttccacttctacgcggacgacatggggcggcaggtggaggcgcaccacttctgcgcgcacctgaacgaagacgtgcggcagtgcctcatcttcgacgggcccggcgccggcgcgcgcctcatcggcgtggagtacatcgtctncgagacggtgttcctgacgcttgccgacgccgagaagccggttgtgcacacgcacgagttcgaggtgaaaggcgggt

SEQ ID NO: 77282 - DNA, 354 bp, Zea mays
  Clone ID: LIB3079-002-Q1-K1-F8
cccacgcgtccggcctccgatccgagcagccgcctacagtcaacccattcaacctgaaatgttccttgtgaggtatcatgacagaacagcaggaaggtgttagcaagagctcttcctcaagtattagcagcagcactcaggagagtgaggaggaactgaccatcggtacccttataaccgaagcaacaaacacaacaaacagtgccaagagtcttggaaagcgcctttcacacttagattcgatcccgcacactccacgtgttaatgggaaaattccagattttaataatgcgacaattgatcatgaatcattattagaaagattaagcacttatggcttagctgaatatcaaa

SEQ ID NO: 77283 - DNA, 420 bp, Zea mays
  Clone ID: LIB3079-002-Q1-K1-F9
acaaattgtatctgctactacttgatatggcttttgatggacaagaaatgatgcgaagaattttgggcagctatagtctgcaaagtctagaaaaagtttcaattgggctgggactacaggcgctgagagtacacatgtcagatgatacaactcatctattcatcacaaggacttccaaggaagcgcaagatgtactttggctcttgagcgtaactaacttgcccaaattaaaccacaagatacattttcaaagttgggagaacatccaagtcaaattgttcgagaaatgtattatacgcagaactgcatatacgggaatatgtctctactctatgttgatgttctggaggaatgacgttgaagaagactcccgttttattagatccatctttgtcattgaatgctccatattggtgtgca

SEQ ID NO: 77284 - DNA, 429 bp, Zea mays
  unsure at all n locations
  Clone ID: LIB3079-002-Q1-K1-G1
ggaggcccctgcccaaggcaagagaaaccgcggcgcgcggagagggaggaagggcagacgcagacgggcgaacaagatgagggagatcatcagcatccacatcggccaggccgggatccaggtcggcaacgcctgctgggagctctactgcctcgagcacggcatcgagcacgatggcaccatgcccagtgattcctcggttggcgtcgcacatgatgccttcaacacgttcttcagcgagactggttccggcaagcatgtgcccagggccatcttcgtcgaccttgagcccactgtcatcgacgaggttcgcactggctcgtaccgncagctctttcacccagagcagctcatctcggggaaggaggacgcagctaacaactttgcccgtggccactacacggttgggaaggagattgtcgatctatg

SEQ ID NO: 77285 - DNA, 382 bp, Zea mays
  Clone ID: LIB3079-002-Q1-K1-G11
cacacctcacagagctgcagcagcatcagctgccacctcctgcctctcctccttcgttcctgcctgcataggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagtttgacaaggagattgaggacaagaagacagagctggagcccaaggtcgtggaggcctacgaagcatctcctcctgaggtcaaggctctcttcaaggataagaagccagtcaaggtcagcaagaagaactcggctgcagtcaccaagttcctcgatgagctggc

SEQ ID NO: 77286 - DNA, 369 bp, Zea mays
  Clone ID: LIB3079-002-Q1-K1-G12
cggacgcgtgggttggggtacaagtcatgtcaatgagagtatggtaactggtgaaggtgtaccaatctccaaggaagtatccagtctagtcattggaggcacaatgaacttgcatggtgttcttcatatacaagcgacgaaagtaggatctggaacagttttgagccagataatttctctcgtggaaaccgcccagatgtctaaggcccctattcagaagtttgctgattatgtagccagcatttttgttcctattgtcatcaccctgtccttcttgacattccttgcatggtttctatgtggatggttgggagcatatccaaactcatggtctgctgaaagtagcaattggctttgtttcttcctaat

SEQ ID NO: 77287 - DNA, 423 bp, Zea mays
  Clone ID: LIB3079-002-Q1-K1-G2
cccacgcgtccgggacatcttttcgcattaaagaagctttttgaaagctcatctagcataggatgtgaggcgtacaaccttggaaccggaaaaggaacatcagtgttggagatagtcaatgcatttgagaaggcttctggaaagaaaatccctttggtcatgggtcaacggcgtcctggtgatgctgaggttcttttttcatcgccggcaaaagcggagagagagctgcactggaaagcaaaatatggcatcacagaaatgtgcagagacctgtggaactgggctagcaagagcccttatggatacgcggcatctgagtctcccaagctgaatggcagttcacgctgagcaacacgattggtccttgtggactcacttgtacatgagacagtagtgcctaccaggataaatgtagatctagta

SEQ ID NO: 77288 - DNA, 461 bp, Zea mays
  Clone ID: LIB3079-002-Q1-K1-G3
catgtcaagcatggccacggggcaaacagggacaccatgatgatcctgcagaacagcagctacgacgcgtccgggtcgttcatggtctactcctctctcgacaagcatctggtggagacaattacgaacccgggtgacagccaggcgatgagcagcatcaacctcttccccgccggcttctccctcgtccccctcaccaacccggacccggcgccgcaagagggctccggcagcatcgcacagcctggggcgaccgtgatgactgccgggttccagattctgatgaagatggcccgtgggaccggcctttgccctcgctcggtgtcgtccgcggtcaagatcatgtcagacaacatcaccaacatcaaagacgctctgttgaaaagccaccctgttttctacaagagcattcagtctgtcgactgaatagcggcaagggagaaagggaggtcgtccaatgc

SEQ ID NO: 77289 - DNA, 114 bp, Zea mays
  Clone ID: LIB3079-002-Q1-K1-G4
gtataactactactactacgaggctagctgcgcgctgaacacagcgctgtaaaggagtgttggtgtgctaaattcagaatgtgtaagtttaatttatgttattaccagttaacc

SEQ ID NO: 77290 - DNA, 410 bp, Zea mays
  unsure at all n locations
  Clone ID: LIB3079-002-Q1-K1-D11
gcgcggaccgtccgggccagcggcggctgatcctatttttagaagcgaattaccgagacctgcacccaagccaccacatgccatacaaaccctagataacccattcggaccgtctgcgtatgacgccagacatcccgaatataatgtcggacggtccggccacatggccggacagtccgcgcatggagtcggacggtccgcgtatttaccggacggtccggcacagagttttttaaggaagatggatatctaactccgtattcgtcccagctagactccccatctcaccatacgacancacagcatcataatataatctatcaaacctgtgagagtgagaacctttcggnccctagaaagccagaaaggatggccagtcctatgagcctcatanggcatgcattaacgcg

SEQ ID NO: 77291 - DNA, 367 bp, Zea mays
  Clone ID: LIB3079-002-Q1-K1-D12
cccacgcgtccgcttcagatctcaagaagatggctcttcctccttgccacatgtgggcacaatttaatgtggagaacgggaagctatcctgccagatgtatcaacgttttgaaaacatggggctgggggttccattcaacatggaataatatcctcttttgacatatataatggctcaagtttgagatctttctccaggagattttgtccatgttataggggatgctcatgtctatagaaatcacgttcgagctctggaggaacagattcagaagatgcctaaaccatttccaattttgaagataaatccttcgaaaaaggatatagattctttcatggcgtcagacttcaagctggttggctatga

SEQ ID NO: 77292 - DNA, 173 bp, Zea mays
  Clone ID: LIB3079-002-Q1-K1-D2
atcatatcctatattgaagacaggaactctggcatcacaacccagacattgttgagaccatgcttgggcatctgcaaacaatcgtaaagaatagctctgaatctaacactgatgaaattcccaagattaatgttcctacaaacccaaaaggtgctgaaagacttccaccaggc

SEQ ID NO: 77293 - DNA, 393 bp, Zea mays
  Clone ID: LIB3079-002-Q1-K1-D3
atcgaggtctcagcttcaggaaagggaaggaagcatgttcgggcaccaccaccacgacgggcacggcgggcaccaccaggccccgccgccgcacgagcagacgctgttcaggatcttctgccgcgccgacgaggcgtactgcctcaccgtgcgccacgacgccgtcgtcctcgcgcccaccaacccccgcgacgagtaccagcactggtacaaggacatgaggcacagcacgaaggtgaaggacgcggagggccagccggcgttcgcgctcatcaacagggccaccggcctcgccatcaagcactcgctcggccagtcccatcccgtgaagctggtgccctacaacgcggagtacctggacgagtcggtgctgtggacggagagccacgacgt

SEQ ID NO: 77294 - DNA, 88 bp, Zea mays
  Clone ID: LIB3079-002-Q1-K1-D4
aaaaaaaaaaaatattaataaaaaatttaaaaaaaaaaaaaaatggtctcccctataggaaagggttaaatttttgggggggctatac

SEQ ID NO: 77295 - DNA, 164 bp, Zea mays
  Clone ID: LIB3079-002-Q1-K1-D6
cgcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggca

SEQ ID NO: 77296 - DNA, 62 bp, Zea mays
  Clone ID: LIB3079-002-Q1-K1-D7
aaaaaaaaaaaaaaaaaaaataaaataaaaaaaaaaaaaaaaaaaaaaaaagggggggccaa

SEQ ID NO: 77297 - DNA, 292 bp, Zea mays
  unsure at all n locations
  Clone ID: LIB3079-002-Q1-K1-D8
cccacgcgtccggtggttattgaaactttctcaaattcctgagatcactgaggtgcctcagttcagcaaggaagcccaagccttcttgattgctattattgagaatttttgcattgatgatgcaaaagaaataaagaaaatcgagaaagtaaccaaccatgatgtgaaagccgtcgagtactttctgaagcaaaggtgcagctccaatccagagattgctaaagtgtcngagttcttccattttggctgtaactttgaagatatcaacaatttgtcacatgcattggctctt

SEQ ID NO: 77298 - DNA, 400 bp, Zea mays
  unsure at all n locations
  Clone ID: LIB3079-002-Q1-K1-D9
cccacgcgtccggtggttattgaaactttctcaaattcctgagatcactgggattgctcanttcaacaaggaggcccaagccttcttgattgctattattgagaatttttgcattgatgatgcaaaagaaataaagaaaatcgagaaagtaaccaaccatgatgtgaaagccgtcgagtactttctgaagcaaaggtgcagctccaatccagagattgctaaggtgtcggagttcttccattttggctgtacctcttaagatatcaacaatttgtcacatgcattggctctcaaagagggggtaaatagagttatgttccctgccatgattgacatatgcacagcattatgttccttggcgacacataattcaggctaccctatgttggctcgaacttat

SEQ ID NO: 77299 - DNA, 344 bp, Zea mays
  Clone ID: LIB3079-002-Q1-K1-E1
cctacggtgatggcactcctgattcagctgggaagtaggtttccaccggatgtatggtacgtacctttggccattgtctcttgatcggtccagtgttacgtcactactgtagagaagagaacggttttggtccttgaggcgccccgtgtactggtgttgtcgctgtagaattgttacttaaacagtatggtgatgattaatctcagcattttttttcttgcagcaaaaaaaaaaaaaaaaaaaaacaagatgaaatatattattttgtaattatgaccaggtgtactgtgctatacattaaaagtatatatttgtgaaaaaaaaaaaggggcggccgttttaaa

SEQ ID NO: 77300 - DNA, 355 bp, Zea mays
  Clone ID: LIB3079-002-Q1-K1-E10
cttgaagaatattttctagcagaatatgaattgagagggcagaaagttcaatttgagaaggatcagtgcaatcgtgaaacatcatcttcaggtacttcaggcagaaaaggaagcactagggcactgcatgctgaagacccgtcaaatattcacattggagtaggatgcgactcatgtggggtatatccgatacgtggtaagagatacaaatgccaggactgcactgagttaataggctttgacctttgcgaagcctgctacaactccagttcaaagctcccaggacgctttaaccagcggcacacccctaatcacagaatggaagttgacaattcagcactcgtgcataagatac

SEQ ID NO: 77301 - DNA, 399 bp, Zea mays
  unsure at all n locations
  Clone ID: LIB3079-002-Q1-K1-E11
gccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacggacgacgacctcgacgagctccgcggctgcatcgacctgggcttcggcttcgagccggcgcacgccgncgcgtgcgcgtgcgcctgcgcctgcgccgggaggaaccgnctnctggagaccgctgccgcgctcgacctctactacgccgtccacggcgggg

SEQ ID NO: 77302 - DNA, 355 bp, Zea mays
  Clone ID: LIB3079-002-Q1-K1-E12
cttactgagtgaccaggtcgtgggttcaaagcatttatctcttctctagaccccagtcatgtgggaatctccgatactagaaggttatagacaccatgaatacccctgaccaagtgtcaatgttagtgtccgccttaaatactggaatgatgtgtttaatgactgattcttatgggaatcatgttgtggaccactgcctgcagaaattgttacctgagcacaaggcattcattcttgaggctgctgcatcatgctatcttcaactagcaagagatcgtcatggttgctgtgtcctccagaaatgtattggtcattcaagtgatgaacagagaaacaacttggtgtgcaagataac

SEQ ID NO: 77303 - DNA, 455 bp, Zea mays
  Clone ID: LIB3079-002-Q1-K1-E3
cccacgcgtccgcgttggtcttgccgctgcagaaggtgcaaggattgctggagcgtgaaggatcattggtgtcgacctgaaccccagcagattcgaagaagctaggaagttcggttgcactgaatttgtgaacccaaaagaccacatcaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcg

SEQ ID NO: 77304 - DNA, 439 bp, Zea mays
  Clone ID: LIB3079-002-Q1-K1-E4
cccacgcgtccgtttttttttttttttttagtccaaactccaaacaggagtccaagttataatcatgctctgttcaaacagtttagctggaacccatcccaaggtcatccatccaaataaatgtataaaggaatgaaagtgcaccatatatgataactcaaaaataataatacagtaataacaagatggtcacttcttttgttgcagacatagataagggaatatgatcaaaacaaattgctatggcatcatcaatgatggaaggcctccgaaatttgaggtttctagattatgggtatgacatcttttgcatggtatcatcttctagatcttaagactgatccaaatgtaaatgaaagaaaaggattagtcggggcggaaactgacgtatgaactcaagtttacaagatcctgctgctgctctgctgatgccactaca

SEQ ID NO: 77305 - DNA, 230 bp, Zea mays
  Clone ID: LIB3079-002-Q1-K1-E5
ccggagaacgatggctgtatcaatgctgttttgctagtgtagagccatagtgagattttgttgatggtggtgaatcgtcccatttgtatctgctccgatatgctattttttgaccatgtcatggctaatcccagtagtttgttgtgcaccatgggcataatgagcattctgtattcacgctgtgtgctacaaacatatatggagtaatataaattagcagtattttcttt

SEQ ID NO: 77306 - DNA, 71 bp, Zea mays
  Clone ID: LIB3079-002-Q1-K1-E6
aaaaaaaaaaaaaaaaaaaaaaaaataaaaaaaaaaaaaaaaaaaaaagagggaaggcgcaagcggaacga

SEQ ID NO: 77307 - DNA, 456 bp, Zea mays
  unsure at all n locations
  Clone ID: LIB3079-002-Q1-K1-E7
ctgatttgtttaccccccgaaatttgccgtctcctcgtctcgctcctctccctgcgcagcccccagatccggcaccgcccgctcctcgatccccgcaccccacgcccgcaggccgggaccggcggggtcgcgcgccgggtaggaggaggagaagaggaagggtggtatggcggcgccgccggcgagggccagggccgactacgactaccttatcaagctgctcctcattggagacagcggtgttggcaagagttgcctcctggtgcggttctctgatggttccttcactacaagctntattaccacaattggtattgactntaagatacgaacgatagaattggatggcaagcgtataaagctacagatttgggatacggcgggccaagaacgcttncgggactataccaccgcgtactaccgaggagctatgggcatctngctgggttatgatgt

SEQ ID NO: 77308 - DNA, 414 bp, Zea mays
  unsure at all n locations
  Clone ID: LIB3079-002-Q1-K1-D10
ggcaggtgaaagcatgggctgagcttttgaatgctttttgcacgagtggcagacgcgaactggaacttatatacaaagtacagacacagtgctatgaggatgctaagctgatgaagctgtttcctgaaatcataagaacactgtatgaccaagatgtcctagctgaagatactgtcctgctttggttccgtaaaggttcaaaccagaagggcaggcaatctttcgtgaaagctctggagccgtttgtcaaatggctcgaggaggctgaggaggaagaataagtttttgatttggagaacggccgaatgctggcctaagtgttactttatatttctgaagttagaagtttgtggaggaattattgctgctgcctcttactgccgagaactttatngtatgatgttagccacatgg

SEQ ID NO: 77309 - DNA, 457 bp, Zea mays
  unsure at all n locations
  Clone ID: LIB3079-002-Q1-K1-F1
cagatccaggattgccgggctccttgactcgttacctcgcgcgccctcggtgagcgactttgtttcgatttagcgacaaatcagtttgcttcatgttgcgcaggcttagatctgaatgccggattcttcgtcttacggcttgaatcgagctgggaggctgtggatctgagcacgggaggtacaacaaatccgcgtgtatgacgagttggatcggcaccggttagtctctgaccgcaagattttgttgttgtgttgggctgatctgccgcgttgttttgcttcaggttctagagctagcgaaatcgcaaggctattagggttcctttcggagcgcgtctgaagcgatgatggctgaagtcggcggtgggatcgggatcttctctggcctgctccactcgggatgatgaatctgctgcgctgataattattggatgaatntcgataattattaggatct

SEQ ID NO: 77310 - DNA, 413 bp, Zea mays
  Clone ID: LIB3079-002-Q1-K1-B5
gtgagaacattccagcagaagaatcttttgatgtagcaagaaggattaaagaaatgtactgctatacttcttcggacattgtgaaggaattcaataaacatgacaaggagccatcaaagtacattaaacactggacgggcaccaaaccgaagactggtgcaaaatacacatgtgacattggatatgagcgattcctagggcctgagatcttcttcaacccagagatatataacaacgacttcaccactcctttgcaagttgttattgacaagtgcatccaatcatctccaatcgacacaaggagggctctttataagaatattgtcctgtctggaggctcgactatgttcaaagatttccataggaggttacagcgggacctaaagaagatagtggatgcacgggtccgtgca

SEQ ID NO: 77311 - DNA, 191 bp, Zea mays
  Clone ID: LIB3079-002-Q1-K1-B6
taaaaaaaaaaaaaaaaaaaaaaaaaaaaaaaaaaaaaaaaaaaaaaaaaaatgaaggtaataaaaaaattaaaaaaaaattcataaaaaaaaataaaaaaaaatataattttaactaaattaaattaacatacactaaattttacaacatataaaaatataaaaaccatttcttttcccaactttataaa

SEQ ID NO: 77312 - DNA, 449 bp, Zea mays
  Clone ID: LIB3079-002-Q1-K1-B7
cccacgcgtccggcggcctccgccgctgccctacgccaggatcccaggctgcatggtccgtacgccaggaggagggcctcgccgcaggttgggtgggaggcggagatgagccgggggcggtcgccggagccgctggatttcttcatctggactgtgcaggatgtagggttatggttggaggaaataaatcttggaagctaccgccaggcttttgaagaaaatggtgtcaatggagagtatctagaaagcctgtcggtgttcaccactgagcagattcttcgctttataagacgatgccatatgaaatggggagattttatcaccctctgtaaagagttgagacgcatcaaagttgcctgcctgaaaggggagcaggaggtccgcaggccgtggtgggcgccgtcatgcctgtcggtcgtgttcacgcgggttgccaggcacaaccggca

SEQ ID NO: 77313 - DNA, 380 bp, Zea mays
  Clone ID: LIB3079-002-Q1-K1-B8
ccagaagtcacgcaccaaacaccaccaccaaagaaggcgagaacgtactccgtccgtcccctcccctcgcctccccttcccctcgaggctccaggaccgtctcctcgcctgctcatccgccgctgcttcccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaaattgggcctttgggataccgctgggcaggaagattacaa

SEQ ID NO: 77314 - DNA, 419 bp, Zea mays
  unsure at all n locations
  Clone ID: LIB3079-002-Q1-K1-B9
cgaaccccgtcgaccgggttcgtgtggctgcggcaggccgccggcctgacccacaccttcggctccatcggcaagcaggtgtggtacgacagggaggtgacggcgttcgtggagcccgggcggatgcacggcctcgccggggtgaagagcaaggagctcctcatctgggtcaccatctccgagatcgtcctcagcccctccggcaccaagatcgtgttccgcacccccgcggggctcggccgcgccttccctgtcaccgccttccagctcgagcccgcggcggcggagggggaccacaaggaggaggccgaggacgccgtcgccgtcgncggcaactgatttgctctagcttccggcggcggcggccgtgcgtgggctgctcgatccggtagtggcagtggctttgtgagacagtcgag

SEQ ID NO: 77315 - DNA, 214 bp, Zea mays
  Clone ID: LIB3079-002-Q1-K1-C1
cggaccagcagcggctgatcttcgccggcaagcagctggaggatggtcgcaccttggctgactacaacatccagaaggagagcaccctccacttggtgctccgcctaaggggtggcatgcaaatctttgggaaaccattgactggcagaaccataactttgaaggtgaagtctcttgcaccattcattatggccaaagccagaatccagaccag

SEQ ID NO: 77316 - DNA, 380 bp, Zea mays
  unsure at all n locations
  Clone ID: LIB3079-002-Q1-K1-C10
gcatggctcaacctaattatgtgcattcttctcaatcctctcaattcacgagctgggttcaaccgaattctgtacctcctgctgagtcctcgcagtttggaagcaaagcccaatctagttctgcaccccttgctaaaacctctcagttcaagggcatggctggaccaaattctgtacctcctgctgagccctctcagtttgggagcatgattagacctaatttggtacctcccgcatcttctcagtttttggggagcatggttcgaccaaattctgtaactccagaatcctcacagtttggaagcatgaccagaccaaactctgtacctnctgtatcgtcacagtttgttaacatgcccagtcaaaattttgtgagcgca

SEQ ID NO: 77317 - DNA, 366 bp, Zea mays
  Clone ID: LIB3079-002-Q1-K1-C12
cccacgcgtccgcccacgcgtccggcaggagaagccttgggccaacgacgcgcacgacttccgccgcaccaagatctccgcgctcgcgctgctcaagatggttgtccacgcccgcgccgggggcaccatcgaggtcatggggctcatgcagggcaagtgcgagggcgacgccatcatcgttatggacgcattcgcgctccccgttgagggcaccgagaccagggtcaatgcccaggccgatgcctacgagtacatggttgactactcaaccatcaacaagcaggctggaaggttggagaatgtggttggctggtatcactcgcaccctggctatggatgctggctgtcaagaatcgacgtgtcaac

SEQ ID NO: 77318 - DNA, 335 bp, Zea mays
  Clone ID: LIB3079-002-Q1-K1-C2
aaaaaaaaaaaataaaaaaaaaaaattaaataaaaaaaaaaaaaaaaaaaaaaaaaggaagggtaaaaaaaaaaaaaaaaaaaaaaaaaaaaaaaaaaaaaaaaaaaaaaaaaaaaaaaaaaaaaaaaaaaaaaaaaaaaggggcgccccttttaaagaacccaactttacttccccttcatttcaaaataaaagcttttttaaagggcccccaaatttaaattaattgccctttttttaaaaacttcgaaattggaaaaaccttggttttccccaatttaatccctttggaaaaaatcccccttttccaaattggcttaattacaaaaagcccc

SEQ ID NO: 77319 - DNA, 370 bp, Zea mays
  Clone ID: LIB3079-002-Q1-K1-C3
cccacgcgtgcgcgttgacgcgcacgacgacgagtgcaaggacatcggcgtcgtggcggacgacgaggcctagaagtcctcctccgtcgcgcctagcgctgccgccggcgatccgacgatggcctcctccgagggcgccgtggaagcgaaggagccgttccagagccctgatgacgccaaggccaccggcgacgacggcggcaagtttgctgcccagcagcaggaggaggacgagggggaggacgaggaggaagatgccggcaaggaaaacgacgacgaccacaaggcggcgcgtgcgccgcagtgcgtggtgttcatcgtggggaagctgaacgtgaaccggatctgcgcgctgtgctcgttcggcgtc

SEQ ID NO: 77320 - DNA, 454 bp, Zea mays
  unsure at all n locations
  Clone ID: LIB3079-002-Q1-K1-C4
gctggagcaggatcagcaactctttcaatggcctatgcagctgccaaatttgcagatgcttgcctgagaggattgcgtggtgatgctgggataatagagtgctcttatgtggcttctcaggtcacagagttgcctttctttgcatccaaagtgcggctagggcgatgtggcattgaggagatcctaccacttggaccattaaatgagttcgagaggtctgtattccatactcgaacttacaactactcaggttcttgttgtgaattgaaagtcgcatgctctgcattattcaacggccatttcacacatgctttccgtcgagttatatatctcagcaaattagtttgttcagctacttttcgtctacaacaacaggttcatcttgcccactcatctgacccaccatgatttggatccgncaggtngtagtagttattaggctatggtcaacata

SEQ ID NO: 77321 - DNA, 462 bp, Zea mays
  Clone ID: LIB3079-002-Q1-K1-C5
gaaggagagcagcccggaggagggggagcaagcagcagccgtccgtggaagaagaggtcgtacctgctgccgcatctgcactcggggtgggcggtggaccaggccatcctcgccgaggaggagcgcctcgtcatcatccgcttcggccatgactgggacgagacctgcatgcagatggatgaagtgctggcagcagtagctgagaccataaagaactttgcggtcatctaccttgttgacatcacagaggtccctgatttcaacaccatgtatgagctgtacgacccttcgacagtgatgttcttcttccggaacaagcacatcatgattgatctcgggactggaaacaacaacaagatcaactgggccctgaaagacaagcaagagttcatcgacattgtggagaccgtatacaggggcgcccggaaaggccgtagtctggtgattggctccaaggactac

SEQ ID NO: 77322 - DNA, 461 bp, Zea mays
  unsure at all n locations
  Clone ID: LIB3079-002-Q1-K1-C7
cccacgcgtccgccaagaccggcgtcttcggcccggcggcggtggaccccgagctggccgctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcgggagagcctggcagtggcaggcactctgctcgtgctcggccgggctgggctccctgcttatatcactgcaatattatactactagtagtggtgcttgatagcagtgtgtggctgtgctaataccagtataatactggttctactataatacagtcgtatcaggcatggcgtgcatcangactggttgtgatagtagcaacgtgatgctcgtgccttgtataagaacaagcaggc

SEQ ID NO: 77323 - DNA, 295 bp, Zea mays
  Clone ID: LIB3079-002-Q1-K1-C8
cacaaaaacacaggtagggttaggcgacgcggcggcgagagcgcgagagtaggaggaggcgtcggccatgacggggaaggcgaagccgaagaagcacacggcgaaggagatcgccgcgaagatcgacgcggcgacgacgaaccggggcggcggcaaggtcgggcaggcggatcggctagggcaggacaagggcgggcacgcgaagctggcgtgcccgctctgccgcaccccggcgcccgacatcaagtccatgcagatccaccacgaggcgcgccatcccaagctccctttcgag

SEQ ID NO: 77324 - DNA, 197 bp, Zea mays
  Clone ID: LIB3079-002-Q1-K1-C9
gctactgaataaaacactcttggttctccctttaaaaaaaaaaaaaaaagaaaaagaaaaaaaaaaaaaaaaaaaaaaaaaaaaaaaaaaaaaaaaaaaaaaaaaaaaaaaaaaaaaaaaaaaaaaagaaaaaaataaaacaaaaaaaaaaaaaaagaaaagaaaaacaaacaagaatcggctagagcaaaacaagg

SEQ ID NO: 77325 - DNA, 415 bp, Zea mays
  Clone ID: LIB3079-002-Q1-K1-D1
gtcattttcacaccttgatctggataatgatgggctcttatcagcagatgagctggagcctgtaattggtaatctccatccatcagaatacttctatgccaagcaacaagccgactatgtaatatctcaggctgacacgaacaaagatggacaattgagcatgaatgagatgatcgagaacccctatgtcttttacaatgctttattcacagaagatgattatggctttcatgacgagctccgttagttcccaattcaacagcacaaagctttatggaatcaccactgtaggaagtcggaagactttgttatgcactgctaagaccatttccgttttctgtctgaaatcatccatcatttgacggtgattccatgtaaaacaagcatgtttttagatgcacctattctagaagct

SEQ ID NO: 77326 - DNA, 292 bp, Zea mays
  Clone ID: LIB3079-002-Q1-K1-B4
cctcgaaggagtagactctggtcagcggtgataatcgtgattccatatattgtaggactgtaatccctgctagtaatccatttgtgctgtttatgtatcgaaggcagcaaagatgtgtgaagcggcaatgggatgcttgctgtaaggtaatatgtttggcttgctaggcatgctacacgctatttggatgtagcaacgttatcaccagctgtatacgctttttaatcgacaacatttgaataatatgtacataacattatgttgaaaaaaaaaaatatgtataaaataaaaa

SEQ ID NO: 77327 - DNA, 246 bp, Zea mays
  Clone ID: LIB3079-001-Q1-K1-H9
ccacgacgaccggcggaagatgcacctactactactcgtgctcgcctgttcgtgccctcggcggtgacggcggcaagaggccgtgtcggcggtggcgcgccaagtgcgcacagcatacatccagccgtcgattccacgctccggaaatctgtcgtcagggccgtcgacgctggccgtctgcgcacgcatccgcattacgcctcattcgttcaccgaggatagttacagcagcaccagcacggacaa

SEQ ID NO: 77328 - DNA, 248 bp, Zea mays
  Clone ID: LIB3079-002-Q1-K1-A1
gacgaccactccctccacaacgccttcagcacctacggcgaggtcctcgagtccaggatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtgg

SEQ ID NO: 77329 - DNA, 278 bp, Zea mays
  Clone ID: LIB3079-002-Q1-K1-A10
aaaaaaaaaaaaaaaaaaaaaaaaaaaaaaaaaaaaaaaaaaaaaaaaaaggaaaaagaaaaaaaaaaaaaaaaaaaaaaaaaaaaaaaaaaaaaaaaaaaaaaaaaaaaaaaaaaaaaaaaggggaggccgtttaaaaaattccaatcttattaacactttccagaaacttaaaaatttaattatggcgcaatatattttaatttaaatgcccgactttttaaaacttaaaatttgaaaaaaacttggtattaccaaataaaatcctttattaaaaa

SEQ ID NO: 77330 - DNA, 416 bp, Zea mays
  unsure at all n locations
  Clone ID: LIB3079-002-Q1-K1-A11
gcaaaattctcaactgattttgaaatcaagtacatcagcagtagctgctctctcttggtcattgatagaggaaaccaagcaattcgagaaattccactcaacgatgatgactgtgcatatcagtatgaagctggttttccactagggtttgcattgctttgtgctgctggcttctttggttatatgcttgcgatgctccaacgccggcttttaggaatgtcatcaacaacagatgatcctcaagcgcctncaagacccagcattgcaagtatccctccatcataccagaagcctttaaatccttatattcgtcatccattcatcccgagagaagaaactgcaaaacaggaaaccggagaggggttcttcaccacagctggcanactcatgggaggggcaaaatcatctgtgggtga

SEQ ID NO: 77331 - DNA, 421 bp, Zea mays
  Clone ID: LIB3079-002-Q1-K1-A12
tccagatgcgcttttggttataattcatagcgcaactcattagctatatgctggtagtgagggtgctaacacaagctgatggtttaaaatattttctcttgctctagggtgagattatgaaggtttatgccaatgatcaaataaaaacatgtgttgagtttccagagtgttttgtatgtaagtagtgcacattatattttcttttcatttttgcaccttgtatgttttaaaatttaaaaatgattgggtatctgagctccatgccttctatagaagattgctggtcaaacatgagctgttagtgagagaagaattgtgccctcttacctctggatctccctgattctcacaggtgtgttttgcacttgcacacttacattggtgctctttctttttgctgctaacataagtactatactac

SEQ ID NO: 77332 - DNA, 442 bp, Zea mays
  Clone ID: LIB3079-002-Q1-K1-A2
ctttatgatcaattcctttttatcagggtttcgagagtgaggttgctgaggctgcggatggagaacagaaaaccgagagcctgatgaggctctcctgggcgcttgttcactctagacagcctgaagatgtcaaccggggcatcggaatgcttgaagcttcattggacaggtctagcagcccagaggaaacaagggagaagctctacttgttagctgttggtcgttacagaactggggattatacaagaagccgacagcttttggaaagatgcttagagatccaacatgactggagacaagccataactttgcaaaggctcgttgaagaaaaaaccaaaagagatggtatgattggcatggctatcatcacaggcgcctttggagttgtgggtcttgttgctggtgggataattgctgcggattcttcgtcatccaggaagag

SEQ ID NO: 77333 - DNA, 426 bp, Zea mays
  Clone ID: LIB3079-002-Q1-K1-A3
gtccccgctcttggattcccgacgacgagctcggagcttcttcttccctgctcggtgctcgtcgcaacagctgccgccatgtctgccgcgaaccagctcgccgctctggtcagcaacatgtacgccacgggtttgcttgacgatcagttccagcagctccagctgctccaggaccccagcgcccctgacttcgtctccgaggtcgtcacgctcttctgtcaggacggcgagcggatcatcgaagagctggccaaactgctggagaagcccaacgtggattttgacagggttgacgcctttgtgcatcagctcaagggaagcagtgcaaatattggtgctcagaaggttaagaacacttgcattcagttccgcgaattctgtcagcagaagagcagagatgggtgcctcaggtactggagacaatga

SEQ ID NO: 77334 - DNA, 411 bp, Zea mays
  Clone ID: LIB3079-002-Q1-K1-A4
cccacgcgtccggtgcccgtccccgtcgccgtccgcctcgccagggccgacggtggcggagatgcagcagctggacttcagcgaggcgccgtgggacgaggccgccggcttcgcgctcaccaagtacccgtcgtacgagatcgactgggactccctcctcgccaattaatcgtcgccccttgttggctggctggctggctggctcccatcctacccacactgccgtcgtgcagcaagaggagggttaaagaaggttaacggccgtcgcgcagatgggattttagacatcctgcgcgggcactagttggatcattagtgctaatccccgtgcgtccgttcgttggttggttctgtgtaaaagttcgtccgattcgattgggccttgtcactggtgagtcagttgtagatctc

SEQ ID NO: 77335 - DNA, 384 bp, Zea mays
  unsure at all n locations
  Clone ID: LIB3079-002-Q1-K1-A5
cccagctgtgcaagcctataggctacaacaagcaattgcggcgagcgtcttacaacaaccaatttcccagttgcaacaacaatccttggcacatctaacaatacaaaccatcgcaacgcaacagcaacaacaattcctaccagcactgagccacctagccatggtgaaccctgccgnctacttgcaacagcagttgcttgcatcaaacccacttgctctggcaaacgtagttgcaaaccagccacaacaacagctgcaacagtttctgccagcgctcagtcaactagccatggtgaaccctgccgcctacctacaacagcaacaactgctttcatctagcccgctcgctgtggccaatgcacctacatacctgcaacaacaatt

SEQ ID NO: 77336 - DNA, 371 bp, Zea mays
  Clone ID: LIB3079-002-Q1-K1-A6
gtttgagaagaaatatgaaccaaccattggtgtggaagttcatccgttggatttcgccactaactgtggttagatcaggttctactgctgggataccgcagggcatgagaagtttggtggcctcagggatggatactatattcatggccagtgtgcgatcatcatgtttgatgtaacctcaaggcttacttacaagaatgttcctacgtggcatagggacctgtgcagggtctgtgaaaacatccgcattgtcctctgcggtaataaggttgatgtgaacaacaagcaggtcaaagcccagcaggttactttccacaggacgaagaatctgcagtactatgaaatttctgacaagagcaactacaactttg

SEQ ID NO: 77337 - DNA, 213 bp, Zea mays
  Clone ID: LIB3079-002-Q1-K1-A9
accacgcgtccgaaaaaaaaaaaaattaaaaaaaaaaaaaaaaaaaaaaagaaaaaggaaaaaataaaaaaaaaaaaaaaaaaaaaaaaggacagacattttaaaggaatccaaatttacatactaatacatactttttattttttttttttttttgagttcctaatttcatttcactggccttggtataacaacgttattatttgaaaaccc

SEQ ID NO: 77338 - DNA, 403 bp, Zea mays
  Clone ID: LIB3079-002-Q1-K1-B1
cccacgcgtccgcccacgcgtccgcccacgcgtccggagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctag

SEQ ID NO: 77339 - DNA, 419 bp, Zea mays
  Clone ID: LIB3079-002-Q1-K1-B11
gatttccatggcaattggcaacttcgcaaacacattggatacattgatggccaagtctcggttcaaagcgaagatgaagaaatcaaagggcaaacgggatcttgacacgtgcccctcaccaacaggttcgtcgccgacagattcagcaaccagagcatgaaaaggtcaagagggccagttgcttaccctatgaccattgcccgtgtttaaccagggctggtcaccattgtaaatcattagtgttttctggccatcagcccctaatccttactgtctctgtcagagctcatactcatgtaagcatcaggcaactaggttgctgatggtcctaggctgaaaaaggatactgagaataaacttctggtgtttgtttatacctatatcctgaacatggagtggagtagatgagctttaggact

SEQ ID NO: 77340 - DNA, 355 bp, Zea mays
  Clone ID: LIB3079-002-Q1-K1-B12
ctcacgcgtgcggcttgccaaagcagacgcacatcataccactgctgctgatatcagggacgactgttcagagtttgtgcaaaagtacttgcgtgagggccctagaatggtgcgtgacgtgttacgaatggccaacgagaatgcccgagcaatcataatcattgatgacgttgatgctatagccactgctcgttatgatgctcagactggtgctgaccgataagttcaccgtattcttatggagctactgaatcagatgcgatgggatagatcaaacagtcgatgagaaggctataatggcaactaatcatgcatacactctagatcctgctatgctgagtgctgctagacttga

SEQ ID NO: 77341 - DNA, 410 bp, Zea mays
  Clone ID: LIB3079-002-Q1-K1-B2
agcaggccgccgggtacggctacccgcccccgcagcaggccgggtacgggtacgggtacgcgccgccgcaggccgccgggtacgggtaccagcagcaggccgtgaggccgcagaagaagaagaacaacttcgggatggggctcggggccgggctgctcggaggcgccgtcgggggcctcctgatcggcgacatgatctcggactcgtcggcgtacgacgccggctacgacgccgggttcgacgacggcggcggcttcgatttctagcgcgctccggtggcatgggtggtgacgccacgccgcgcatcagagacggagaggttcccgttttggatttgccttttgtgatttgtttccttctgtacgcaatctatgtaattgtcggaacgaaatcaatcaagattatgcata

SEQ ID NO: 77342 - DNA, 416 bp, Zea mays
  Clone ID: LIB3079-002-Q1-K1-B3
gggcttcttccattgatccagtcttctgaagctggtctggtcaaggttgacttgagtggttgcaagaacattacagatgtggctgtctcctccctggtgaagggacatggaaaatctctgaagaaaatcaaccttgagggttgcagcaagataacagatgctatcctcttcaccatgtctgagagctgcaccgagcttgcggagcttaatctttcaaactgcatggttagtgactacggtgttgccatcctggcatctgcaaggcacctcaagctccgtgttctctcactgtcaggctgctctaaggttactcagaagagcgtgctgttcttgggcaaccttggccagtctatagagggcctcaatcttcagttctgtgacatgattggcaaccacaacattgcatcgctggagaa

SEQ ID NO: 77343 - DNA, 432 bp, Zea mays
  Clone ID: LIB3079-001-Q1-K1-H6
gtcaccgtctcgcttcgcagtcctactcgcactgtcgcacacacccgtccccatcctcttccggtctcgccctcccctcacgccgctcgccgcgtccggccgcggcaacccgacctgcgtcaatcgccatgactacctcaaggcgtcttgccgataggaagatagcacgatttgagaagaatatcacaaagaggggctctgttcctgagacagtcaagaaggcaaatgattatcctgttggacctattcttcttgggttctttgtcttcgttgttgttggatcatctctctttcagatcatcaagacagcatcaaacgctggtttattctgaggacaattggtcacttacttttagtcactctaaagtcgaggaaccagggtgacatatgcagttggtcacttaaaaactatacaagtgtatggcgtaactg

SEQ ID NO: 77344 - DNA, 349 bp, Zea mays
  Clone ID: LIB3079-001-Q1-K1-G12
aaaaaatgataaatgcaagtgtatgaaacaaagtacaattacctataaatcgtggtggactctgggaaagtgaaccctatacgcctgatcatttcctacaaaacattacgatgatgccagtgaacaatcttatactctacgatgatacacttgcgtcttaagttaagataacccctactaggaaaatattaagctcttcgtcattagagccataccatctctttgattaacctgaaccaaacttggtggattcttagaccggagagacttatcactgaaacgtacacgttgtctgaatagtgattccaacttacactcctgccatgctattattgctactatgcttgtt

SEQ ID NO: 77345 - DNA, 415 bp, Zea mays
  Clone ID: LIB3079-001-Q1-K1-G2
tcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttgtccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggatgcggctacggcggtggcggtggaggctactgcagtggtcgtggaggcta

SEQ ID NO: 77346 - DNA, 371 bp, Zea mays
  unsure at all n locations
  Clone ID: LIB3079-001-Q1-K1-G3
cccacgcgtccgccgttccccaccaccaccttcgctccttctgcttcgcccgtccccctccgtcgcgtcgactcccaagatggataagctcagtggttctgcacgtcttatgattgtttcagatcttgaccatacaatggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggngaggcaatggttcctgatgatggctgggaagaatatc

SEQ ID NO: 77347 - DNA, 430 bp, Zea mays
  Clone ID: LIB3079-001-Q1-K1-G4
gtgaagttgagaggaaggaacaggagaagaaaaggagcccaaaagttgaatttattactggagtacaacccccaatcaatgcatcaataccgaagatcccaggtttggctggtgtctgtacactaccggtacctacagaaggtgtacagaaagagactagaccaaacaagaaatcaaaatgggataaggttgatggtgatgttaagaaccatgtggttcctagtggacacgacaacttatcagcaactactgcggcactcttgacttcagctaatgttggtgctggatacgctggttttgcgcaacaaaagagaaaagaggccgaagaaaagaaaaacgatcataagtcagacagaagatcgtagcaccaccttttgtttcattctgagcagtcagcgtatcatttattttttttcagtgacatagtttt

SEQ ID NO: 77348 - DNA, 314 bp, Zea mays
  Clone ID: LIB3079-001-Q1-K1-G5
cccactcgtccgaaaaaaaaaaaaaaattaaataaaaatgaaaaaaacaaaaaaaatacgaaggaaaaactaaaaaaaaaagaagaactaaaagaatctaaaacgaaatatgggggggtcagattttgggccccacattggctatccctttcttggggggtaacctgtccttgcttaggtctccgtgccctgttggaatgtgcctactgttacgattctgtactcggaaaatccactggttgaccaccttctctctacttggaattaatgaaagtttagcctattctcactttagacattagtctcatgcctgt

SEQ ID NO: 77349 - DNA, 252 bp, Zea mays
  Clone ID: LIB3079-001-Q1-K1-G6
aaaaaaaaaggaacgagcacaagatatggaatgatcccaaaaattgaatagattactgggggggacgccccaaacaaggtgttaattccgaagactccatgtttggctggacgtctgttcacctaacatacgtacacaaagtgtacggaaagatactagatccaacaatatatcagtatgggatgacgcagatggtgctctgattaaccatgttggccctattggactccgactgcttatcagggacaactg

SEQ ID NO: 77350 - DNA, 405 bp, Zea mays
  unsure at all n locations
  Clone ID: LIB3079-001-Q1-K1-G7
cgcagacagtccaagatggactcagtttcgtggcgagcttgaagcgcgtgttcgcctgcgagcctgacaagtacgacgagatcatcgccaccatgcgccagttcaagtccgggagcattcgtagtgcggttgtggttgagcgtgtgaaggtgcttctggaaggtcaccctggtctcctccgccacttcaaccagttcctgccatggggttacataagggctcatggaccagtcgggaggatcagcgtctgatgcagccagggcagggaagcgcgtgtggctacctaaacaagcctaaacctactagctggtgctttccatcgcatgaatggcanaatgggacaagagtatctggttggcccgtcatgactgctattctgcatgggcagtaccattaagacatgta

SEQ ID NO: 77351 - DNA, 389 bp, Zea mays
  Clone ID: LIB3079-001-Q1-K1-G8
tcgcccacgcgtccgacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctatctgctgcctacccccagcaatttctttcattcaaccaactgacagcattgaactctcctgcttatttacagcagcaacaactactaccattcagccagctagctggtgtgagccct

SEQ ID NO: 77352 - DNA, 455 bp, Zea mays
  Clone ID: LIB3079-001-Q1-K1-G9
gaaaggcgtaagatgtaagagaataactagatgcattggttctgttgggctggatgtcccaggtggcactgcagtcttgccttcaactgcattgatgcttgctgtgcctgcacagattgctggatgcaaaactattgttcttgccacaccacctagccgtgatggtagcatatgcaaggtacacttgatatggaactgcaccgggattcttttttaaacaattggttgatggagcattatatacttgtttcctgcaggaggttctttactgtgcaaagaaagctggtgtgacacacatattgaaagctggaggagctcatgcaatctcagcaatggcatggggaactgcatcttgcccaaaggctgagaagatttttggacctggtaaccagtatgtaacagctgccaaaatgattcttcagaacagtgaagctatggtatctatagacatgcct

SEQ ID NO: 77353 - DNA, 268 bp, Zea mays
  Clone ID: LIB3079-001-Q1-K1-H1
acgagggcgagcaccgccacagccccgcctccggccaggacccgccgtcgccgtcgctcgcgccgctgccggagctgcccagccattgatttggcttcctgcctgctctgtcctgtcaattactagtagctgttgtcataagttataaaatcaaaatcgccagttcagttttagcagctccgttttccgatttttttctcttctgtcgttcgcgttagcagctttgtgaaaggattaggaaagtgttagcatcagacttggagaaggg

SEQ ID NO: 77354 - DNA, 360 bp, Zea mays
  Clone ID: LIB3079-001-Q1-K1-H10
ctcacatccctcgagaagacgcctgctcctcgccgatcgatacgatggccgggttctccgacctccacaccgccgacggcctcaagtccctcgaggctcacctcgccggcaaaacctatgtgtctggtgactccattactaaggatgacattaaggtcttcgccgcggtgccgtcgaagcctgtcgctgagtttcctaatgccgcccgctggtacgagaccgtctctgcggctgtagcctcaagattccctggtaaggctgttggtgtaaatctgcctgcgggatcagctcctgcggcagctgctcctgcggatgacgctgatgacgatgatgaccttgatctttttggtgatgaaactg

SEQ ID NO: 77355 - DNA, 466 bp, Zea mays
  Clone ID: LIB3079-001-Q1-K1-H11
cagaatcggctcctgcaaccagaagctgcattgaacaaattcagactgaagcggaaagatcggaactttggtaaaaaggttcgctaccaaagcaggatgaggcttgctgagcagcggacacgggtccgaagacagtttgtgcgacagtctgagcaggatgatcaaacagcgcatggttcagaaagatgacacgtaatttctaatacaacgtatcatcttcttcggcatatctgagaattatgcggatcttcctattgcgcatcttcgtcgacagatctgacaattaagtggtccttgccattgctgatagtagcccactgattcccaacgttagagtacacaatatataagactctagctgtcaatttctgtgattgactgcatatgatcaccctagcgctatggagtcaacaatgtaatatcgatatactatgttcgtgccttggcaccttggcggtttgcaatc

SEQ ID NO: 77356 - DNA, 428 bp, Zea mays
  Clone ID: LIB3079-001-Q1-K1-H12
ctcctgaagacagaagctgctttgaacacattcagactgaagcggaatgatgcgtactttgctaaaacggtttgctaccaatgcaggatgaggcttgctgagcaacctacacgtgtcctaactcagtttctacgacagtctgagcagtattatcaaacatcgcatggttaacaaagactacacgtaatttctaatacaacgtattatattacttcgccatatctgagaattatgcggatcttcctattgcgcatcttcgtcgactgatcttacaataaaatgttccttgccatttctgatagtagaccactgattccaaacttttgagcacacactatataagactctagctgtcaattactgtaattgactgcataagatcaccctagctctctggagtcaacaatgtaatatttatatactatgtt

SEQ ID NO: 77357 - DNA, 224 bp, Zea mays
  Clone ID: LIB3079-001-Q1-K1-H2
aggcacgcgtccgacggatccaacactccatccgggatgggatgttaccttcattagcgctgttgctgcaacagtcatgagacctattacagtagctacctgcggtgcactgactggcactaatcatcagggcactacgtcttcaacaacttgtgctaacaaaacttgcagcctactctcagcaacagcagtttctttcattgaaccaactagctcgattgaac

SEQ ID NO: 77358 - DNA, 390 bp, Zea mays
  Clone ID: LIB3079-001-Q1-K1-H4
cccacgcgttcgctacaattccaccagctactgggatgagtttgtgtggggtggtgcgtggatgtactttgccacagggaacaattcatacctcacggtcgccacagccccaggaatggcgaagcatgctggagcctactggtttggaagtccaaactatggagtatttacctgggatgacaaacttccaggagctcaggttcttctcagcaggttgcgactcttcctaagtccagggtacccttacgaagaaatactgaggacattccacaaccaaaccgacaatgttatgtgctcatatctgcctctattcaattcattcaacttcactaaaggaggactaatacaactcaaccatggaaggcctcagccacttcagtatgctgtcaa

SEQ ID NO: 77359 - DNA, 357 bp, Zea mays
  Clone ID: LIB3079-001-Q1-K1-H5
cctgcctagttctaggtacgatgctgatcagtccatcaaacctacagttatgaattgggacgtctggagttaggaagaacattcacaaaagaagttggtgaggccatggctttcttcaatgagaggcctatcatctttttactgtcaaatccaacctctcattctgaatgtactgctgaagaagcatataactggactcagggtcgtgtaatatttggccagtggcagtccatttgaccctgtggagtacgatgggaaggtttttgtacctggacagtcgaacaacgcctacattttccctggatttggccttggtcttgttatctctggagccatacgtgtccacgaggacatgct

SEQ ID NO: 77360 - DNA, 453 bp, Zea mays
  unsure at all n locations
  Clone ID: LIB3079-001-Q1-K1-G11
tcgcaaagttgataaatgcaagtgatgaagcaagtacaattacctgtaagtctggtgaaccaggggaagtgaaccctatagcctgggcagttcctacaaaacatgagggtgatgccagtgaagaagcttctttcgccgatgagacacttgcatcagaagtagtgctaacccggaagaggaaaataggaagctctttgtcagtagagcccaaccatctctctgatgaacttgaaccaaagttggaggatgcttagaacggggagacttctaactgaaaaggtaaagtgggcagcgtcgtgatgccaacttacccacctgccatggttctattggtcctctgcttgtttctcgttttccttgggagtcagcttctctgttttatgtggtcgcacacggtcttatntgtagtattacaccacagaagctggctgacccaaaaaccgacttttgggg

SEQ ID NO: 77361 - DNA, 445 bp, Zea mays
  Clone ID: LIB3079-005-Q1-K1-D9
cagcgcaccaacaggtgagcttccgcgggcttatcatggagaccaaggacacgtgtctgcgccttacgtcgctccgtgggctcagccgcagtcccagaccgcaggaagtcagcaaccgacacgcactcaggcacaggtatcttacagctcgtatgcttacccaccgccgccatgggcgtcacaggacagcaccgaatcgaacccttttgtagcggcagcatcgtcatctcagcaataccagtccacttcgagaacccctaccatgccaccgaacttgaggcctctactacagcagtcgcattcttttggagtaccacttccaaccgcgagtctggactcgccaataaatgggaacctgaagcaaccgctgtctgctggggctcgcatgccatcttatgtttcttccaacaagttcttcgacgacttgtttgagaggaactcggat

SEQ ID NO: 77362 - DNA, 349 bp, Zea mays
  Clone ID: LIB3079-005-Q1-K1-E1
aaaaaacaaacaaacacaaaaaaaaaaaatttaatacaacaaaaaaaaacaaaaaaaaaagaaagaataaaaaaaaaaaaaaatacaaacaaactaaaacacaatccaaaatacataactcatcaaaacctacaccctcctcttcatatttcccttctacatccccacaattaatccatttaccttctctatatcaatccttttaattccaaaaacccttcctatccccaacttcttctactttgacaaaatccccctttctccaattttcttattacccaatatctccccccttatccccctttccaaaattttttcatcctcattgcttttttctatcccccccttt

SEQ ID NO: 77363 - DNA, 452 bp, Zea mays
  Clone ID: LIB3079-005-Q1-K1-E10
cccacgcgtccggctgcacaacaacgaggggaactacctagcccacacgcaagggaagaggcacgagaccaacctcgccaagcgcgccgcccgagaggccaaggatgcgcccgcgcagccccagcccaacaagcgcaagcttgccccccgcaagtctgttaagattggcagacccgggtataaagtaaccaaacaatatgatcctgagacgaagcaacactcgtttctctttgagattggttaccctgaaattgaagataattgcaagccaaggcaccgcttcatgtcatcatatgaacagaaagtccaaagttgggataagaggtatcaatacctactttttgctgcagacccctatgaaatcattgcattcaagataccaagtacagagattgacaaatcagcgagcaaattcttctcttactgggatcctgacaagaaggaatacctgc

SEQ ID NO: 77364 - DNA, 332 bp, Zea mays
  Clone ID: LIB3079-005-Q1-K1-E11
cggacgcgtgggcggacgcgtggggtgcgcagccgcagccgcagccgctgcttttcgtgcgtctgcatcctacgcgagggcgaaacccacaaaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggacatggactggtaccatcatgggccctcacaatactgtacatgagggtcgca

SEQ ID NO: 77365 - DNA, 68 bp, Zea mays
  Clone ID: LIB3079-005-Q1-K1-E12
atgacttcttatttctttaaaaaaaaaatttaaaataaaaaaaaaaaaaaaaaaaaaaagggaagggt

SEQ ID NO: 77366 - DNA, 349 bp, Zea mays
  Clone ID: LIB3079-005-Q1-K1-E2
cccacgcgtccgcccacgcgtccgctctaccttcaaagggcgaaggcagccgatctcaagcccgattccccatctcgccctgcccgccgaagagcgcgcaagcaccaccgtcccggcagcgcggagatcggtccactccatccacgcggcgtcaggcgagcggggcgcacggacgctgcgaccgatggatctcaaggatagcctctccaaatttaagcaacagcaggagagatgccagtcatcactggcgagcatagctgcttcgacctcaaagccaaagcacagggcccaaccagcgcatgctcctaacgtcccagcaagaccatcacaacctattaagttttcaaat

SEQ ID NO: 77367 - DNA, 386 bp, Zea mays
  Clone ID: LIB3079-005-Q1-K1-E3
cccacgcgtccgggcgcctcggcccgcaccagatccgccgccccgtggcgctcccctccgtcgagtcggaggtcgccgcctcgtccgcccaggaccgcgccaaggacatcctcgtcgtcgtctccggcctcctcttcggcttcggctgcggcgccctcaccgcggcgtccatgtacctcgtgtggtcgctcctcgcctccacctgcgcctctggatacgacgacgacgtctacagcgacgacgaggaccggctgtccgactccgagagccccaagaatgccggctacgtcatcatccacgacgctgacgagtacggcgccggtaagaactagggctggggatccgtcttcggtctcgccgggggtcagcagaaggattttcgtaat

SEQ ID NO: 77368 - DNA, 300 bp, Zea mays
  Clone ID: LIB3079-005-Q1-K1-E4
gttacattgccacgttctgtttctcgggtctcctatttcactggttcactccatctggagatgactgcggactcaacctgtttttcattgtcttcacgttgattcttgtttttgcgtttgctattgttgccctgcacccaaagatcaatggaagcttgttgcctgcatcagttattggtatgtactgtacatatctgtgctacagtggactctccagtgagccaagggattacgaatgcaatgggcttcacaatcactcaaaagctgggtcaactggtagccttacattgggactcctta

SEQ ID NO: 77369 - DNA, 492 bp, Zea mays
  Clone ID: LIB3079-005-Q1-K1-E5
cggaatggaatgcccgacccgagcgacgcgtcacgcgtacgggcgcctcggcccgcaccagatccgacagacccgtggcgctcccctggggcgagtcggaggtcgccgcctcgtccggccaggaccgcgccaaggacatcctcgtcgtcgtctccggcctcctcttcggcttcggctgcggcgccctcaccgcggcgtccatgtacctcgtgtggtcgctcctcgcctccacctgcgcctctggatacgacgacgacgtctacagcgacgacgaggaccggctgtacgactccgagagccccaagaatgccggctacgtgatcatccacgacgctgacgagtacggcgccggtaagaactagggctggggatccgtcttccgtctcgccgggggtcagcataaggattttcgtaataacatttgcatgattgcttggaaatgtgcagtatactgtatgcacctttttaatcatgtgcgtctcgtctgtcggt

SEQ ID NO: 77370 - DNA, 462 bp, Zea mays
  Clone ID: LIB3079-005-Q1-K1-E6
actagctcaaaaccctagagctctcgcctgctcgcctccgccgccggagcgagcgcccgatcttcatccgtcaaccatggcgacccagatcagcaagaagaagaagttcgtcagcgacggtgttttctacgccgagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgttgagctttatgccgagaaggtcgtcaaccgtgggctctgtgccatcgcgcaggccgagtccctccgttacaagctcctcggtggccttgccgtccgcagggcttgctacggtgttcttcgttatgttatggagag

SEQ ID NO: 77371 - DNA, 448 bp, Zea mays
  unsure at all n locations
  Clone ID: LIB3079-005-Q1-K1-E7
gaccaacttcctgagctatgctatagatgatgcacagaaatatccataccttgcatcaatgggcatttatgtcttcaagaaagatgcacttttagaccttctcaagtcaaaatatattcaattacatgactttggatctgaaatcctcccaagagctgtactagatcatagtgtgcaggcatgcatttttacgggctattgggaggatgttggaacaatcaaatcattctttgatgcaaacttggccctcactgagcagccttccaagtttgatttttatgatccaaaaacacctttcttcactgcaccccgatgcttgcctncgacgcaattggacaagtgcaagatgaaagatgcatttatctcagatggttgcttactgagagaatgcaacatcgagcattctgtgattggagtctgctcacgtgtcagctctggatgtgaactc

SEQ ID NO: 77372 - DNA, 238 bp, Zea mays
  Clone ID: LIB3079-005-Q1-K1-E8
gaagatttgtcttatcaccatcagtttattctgcatgctgcattagatgttgttcaggatctagcatggagaacaaatgcaatgttcctgaagtcagttgatagattcaatgaccttgtggtgtctgtttatgtaactgctggtcataccagattcatgctgcttcatgactcgcgtatcgaggatggaataaaaagcttttttcaagaggtccatgaactttacatcaggatattcc

SEQ ID NO: 77373 - DNA, 362 bp, Zea mays
  Clone ID: LIB3079-005-Q1-K1-E9
caaccccaaaccaatccgtcgcagacactcaaggtcgcaggatgccgccgccgcgtgagcaccaggagccccaggacgaagaggacgacgataccgcaggcgttgtcaagctcatcagcgccgagggcttcgaattcgttgttgacaggaaggccgccatggtctccaacaccctccgcaacatgctcacatccccaggcggcttctctgagacgcgccagggcgaggtccgcttcccagagatccccaccaacatcctcgagaagatctgccagtatttctattggtcgctccattactccagtgggaaggagaccaccgaagtttcaaatcgaaccggagataaccctggagcttatgat

SEQ ID NO: 77374 - DNA, 369 bp, Zea mays
  Clone ID: LIB3079-005-Q1-K1-F1
tgagaatttggtctctcgatatgatgagttagaggaggaaaatggtgagcctatgaatggcgagtatgatgagcagatctcaggctatccaagggacaattctgagttcagccccatacagatgatgggtgatgtgagccacgatgaggatgctgaaagggatgagggcgaggaggatggagaggactatgaaactgacgatcctgctggtgatgaggatgatgacgttgagatggattgggatgatgacattcgggacaacgatgatggtaatggagcagccaacgcagatgaggatgaatgtggtacatcatcatattcttcacagtatcgtgagtgatgagagtggattgaagatgcgcaggtttg

SEQ ID NO: 77375 - DNA, 453 bp, Zea mays
  Clone ID: LIB3079-005-Q1-K1-F10
atcactcgagacatgctgttttgtcatgcagttcgtaatcctggccttattattgacagggtacaagatatacgtctgatgaatggggaagccatccatgcaacaccaaggaagacagggattatagttcttggtggaggccttccaaagcatcatatatgcaatgccaatatgttccgcaatggtgcagattatgctgtgtatattaacacggctcaagagtttgatggtagcgattctggagcacaccccgatgaagcagtctcatggggcaagattaagggttcagcaaaacctgtaaaggtgcattgcgatgcaagtatcgctttcccgcttcttgttgcagcaacatttgcacgtaaggttcataactccaaatgaacagactgaatgggattcggtggagtgaatgggcaacagaattttgttgaactcttcaaatgaccttttgga

SEQ ID NO: 77376 - DNA, 449 bp, Zea mays
  unsure at all n locations
  Clone ID: LIB3079-005-Q1-K1-F4
cttcggctccacaagagccttcagccacaagaaccccctcaagtcagactggtgcctcggaaagctgagagccgcactggaagacatgggataccgagacggagacaccatgttcggagccccctacgacttccgctacgcgccgccgtcccccggccagacgtccgaggtgtactcccgctacttcaaggagctgatggagctggtcgaggccgcgagcgagaggacccggaagaaggccgtcatcctcggccacagcttcggcggcatggtcgcgctcgagttcgtccggaacactccgncggcgtggcggcgcgagcacatcgagcgcctcgtcctggtcgcgccgacgcttcccggcgggttcctggagccggtgcgcaacttcgcgtncgggacggacatcctctacgtgccagcgacgacgccggttgccacgcgagccatgt

SEQ ID NO: 77377 - DNA, 161 bp, Zea mays
  Clone ID: LIB3079-005-Q1-K1-D7
aaaaaaaaaaaaaaaaaaaaaaaaaaaaaaaaaaaaaaaaaaaaaaaaaaaaaaaagaaagaaaaaataaaaaaaaaaaaaaaaaaaaaaaaaaaaataaaaaaaaaaaaaaaaaaaaaaaaaaaaaaaaaaaaaaaaaaaaaaaaaaataaaaaaaaaaa

SEQ ID NO: 77378 - DNA, 329 bp, Zea mays
  Clone ID: LIB3079-005-Q1-K1-C2
gttactggatccatgcagtaacaatagtgttttcaatgcagtaggagtattgattaaacgatgtataaccctgctggttgtatatttctttgtgatgtggtaagtgagaccatagacttgtgttttttagccttcttattgagtgtgctttgagtatgtcgaagatgaacacttgtagttctgaatcttaacacatccaacatgtaagagtgtgtttacttcgaaatctaaaacgaaaaaatttctaatgaatacctactaaagcatttgggatgctcttgcacacctaaacttacttacccaaaccacttaagtaaatggatttggtc

SEQ ID NO: 77379 - DNA, 275 bp, Zea mays
  Clone ID: LIB3079-005-Q1-K1-C4
cttcactgacattgcaatgtgggtgttctgcccgttcaacgggcctgccaccatcaagggggggtttgcgagtttcgctctgcagaaggtcggtaggcacattggagactgggagcacttcaccctccgagtgagcaacttctcaggtcagctgtcgtctatctacttctcgcagcacagcgggggcgagtgggttgaagcttgcgatctggagttcatctctgggaacaaagcgatcatctactcgtccaggaacgggcacgcgaactaccccc

SEQ ID NO: 77380 - DNA, 340 bp, Zea mays
  Clone ID: LIB3079-005-Q1-K1-C5
tcgatcccagatcagcttggacagtctgttacccactgagaaaatcatggcactagggtccgggatctatcttctgtgcgcaagatcttaggctgcccgtcaggacgctttgtcgttctccggcacagcgaacggtgtcaccagcgcggcatcagggaaaacaccggcctgacttagctacgtgccgatctaggccgaccatgtgatcggtatagcacacacacactctaaacttttacaggtcctaaacaatctccaaatattctatttgtcagacagatggctacaaagacattgtgcatgtatatttaggagtttgtaatcatctagaatggtgcac

SEQ ID NO: 77381 - DNA, 395 bp, Zea mays
  Clone ID: LIB3079-005-Q1-K1-C6
cccacgcgtccgcactgatgaagtttattgatgctagcaccatccctagagttgggacgtttgacaagaaccctgacaaccacccatacctcatgaaattcttccaaagctcagcccccaaggctatgctgtttttgaacttctccaccggaccttttgattctttcaagtctgcctactctgctgccgcggaggaattcaaggacaaggaaatcaagttccttattggtgacatcgaagccagccagggtgccttccagtactttggcctgaaagaggaccagacaccccttatcctcatccaggatggtgactccaagaagttcttgaaagttcacgttgaagctgaccaaatcgtcgcttggttgaaagagtactttgatggcaaattgacg

SEQ ID NO: 77382 - DNA, 450 bp, Zea mays
  Clone ID: LIB3079-005-Q1-K1-C7
aatgatagaggggtctcatatacctttggtgctgacaaggtttcagaattcttgcaaaggcatgatcttgatcttatctgtcgtgctcaccaggttgtcgaggatgggtatgaattttttgctgacagacagcttgtcaccatattctcggcccccaattattgtggtgaatttgataatgctggtgcaatgatgagtgtcgatgaaactttgatgtgctcattccaaattctgaaacctgctgagagaaaaaacaaatttatggggtccaacaaaatgtgatagtgaaagccattttgcttccagcagctctagcctgttaaggttctcctgtggatgcatcgagacaacagcatgctggcgccaagtttgagggcagcattgggctactatcagagaaaccaaataatcccatacctaactgttcatctggaagttactcatcatgac

SEQ ID NO: 77383 - DNA, 429 bp, Zea mays
  Clone ID: LIB3079-005-Q1-K1-C8
ctcagatccctagtgaagaagtggcagacattaatcgaagcccatgttgatgtcaagacggccgacaactacatgttgcgtttgttctgcatcggcttcaccaagaggcgcccaaaccaagtcaagagaacctgctatgctcaggcatccgagatccgttagatccgccgtaagatggttgagattatgatcaaccaggcttctacatgtgacctgaaagaacttgtttcgaagctcattccagaagttattggtaaggagattgagaagtctacctacagcatcttcccacttcaaaacgtattcatccgcaaggtgaagatactcatggcccccaagttcgatcttgggaaactcatggaggttcatggcgactacaatgaggatgtcggtgtgaagcctgagaggcctgtcgagggagatgaggct

SEQ ID NO: 77384 - DNA, 355 bp, Zea mays
  Clone ID: LIB3079-005-Q1-K1-D1
gcgtgaatcaccacgatttcatcccgtcggccaatgattcggagggtgatgcggccacgacacggtgctcctgccacagagaaaccgtacatcactttgctctaccgtcctggccactacgatattctctacccaaagtgaattttgcgcatggttagtttcacgacttcggttgagaaagcacactgcccagaaaactcgtcatgtttcgcctgtgtgctgccaaaggtggcaaacttgcttttgagtgcttaatgccaatgccctcgttcaatctagatgttctctacctgctgtaagtcttactctggtacaaggatttaacattgtgttgactgcagagaagttcccgtgg

SEQ ID NO: 77385 - DNA, 450 bp, Zea mays
  Clone ID: LIB3079-005-Q1-K1-D10
atttatatcagctgatgatttgcggataaatctttggaatttggaaatcagcaatcaaagtttcaatattattgatgttaagcctacaaacatggaagatctcactgaggtgataacatctgctgaattccatcctactcattgcaatacattggcgtatagtagctctaagggctccattcgacttgttgatctgcggcaatcagccctttgcgacaatcattcccaaatctttgagcagcatgaggccccaggttcaagatcatttttcactgagattatagcttcaatttcggacataaaattttcgaaggatgggaggcatattctcagtcgtgactacatgactctgaagctttgggatgttaagatgaattctggtcctgttgcaacattccaggttcatgagtatctaaggcctaagttatgtgatttatatgaaaatgactc

SEQ ID NO: 77386 - DNA, 452 bp, Zea mays
  Clone ID: LIB3079-005-Q1-K1-D12
cggagagatctggtctgccattccctcgctccttcccgtgaaccacaaacctaacgcggagcggcgcgggccggccgccgggcgaggtgcgcgtagctgccgtcgattgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgccgggagcacgccgaggccaagcatcccaagacagacgtgtaccagtgcttcccccatctgaagaagtgaaaggcctgaacttagcaaccagtgctggtttggtcactacgatcgggccagggggcgttccttgtgttgagggtgttcattccgtgttatc

SEQ ID NO: 77387 - DNA, 402 bp, Zea mays
  unsure at all n locations
  Clone ID: LIB3079-005-Q1-K1-D2
cccaagacctcctcagacccgagaagcgcagctgcggccatggacgccaccggcactggggctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcngccacggcggcgtg

SEQ ID NO: 77388 - DNA, 461 bp, Zea mays
  Clone ID: LIB3079-005-Q1-K1-D3
cggacgcgtgggggcttcggatcccacaccgaggaaaggagaagagagcgagggtcggggtaatggcggccgaggagggtgccgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaggtcgacgtggacgaactgctggaagtcgcgaagatctacggcgtccatgtgatgccgaccttctgcttcatcaggaacggcgagacgctcgagagctttgctaccgtcgacgaggacgagctccgggacgccgtcaggaagtacgccgtcgctggcactacgacggctcctgccctcgcgttcgcctaattcaggagatgtgatgtg

SEQ ID NO: 77389 - DNA, 407 bp, Zea mays
  Clone ID: LIB3079-005-Q1-K1-D4
gtacttccattattgtcgctctttgcgttttgaagataagccagactatagctatttggagaaaaatttccgggatttattcatccgtgaaggttaccagcttgattatgtatttgattggactgtgtcaaggcaagctgtggacaataacagattgcgactgagcgggaagacaggtggcttggtgggaccatctgtggatagggctgaacgagctgcagcaagacaagatgttccagatagattcactggtcaagctggtgcttttgctagaagaaccggctctggttctggtcaatacggagaacacacaaagcacaggactctgttggattcacttatggcatccaagatggctgttgattcagataaaaagaaagcattcatcatctcggaatggaagcaca

SEQ ID NO: 77390 - DNA, 347 bp, Zea mays
  Clone ID: LIB3079-005-Q1-K1-D5
gatcgagcggccccttttttttttttttttttttttttttttttatttttttttggtttgttttttttttatattttattttttattttttttttttttttttttttttatttttatattttttatttttattaaaaaaaaacctagccaaaattaccactaaaaatcaaaaatcccactttttaaaaaaaaattattttttaactaaaaacttaccaaaaagaccaacttaattttaaaaacttaattccaatttccttactcaaactaaaaacccaataccttctttaactaaaactcttatacaaagatttaacactataactacttcaaataatttaccctag

SEQ ID NO: 77391 - DNA, 328 bp, Zea mays
  Clone ID: LIB3079-005-Q1-K1-D6
cccacgcgtccggagcgccgcggaggtggtgtcggcggaggagctgctgcgggtgcgcaaggagatcgtcgacttccacggcgagatggtcttgctggagaactacagcgcgctcaactacaccggtgagacgcatctcactagggatgagagagtttttatttttatttcaaaaagatagagaggggaaaaacaatcgtgcagcgttagatttcaagattcattctaaacgtactgacatagagcaatggatgctctgggttaaccagggctggtcaagattctcaaggagtacgacaagaggaccggcgcgctgatccgtctgctc

SEQ ID NO: 77392 - DNA, 383 bp, Zea mays
  Clone ID: LIB3079-005-Q1-K1-C12
tgcacgcatacaacaaccgcgactgtgacatcagcccatcctagccacccaccgtataatgagagcgataatgtatgggagagtgataatatggcttccatggacgatgtcagtaggcccgctcctataatacgcgctatggacaaactcatctgagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacaagcggccgggactacgctgtgcccagcctgttctcagatattttccgtgatccgcttagtgcgccgcacagcattggcc

SEQ ID NO: 77393 - DNA, 455 bp, Zea mays
  unsure at all n locations
  Clone ID: LIB3079-005-Q1-K1-A8
gcaagggcttcggatcccacaccgaggaaaggagaagagagcgagggtcggaataatggcggccgaggagggtgccgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaggtcgacgtggacgaactgctggaagtcgcgaagatctacggcgtccatgtgatgccgaccttctgcttcatcaggaacggcgagacgctcgagagctttgctaccgtcgacgaggacgagctccgggacgccgtcaggaagtacgccgncgctggcactacgacggctcctgccctggcgtccgnctaattcaggagatgtgatgtgt

SEQ ID NO: 77394 - DNA, 229 bp, Zea mays
  Clone ID: LIB3079-005-Q1-K1-A9
ctgcgcttgacaagatactgcatctgaggtaaagtaaggaacagaaaaaccatgtgtcggtccatggtcctagctttggctgtggatgctgaagacgaagcgcacatggttggtcattcatcgtgaatgttaataaaagaaatcgatcacatgcagtacttgtatctagagttcttcctaaaaaaaaaaaaaaaaaaaaaaaaaaaaaaaaaaaaaaaaagaaagacaa

SEQ ID NO: 77395 - DNA, 447 bp, Zea mays
  Clone ID: LIB3079-005-Q1-K1-B1
ccagcctcccagcgtcgtcccaggcggtgatctggccaaggtgcagcgtgccgtgtgtgtgatctccaactccaccagtgttgtggaggtcttctcccgcattgaccacaagttcgacctcatgtacgccaagcgcgccttcgtgcactggtacgtcggtgagggtatggaggagggcgagttctccgaggctcgtgaggatctggcggcgcttgagaaggactacgaggaggtcggtgctgagtttgacgagggtgaggacggcgacgagggtgacgagtactagacgctctactggcgcggcgtcgtcgggcttgtgtgccactgctatcctgtgatctgccctgagtggctcctatcgtgttatgtttctgtcggttcttatctatctgtcgttgtgtggtttacaacttacgttgtaagactttattcccccgctttgctact

SEQ ID NO: 77396 - DNA, 183 bp, Zea mays
  Clone ID: LIB3079-005-Q1-K1-B11
ctgcgtgcacaggaagcatgctattgcgtactccccaaagaccccacgtttgcaaaatacatcaccaaccataacaccgcccaaacctttacctcgtacggtatatccatcctcaaatgctaagcaagctctcaacgacatcgcttcgcttgatattgctcttgtgagtaacatattcagctt

SEQ ID NO: 77397 - DNA, 459 bp, Zea mays
  unsure at all n locations
  Clone ID: LIB3079-005-Q1-K1-B2
agcaggcttccctaactggcagtgcaactaccgaggccgtttcagtatcaaggcccttggctgccccacaagtccctgcagcaaaacaaagtgcaccagtcacttcaacagctcagaatgcaccttttctttctcgttcaatgagtgctgttgggcggttggggaatgaaccatctgccaatgctcctagtttcgttccccgttcacgaacatatcgcaatgccatgatggagaaaagttctggtggtggaagctgtttcacacatcagcaaggttcatcggagcaagcagttgcaccatggcaatcgatgtttacatcgcaacctttcattcggccatcagagaccttgtcttggaaagaggaaacattattgagatctgggtttacatttggaactgtgaagcccgagtcactgaacccatatcanggcagagaagagaactcacagcaagcgagca

SEQ ID NO: 77398 - DNA, 462 bp, Zea mays
  Clone ID: LIB3079-005-Q1-K1-B3
ctaagaaatacgatttggaagcatggttccctgcatcaaagaccttccgagagttagtatcctgttcaaattgcactgactttcagtcaaggagacttggaattgggtatggccagaaaaagaatgacgagcagtccaagcagtttgttcatatgctgaactctaccttgactgccactgagaggaccctctgttgcatcctggagaatttccagaaggaggacggcgtcgaggtgccaaaggcgctgcagccttatatgggtggaatagagttccttcctttcaagcaacctttggatgccaaacaagctgctgactccaaatcaaacaagtccaaatcaaagggaaatgctgcttgagttggacgaagaacagactggaatgcaaatgcacgtgcaggttgcaaattcttatttatgttaaattttggggcctatcagtacacagtactcatagcatgac

SEQ ID NO: 77399 - DNA, 385 bp, Zea mays
  Clone ID: LIB3079-005-Q1-K1-B4
gagaaagatgaatttagcaggctgttgaaagcaaaaatcaatgagcttggcatgtcggagaggatcgagtgtacaccaaatgattcaccttcaggaaaattgactgtgcctgtgctgcaagagctcatttctgcccttgcaactgacatgagcacttcaatctcccaatgtagcaactactctggtgcatcagcacccttacgctgcaatggaaatgttgactgcatcaatccagcgcattgtatattctccaatgagcaatcacctgattttcagaaatgctatcagggtgaacaagatgttgattcttctgctacatcgctaaacaatgagcccaatcagccaagtccaacatcagtccttgaagcatctttctcaaatgata

SEQ ID NO: 77400 - DNA, 456 bp, Zea mays
  unsure at all n locations
  Clone ID: LIB3079-005-Q1-K1-B6
caagcccgtggtgctcatgtgcaccgaccctaccaagtcgtccctgaacccgaagctgtaccgcccgacatttgcaggatttgtcgacacggacatctcgaacggcaagatatccctgagaagcctgatcgaccggtcggtcgttgagagcttcggagccgggggcaagacctgcattctctccagggtctacccgtcgctggccatcggcaaggacgctcgcctctacgtgttcaacaacgggagggcgcacgtcaaggtgtcccgtctcaccgcgtgggagatgaagaagccggtcatgaacggggcctgaagatcttgaataaatatatcacccatgcatgacatattggcgcctgaggaatctttcctttntttaaaaaacatattttagatgtcgtttattaagagttgaattgtcatactaaagggcgccccgttatatgttacaatggt

SEQ ID NO: 77401 - DNA, 399 bp, Zea mays
  Clone ID: LIB3079-005-Q1-K1-B7
cccacgcgtccgaacctgagcagcgactttctgccattgttgagcagtattttagagttgggcctttcatgccctgttgaagtgttcatacgttctatataatagcagcctaaaaacagggagctaattagtactggaagaattctttatagcgtccagaagcattcatctgtagattcgtatggtcccttttattttcctggtacaatttatcttctggtggctgcagttgatggattatcgtgtatccttagcttgcaaaactgggtagtttccttaatccttcacatcatatctctggctcccgatgctgtttctgcatcctaaatggcagtagctttgggaaccaactgcatgtctggatcagctcaccatgttcagcattctttcgcttgtatc

SEQ ID NO: 77402 - DNA, 461 bp, Zea mays
  unsure at all n locations
  Clone ID: LIB3079-005-Q1-K1-B8
gaaaatcgagataacgagagctagggttttgattccagtactcacgccgcatcctgtcgccttctgcccctccctctcggcaccgcctccgccccctcattctctctcgcgtcatccggcggaggctcgaggaaactgaggccgggagcgccccgaagaatattctccacccagtcgccgacacccctgcgcgcgcgagagtaagtcgcctcccccgccgccagtgctcttcgtgatgatatatttccagatccggtttgtccgacgcagatggtagggctggagaggctgccgatgtggtattgaagagggatttagatgcatgaattttgtgttcgtaacgtggattggtgtggggtgggagaggctcctttgccggattggccaggttaccattgtacctgtgtagctnggcagttggttgactgtgtgacaaccttgagctatgtcatattacgaaa

SEQ ID NO: 77403 - DNA, 343 bp, Zea mays
  Clone ID: LIB3079-005-Q1-K1-C1
gtgcgctagccgccgcctagctgcactgctgtatttttgtttcaggattgctgctgctggtcgcattcaatctttgggcctcccggagccgccggaggcgcgttttactgttagccttactactcttactccctgtagctccacgtagaagaaaccgatgtcctgcgtctggcaatttttcttagtccaaaaaaaaaaaaaaaagaacaaaaaaaaaaaaaaaaaaatataaaaaatagataataaaagtatactaagatagcaaaactgtttaacataccttaatacaacatatcaatttctgtggctcccaatacatgaaaatgtaggctggccgttttaa

SEQ ID NO: 77404 - DNA, 436 bp, Zea mays
  unsure at all n locations
  Clone ID: LIB3079-005-Q1-K1-C10
gccgccccccaccaaccacgaaccacgcatgcgaacccggccggcgcggggcagcggcgggggcggagatcccggtgatcgacctgcgcctcgccggctcgtcgcccgacgagtcggcgcggctgcgcgacgcgtgcgagcgcctgggctgctttcgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgncgcgcccgccgacgtcgacgccttctgcgcgcgcctcgacgcgccgnccaaagtcagggagaccgtcaagacctacgcggaggagatgcacgacgtgat

SEQ ID NO: 77405 - DNA, 557 bp, Zea mays
  unsure at all n locations
  Clone ID: LIB3079-005-Q1-K1-C11
gaattacccgggctcgactccacgcccgtccgaacgcgcgtcgaagccgaagcaaggctaatgggcctgtgagtctggatnncgaaggcnncctcgctcgtatgccgaccagtgtctggcaggaccgtcatcgcgttcttcggtggcccgccctgcggcccgagggcgctccgcgcccctagccccggtcttccgcacgcccgtcccgcggcngatcgtcgccactttcgcccgtcggcttctttcgtcgcgcttccgctcgcccgcgcttcactcttttcgccgcccgtcccgccacttggagccganntggggcctcgtgccctgcaggggctacctagcnagtaccttccccacgcccgccgcccgacgcccgccttagatcgtatttattcggagtggctatccagtacgtactttagtagtagtgagaatttggttcggtgctgtcgtgtcgtcgtcgcatttntgggtcggatcttggtttcctttggtgccagggaggggtttctattacccatgtcgcgggtgtcggtttgtgtgaatctcatcccccc

SEQ ID NO: 77406 - DNA, 424 bp, Zea mays
  Clone ID: LIB3079-005-Q1-K1-A7
cccacgcgtccgcaacttacgccgccgctcgctccaccgcgcaagaggctgctgctgccgctcacccacccccgctcgcgcagaaggccgccgcagctcttactactggtgccctaaacgccgatatccctgttcgcctccctttccccacccaaaaccccggccttcagggttccggcaccatgccgcagggagatcacatcgagctgcaccagaagcgccatggcaagcgcctggaccacgaagagcgcaagcgcaagcgcgaggcccgcgaggtgcacaggcgctcgaaggatgcccgcaatttgattggtgctaagggcaagaggttcgccaagaaacgctatgctgagaaggcacagatgaagaagaccctgaaaatgcacgacgaatcaaataaacgacagaaggttgatgatgatgt

SEQ ID NO: 77407 - DNA, 394 bp, Zea mays
  Clone ID: LIB3079-004-Q1-K1-H10
tccgggccacgcgccacgcgtccaactgcatgctgactcacgaatcccaattcctccatggcgacgcaccgccagtgcctgcgactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccataagctggccgccgacggtctgcggatacgccgcgtggagcgcggcgagcagcaggtcgtgtccgggatgaactaccgactctacgtcgacgccgccgaccccgccggccgcaccgtgccctacgtcgccgtcgtgtacgagcaggtct

SEQ ID NO: 77408 - DNA, 365 bp, Zea mays
  Clone ID: LIB3079-004-Q1-K1-H11
gggagatcgttcggcgtcacagactttttcaatccatcgcagctggacaagcgttctgtcgtagaggtgatcgttgagatgaccggcggcggcgtggactacagcttcgagtgcatcggcgtgccgtcggtgatgaccgacgccttcagatgcaccaagatggggaagggcaagacgatcgtgctggggctggggagggacagcgacgaggtgtgcctgccgtcgctggagctgctgttcgggaggtgcgtcatggggtcgctcttcggcgggctgaagcccaagacccacatccccgtcctcgccaagaaatgcatggacaaggagctgcagctggacgcgctggtcacgcatgagcttggact

SEQ ID NO: 77409 - DNA, 411 bp, Zea mays
  unsure at all n locations
  Clone ID: LIB3079-004-Q1-K1-H12
aaggacaccaccgccatggcagccaagatgcttgcattgttcgctctcctagctctgggtgcaagcgccactagtgcgacgcatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcanatgatgatgccacaatgtcactgcgacgccgtctcgcagattatgctgcaacagcagttaccattcatgttcaacccaatg

SEQ ID NO: 77410 - DNA, 400 bp, Zea mays
  Clone ID: LIB3079-004-Q1-K1-H3
gggggagaagcgaccgcgccgccaaaccctatccccgcgcaagcgaccgtgggggagctccactccgccgcgccgccccccgtccccgtttcgcgacatggccgattccccgcgcaggaggtactcaaggtccccttcatacagcagggggcacccaaaagggaggtcaagatcacaatctccagctcggtctcagtctaggtcacctgtccctgatcctagatctcaggcgaggtcaagatctagaagccaagaaaaggaagaagatgctgttaaccgggggaatactctgtatgtgactgggctctcttcgagggttactgaaagggatgttaaggattatttttctaaacatggaaaggtggttggttgccatgttggtcttgaaccccatacacgt

SEQ ID NO: 77411 - DNA, 389 bp, Zea mays
  Clone ID: LIB3079-004-Q1-K1-H5
cggacacatcctctacaatagcttgattgcttgtagcaggaggcatatcgggggaaggggtgcagatcaccaccaccacaacagcatacgcatgactctttagagcatgatgcatatcgggtgaaatggaacaaatcaccaccaccacaccagcgaatcgcaggactccttctagcctgacgcatatcgggtgaaatggaacaaagctccacaaccacaccagctatcgcatgactcctttgagccgaatgcatattgggcgggatctaagaaacatgcgcaaggagcaacggacgttgctgatgagacaacgccagcacgtggtcatggtctgcatgtcgcgaccgggatgctcttcacgaggaagagcttgcttccagggacagccc

SEQ ID NO: 77412 - DNA, 401 bp, Zea mays
  Clone ID: LIB3079-004-Q1-K1-H7
ccttcttgatccagccaagccagggatcgccatgtcggactcggaggagcaccactgcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactc

SEQ ID NO: 77413 - DNA, 395 bp, Zea mays
  Clone ID: LIB3079-004-Q1-K1-H9
gcggcgtccgacgagagtggaaatgattgctctctccaagatagccctggtgtgtgcggtggcgctgctggggctgggctgggcgtaccaggccacccgcccgccgcccccggcgatcttgggcgccccaggagggccgccgatcagctcacctagaatccggctgaaagacggccggcaccttgcctacagggaggaaggagtgcgcagggagaacgccaggttcaagatcgttttcatccatggcttctcctccaccaaggagagcgggttccccgtgtcccaggagcttgtggagcagctgggcatatacatgctcttcttcgacagagccgggtatggcgacagcgacgccaacccgaagcgctgcctcaagagcgacgccacggacgtcg

SEQ ID NO: 77414 - DNA, 415 bp, Zea mays
  unsure at all n locations
  Clone ID: LIB3079-005-Q1-K1-A1
cggcagcttgccggacaacctctgcgactctcccgcgatgagcatcatcaacatctcccgcagcgcgctctccggcacgatcccggcgttcaagaactgcaggaggctggtgtcgctgtacctggccggcaacggcttcaccgggcctataccggcgtccctcggagacttacaggtgctgacgtacatcgacctgtccagcaacgccctcaccggcggcattccgacggagctccagaacctgaagctcgccctgctgaatgtctcgtacaaccagctctccggccgcgtgccgccatctctgatcaccgagcttcccgccgtgttcctccagggcaacccggggctgtgcggcccggngttgccgaaagactgcgacgccgacgcgccatcgcggaggcgtcagggactcgcg

SEQ ID NO: 77415 - DNA, 364 bp, Zea mays
  Clone ID: LIB3079-005-Q1-K1-A10
cccacgcgtccgcccactcgtacgcccactcttccgaaaaaaaataacaaaaaaaaaaaggaaaaggtaaaataataaaatgaaaaataaaaaaaaaaaatcataacaaaaatccaaataaaaataagactagcctataatagcttacctatcatagctaacttatttattacaccttcgaagaataataaaacttcatcaaatcgaatgacttccctaactataacaacatatcccattacaaaacctatatttcctcctctattataccatcttcctttaaaagcattcttcctatgccacccagaatcataccacctccatcacctaagatcattcctacagcttcaccaaacttaccttc

SEQ ID NO: 77416 - DNA, 420 bp, Zea mays
  Clone ID: LIB3079-005-Q1-K1-A11
cccacgcgtccgcccacgcgtccgcccactcgtccggagcgctccggcacaggaagattgtgagtgcgtgcctaaacgctcgtgggagtttaccatttcatactagatttgtacgccattcagatcctgacatgcttgaggtgggcaacggcggcatgtccgaggcggagtaccgctctcacttcagcatctgggcgctcgccaaggctccgcttctgatcgggtgcgacgtgcgggcgatgagccagcagacgatgggcatactcagcaactcggaagtcatcgccgtgaaccaagatagccaaggtgcgcagggaaagaaagtgcagtccagcaatggcttggaggtttgggctgggccgctcagcaacaacaggaaggccgtggttctctggaaccggcatggataccaggcaacca

SEQ ID NO: 77417 - DNA, 398 bp, Zea mays
  Clone ID: LIB3079-005-Q1-K1-A12
ctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctcccagaggctttcctggagggatgcctggtggtggtttccctagagggatgcccggtggaggtttccccgggggtggcatgcctgggggtttccctgggggtggcatgcctggaggtttccctggtggtgttcccggtaatgttgatatg

SEQ ID NO: 77418 - DNA, 437 bp, Zea mays
  Clone ID: LIB3079-005-Q1-K1-A2
ccccgatccatttcagccgccgccgcgcgtagcaagcaggagcagcaaggatgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgcagccatcccgctgcacagaagagttccgcctgaggaaggtgaagaatgaccagctgaaggcggatgcaaaggagcgcggcgaggtcatcagcaccaag

SEQ ID NO: 77419 - DNA, 415 bp, Zea mays
  unsure at all n locations
  Clone ID: LIB3079-005-Q1-K1-A4
gcgccgactagcaggttgtattagaattaactctcagctcacnagcggcatgcaggtgcatcccctggcgagcgcgtgtcccggtgatatgtcgccaaagatcaaggggcattagacggacaagtgcgaaggatgtgagcatgcanttgtgcacgaatctgcgacgccttcgtaccaacccaagagcagcaacacgattacatctatatccgtcgcttaaatccgtttcgtttcatcgcatgcatatgtatcatgcatgttcactgtaatgataagagcacgtgaccctatctttggtgatatggatcacccaccacaaaacggcctattggtttttatcctaatccatatatagattggatgagattgagagagttaaattcttaacaaatcagaatatctcttaatgtctcct

SEQ ID NO: 77420 - DNA, 451 bp, Zea mays
  Clone ID: LIB3079-005-Q1-K1-A5
cagaagcttgcagaaacttcttattgatactgccacttcagaatacctgtttactgatgatttctttggcgaagaatccatattccatgatatatttgcaggaccgattcaagttgttgatgaacatttcaatactgtactcctgaactgttatgatgcaattggcataatgcttatgatcagaataattcatcagcaccagctcatcatgtttaagcggcgaatcccatgtttggactcttacctagacaaagttaatatgtcactctggcctcgcttcaagatggtgttcgacttgcatttgaacagcttgcgaaatgcaaatattaaaacactttgggaggatgatgtccatccacactatgttacaaggagatatgctgaatttacagcttctctagttcatctcaatgttgagcatgggaacggtcacctagatctaaaatttgag

SEQ ID NO: 77421 - DNA, 427 bp, Zea mays
  Clone ID: LIB3079-005-Q1-K1-A6
ggccaagaacccagccgcgaagccaagcccatctgatccggcccctgctgccctgccccagctcgtctctcaggtcgccttgccgttgccggttccgcgcccgggcccggctcagagtcgcgagctcgtctcgcagatccggcttcgcttgcttgaattctgttctttgggagcaaagaggtgctggccggtggcgtggcttggtgctctggggccggcgagtttttttttttttgcgtccgctcgctctgcctgtagtcttcttgctgcggcggcggggtggagatgggggtggcgggggagaagttccagctggggacggtgggggcactcagcctctcggtggtgtactacgtctccatcgtcatctgcaacaaggctctcatgagctgccttggctttaacttcgccactacttttgacaagc

SEQ ID NO: 77422 - DNA, 435 bp, Zea mays
  Clone ID: LIB3079-004-Q1-K1-G9
agaacacaggtacttttcatcgttacttgcaccaacaagaccatcgcagcttgcaaggccacgtcggaaaggagatcaagggaataacaagattcctgatctcaacctgcaggatggccctatggtgctctccccgccaagaaagttacgtagggtgacagcgcatgaagggatggaaggtatgcacaggacagataaagtggacgaacatccttctgggatgaggcacaccgatgacatgcccagtcagagttctagaattccaatgtcagttgatgttggggctgtgtttggcacacgacctgcacctaggccaacattgaacagtgcggacaagtctcgtttaaaacggaaacttgatatggatccagagtttggatacgcggagtagaaggaacacatgtttacatgcaccattcttttcttattggggat

SEQ ID NO: 77423 - DNA, 406 bp, Zea mays
  Clone ID: LIB3079-004-Q1-K1-E7
gatttgcccccacaacttctctttgctcatcagggccagagagacttgaaagagctggactggcacccacagataccgtcgatgatcatatcaacggcaattgatggcttcaacgtgttgatgcctagcaacattgatacaaccattcctggcagcactgatgcagcaatgccatctgctgagccacagcactagccaacattgatacaagcattcctggcagccctgatgcaatgccatctgctgagccatagcactgatgtaggcgtttcttgtagcatggctcccagcttagaattccaagtctacgcagtggtgtatccgagtgcggttggcatttgtgttgagagtgctatgatgctatgtttgggtttgagcatgatgggaaaggtttggttggctggca

SEQ ID NO: 77424 - DNA, 390 bp, Zea mays
  Clone ID: LIB3079-004-Q1-K1-F1
ttgtggacgtcccagaaatgaattatacttcggaggatcaaccgtatcctcgtggagagatgtgtgttaggggacctataatattctgtggttactataaagatgaagtccaaacgtaacttgttatcattacacatctatttacatcctttaaataaatacatccattaaactttgataaatgtatttgaaaacctgcagaagagaggtcattgatgaggatggttggttacatactggagacataggtttgtggctgcctggaaggcgtctaaaaattatagataggaaaaagaacattttcaagttaactcaaggagaatacatagctccagagaagattgagaatgtctatgctaagtgcaagttcattgctcaatgctttatata

SEQ ID NO: 77425 - DNA, 385 bp, Zea mays
  Clone ID: LIB3079-004-Q1-K1-F10
cccacgcgtccgcgagcccgccagagtagttgggaagcatgcccatgtcctggaaggggccgaggccgaggaatagcagcagcccgagaaccgcgcccgtatcgcccaaggagaagaaggacaggatcggcgagagagtcgcggcgctccagcagctagtgtcgccgttcgggaagacagacacggcttccgttctgcaggaggcctcggggtacatcaggttcctgcaccagcagctccaggtcggtgttccaccagtgaccgcgcgcatggtggccggcactacgtcctcagctccccttacatgcgtgctcctccggctgccggcgccgcgcctgaggatcccgagcactacagccttcggagccgctggctgtgcctggtg

SEQ ID NO: 77426 - DNA, 365 bp, Zea mays
  Clone ID: LIB3079-004-Q1-K1-F11
atgggcactatctacttcagacctcaattcaacccaagcgacaccatgaggaggaaaggtcaaaatccaaactctcctggctctcgcaacgagcgccacctccacgcatacaagcggcggctgcggctgccagccaccgccgccggttcatctaccgccgccggtgcatctgccacctccggttcacctgccacctccggtgcatctcccaccgccagtccacctgccgacgccggtccacctgccaccgtcggaccatgtgccgccgccggttcatctgcccccgccaccatgccactaccctactcaaccgtcccggcctcagcctcatccccagccacactcatgcccgtgccaacaaccgc

SEQ ID NO: 77427 - DNA, 385 bp, Zea mays
  Clone ID: LIB3079-004-Q1-K1-F12
gctcgccggagtccggagtcgccgctttcagtccacagccccaccgtctgctgcacctcgcccgtcatgtctgctgccgcagcagctgcagctgccgctcggtgcgtccctctccgggtgtcctcgccggagaccgcgaagtccgccgcttccattcccacctcctcggccgcctctgcgtctgctcccctccgcgccgccgtcgccgcgggacccggccgccggcttccggcgccgccgttccggtgctcctcatcgtcgccggagaactctgccccgcgcgatcttggattgcttctggaggtggaaggagttcttgcagatgtctaccgttttggcaatcgccaagctttcaatgtagcatttcgaagcctcggactagatt

SEQ ID NO: 77428 - DNA, 347 bp, Zea mays
  unsure at all n locations
  Clone ID: LIB3079-004-Q1-K1-F3
ggaaagagcttacgctgctggggttatgggcgagcccgttcgtgctccgggcgcgcagcgcgctcagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttccccgccgtcgcacctaatttccttccatccgacccctacgaccgcgccattgctcgcttctgggcctnctacgtcgacgacaagttctacagcgcgtggatacccgtgttcaggggc

SEQ ID NO: 77429 - DNA, 407 bp, Zea mays
  Clone ID: LIB3079-004-Q1-K1-F5
agcctatccaagtgcgtcggaccaattgaaaacagaattgaggactatctatggtcggctatgtcaggatgacatgcctatggtcagaagagcagcagcatcaaatcttggaaagtttgcagctacagttgaacagaatcatttgaagacagaaataatgtcaatatttgatgatttaacccaagatgatcaagattcagtgcgtctgttggctgttgaaggctgtgctgcccttggtaaattgttggaaccacaagattgcgtagcacacattcttccagtcattgtcaatttctcccaggataaatcatggcgtgttcgttatatggttgccaatcaattatatgagctctgtgaagctgttggccctgagcctacaagagctgatttggtgcctgcctatgttc

SEQ ID NO: 77430 - DNA, 403 bp, Zea mays
  Clone ID: LIB3079-004-Q1-K1-F7
ggcggcgacgcggcggcggcgcagcatgctctgatcgacgcggacctgcgggagctgggcgtcgccgcgcggaagctcgccaaccacgcattcgtcctcggcggcgggctggggttcggcacctccttcctcaaatggctggccttcctcgccgcagtgtatctcttgatattggatcgcacaaattggaagaccaacatgctgacagctctcttggttccttacattttcttcaccctgcctaatgtgctgttttctctgatcagaggagaggtggggaaatggattgcgattattgctgttattctgcgtctattctttccacgacacttcccagattggttagagcttcctggttccatcatcctgctcacagtggtcgcccctagcctgttcgcggaca

SEQ ID NO: 77431 - DNA, 416 bp, Zea mays
  unsure at all n locations
  Clone ID: LIB3079-004-Q1-K1-F9
agtttgtattgaccggggtccttggtgttgctgcaattctggtaacacttgggcttagcgttctggtattttgcttgttgagaagaaaaggaaggaaaccgagagggagaggagtggagcagactgaagagggcattcggtctgggcggagaagtagtagtgtgaatcccgtcacaatgtcacccatggcatcccccagagccagtggttcaccaaagggcgttcctattatcacagatgaattcacctatgagcagttgcaccatgctgcagggggctttggggatgataacctcgtcaagcatgggcactccggtgacatgtactatggtgtcctggagagtggctttcaagttgtcataaaaaagattgatctgaagaccaagaagaatgccaaggcgnattgagctttctta

SEQ ID NO: 77432 - DNA, 371 bp, Zea mays
  Clone ID: LIB3079-004-Q1-K1-G1
cccacgcgtccggattgtccatctttatccctttctcaaaggtttggttggaaggcagaacaggacaccaacgattgtcatcgtctggtccattctgctggcttcaatcttctcgctcctttgggttcggattgatcctttccttgcgaaggatgatggtccgcttcttgaggagtgtggtttggattgcaactaggatgtcagtgcatcagctcccccaatctgcatatgcttgaagtatattttctggtgtttgtccccatattcagtgtctgtagataagagacatgaaatgtcccaagtttcttttgatccatggtgaacctacttaatatctgagagatatactgggggaaaatggaagctgcggc

SEQ ID NO: 77433 - DNA, 293 bp, Zea mays
  unsure at all n locations
  Clone ID: LIB3079-004-Q1-K1-G10
ccgaaacaaaaataatgcacagtttcttatctaagcttttgagggagaagtgtangggtttaatgcattctgagtttgtgcagattacactacgtgatatacacatgtctcgaagtaacgcagaagtacatacatatttgacactgaagtggttatttatgtcatagcgattatgagtgccacacattcaccagcttagtcatctttaaaccttgcttctagcccatggtatacttatgtctccaggagcgtacagaggactcatacttggccgtgttagacgatgacatatg

SEQ ID NO: 77434 - DNA, 415 bp, Zea mays
  Clone ID: LIB3079-004-Q1-K1-G11
ggcgagactattttccctgatgcaaatgtgaacgtcagttctttaccatggtgcaatgagctttcagagtgtgccaagagaggcctttctgtcaaaccaaagatgggagatgcacttcttttctggagcatgaaaccagatgccaccctggacccattaagtttgcatgggggttgtcctgtgattagaggaaataaatggtcgtcaaccaagtggatgcatatccacgagtacaaagcttgagccttcaagactcgagagtcgagcgtaccaaagatggatctctatgcatgtgacttggggctgtctactgggttgacacccatgtatgctttacagacccactgaagctgtattctttgctcctttgttggaggggggagaattgcagataataagggccaataagcaaggg

SEQ ID NO: 77435 - DNA, 385 bp, Zea mays
  Clone ID: LIB3079-004-Q1-K1-G12
atcgcgagggcccctttttttttttttttaaatatacagcatcagataacgaaacgggcaggtagaaaccagacacaacggacttcacaaggtaatacatgagttcaacagggcacaatggtcctcaaaagtccattcatacttgcgacttgactggttatttaggtgataacgatttggggtccggcacattcaccagtttggccagcttttagccttgcttctagcccatggcatacttctgtgtccaggagcgtgcggtggactcatacttggccctgtcggtcttgtacatgtgagcaatctcagggacaagaggatcatcagggtttgggtccgtgagcagtgagcagattgacaggagaacctttgagatagttaaagc

SEQ ID NO: 77436 - DNA, 381 bp, Zea mays
  Clone ID: LIB3079-004-Q1-K1-G3
gtttgaaactatggaagaagcaagaatggctcttgaagctactcatgctaccaccctgttggacagggtgatttctgtcgagtacgccttcagggatgatagtgaagtgagtgataggtacggcagcccaagaagaggtggtggctatggtaggcggggtgatagcccagtgtaccggtcacgtcctagtccagactatggtcgcccagcaagtcctgtatatggttcatatgacggtcctggtcctgttcgtgatcgctatcggagatcttctgcttatcgatcaaagtccccaactgcgaaacgaagagcatatgactaatcgagaaccctttgttatgccatatatggcctaagaacaccctgtagcaagaacttact

SEQ ID NO: 77437 - DNA, 399 bp, Zea mays
  Clone ID: LIB3079-004-Q1-K1-G5
gagagagagagcaagcaatggctacagcagggaaggtgatcaagtgcagagccgccggggcgtgggaggccggcaaaccgctgtccatcgaggaggtggaggtagcgccgtcgcatgccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggatgagagcaacatgtgcgacctgctcaggatcaacgttgaccgcggcgtgatgatcggcg

SEQ ID NO: 77438 - DNA, 333 bp, Zea mays
  Clone ID: LIB3079-004-Q1-K1-G7
cccacgcgtccgcccacgcgtccggctcttgctgttgtggctaatgttgggaaacgagctatttcttctagatcggtggcccatgctcttcataatcggcattggatcactgacattgagacccctcttaatttgctagggctgcaacaatatcttagcctttgggatgctttaaggcgagtggtgctcactcaggacgcggatcgacatgtgtggattcatgctacctctgctcagttctcttcgaagtccagtgatagggcatattgcatgggttcgattaccttcgaaccatggaagaggttatggaagacttgggcttcacccacatgc

SEQ ID NO: 77439 - DNA, 391 bp, Zea mays
  Clone ID: LIB3079-004-Q1-K1-E5
gtgagagcgatatgagtgtcccaggtcaatgctcatcccagccacaatttatgaccagcgttgggaggagtaaccgctccaatggccccggcactcctcttatcgaaagcatagatgttgatcaaattgttattccagagaaaaacagttggaagaacttattctcatacatagggcctggatttctcgtctcaattgcatatattgatcctggaaactttgagacggatctacaggctggagcacagtacaaatatgaggtgcctgctgcttcagtcttatgttcccacttcttctttggatcataccttgtgcatcctgtgctgctcttattattcaatcacttgcagccaggctaggggttgtgacagggaaacatcttgcagagcat

SEQ ID NO: 77440 - DNA, 207 bp, Zea mays
  Clone ID: LIB3079-004-Q1-K1-C3
accacgcgtccgaacaaatctccctaattgcagtcatgaaagcccaggtcgcagcggcaacggtcttggtcttgctcgttctgacctttgctgcggacgctcgtacgtgcatgtcgcgaagccaggaacagaaagggaggtgctttcacgatacggattgtgccgacgtctgcgtcaaacagagcttcaccggaggcttatgcaact

SEQ ID NO: 77441 - DNA, 429 bp, Zea mays
  unsure at all n locations
  Clone ID: LIB3079-004-Q1-K1-C4
tcggatgggattaggnccatgggaccacagctatctgtgattgggcgaaacttgaaacctcagttttgaaaaggggatgggacgtaccatagctgcagtgcgaattctcagtttctaagtgagctgaaatggatgccttggaagcctngattacttcgtcaaatgtaaaatgaaatctgatggcntttctgaagaaaaagggctttgcctcattcattcgtgtgtttatcagcgagcctttgtcggcttgtttggagttggatcccaagctgttaatggagcgattggtcactgcccgtggctcattccttgcttgctgtgaaagtctgcaaggcctttgagattggaagacaattgattttgtttgaacctgaatgaaggccttcgctctctcaagtttgtctatttgctgcaacaaagttgggggct

SEQ ID NO: 77442 - DNA, 230 bp, Zea mays
  Clone ID: LIB3079-004-Q1-K1-C5
cccactcgtccgaaaaaaaaatataatttaaaaaaaaaaaaaaaaaaaaaaaaagaaaggaaaaaaaaaaaaaaaaaaaaaaaaataaaaaaaaaaaaatataattttaataataaaataaaaaaaaaaaaaaaatgccatcctttttacaaattccatctttccttaacctttctttcaaatttctttttttttcaattttataacttaatttaattcccttgaccatt

SEQ ID NO: 77443 - DNA, 398 bp, Zea mays
  Clone ID: LIB3079-004-Q1-K1-C6
gagtttgcctctatcccgcccacctcaccgtcgttgtctccgccaccgccactgctggcaccactgccatgcattaacctcaacccttccgcaaactattcactgtcactttgtcatcggcgctccatcgttcactcaaatgtggtctccgatacctggcaccctcatgaggactagttcactccctgctgtcattgaggcttctggcaatgatgactggaagaaacgaaaggaagcacagagcctgaagaggctcgaggttaagaagaagaggattgagaagaagaactctctcgcctgcaacacttcaaaagaagctgctgggcagagtccaaaagagatgaatgcaaacactgaccaattagtaaggtctgatgaaactattggcaacgcttacc

SEQ ID NO: 77444 - DNA, 393 bp, Zea mays
  Clone ID: LIB3079-004-Q1-K1-C7
cccacgcgtccgggccgcccttttttttttttttttaacaagaaatgttacgcacatgacattatatatatgagttttaattagctgtttgacaagaaaattagaagagaagaaaattaacgacggcatgagtgaccaccttggtcgtgggtattcgtttcatatagatacagatgtacgtagtattatatatgagaacgaagacgtgcacaggctccagctagctatcaagaatcaaggacgcggtagatgacgacgaagcagggcaggatggccctggggttggccacgaagagctcctcgaggttcccgtacacgctgctgctggcggcgtcctcacccgccaccgagtcgaacgggccttcctgatcctcggcggcagcggcggacgtg

SEQ ID NO: 77445 - DNA, 412 bp, Zea mays
  Clone ID: LIB3079-004-Q1-K1-C8
cggccgtgggcgtggcggggctgagagggtcagggttggttagcagcagcaggaccggcttgttcgccggcgactgcaagaggaaggctcgtcgcccggcgtgctcggcctgggccctcaggcagagccggatcggcagcaggagcaggagcaagaggggcctcggcatcgtctgcaacctcgcgggacagtacgaggattccttcgacgacgtccagcggcaactgatgaactacttcacctacaaggccgtgaggaccgtgctgacccagctctacgagctgaacccgccgagctaccgctggttctacaacttcgtcgctgtcaacaagcctaccgacggcaagcatttcctacgtgctctcggcaaggagaggcaagagctcgcagagcgagtgatggtcaccaggct

SEQ ID NO: 77446 - DNA, 372 bp, Zea mays
  Clone ID: LIB3079-004-Q1-K1-C9
cccacgcgtccggcggcgagttcaaattccacaatcttcttgtagcacaccggtgtggtcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgtcgcaagaccgtcaccgccatggatgttgtgtacgccctcaagcgccagggccgcactctgta

SEQ ID NO: 77447 - DNA, 391 bp, Zea mays
  Clone ID: LIB3079-004-Q1-K1-D1
cgcacgcgtccgcccacgcgtccgaatacactcactggcaagacaatcacccttgaggtggagtcttcggataccattgacaatgtcaaggccaagatccaggacaaggagggcatcccacccgaccagcagcgcctcatcttcgccggcaagcagctggaggatggccgcaccctggcggattacaacatccagaaggagagcactctccacctggtgctccgcctcaggggtggcatgcagatttttgtgaagacattgactggcaagaccatcaccttggaggtggagagctctgacaccattgacaatgtgaaggccaagatccaggacaaggagggcattcccccaaaccagcagcgtctgatctttgcgggcaagcagctggaag

SEQ ID NO: 77448 - DNA, 207 bp, Zea mays
  Clone ID: LIB3079-004-Q1-K1-D10
aagaaacctgccaaggttgtcccaaatatagaaccggttgaagagagaaaggaggatgctttggataaggagttattgatgaaacttaagatgtcgcaaaacaagtttccttcagaatttaagtccaccaaaaacccaaaaattggtccccaggtgcctttggaccaaggaacctttaataatccagaaaattttccattccccaaa

SEQ ID NO: 77449 - DNA, 356 bp, Zea mays
  Clone ID: LIB3079-004-Q1-K1-D11
cccacgcgtccgggacactggattgattctctttcagttcttccatcatatggtagtggaccagatgcaaccaaaattttatctatctgtccatctctgcagaaggctatcaagtcttctaaagcagtggtatttggagagtcatgtgtcttcagtaacatgtttattaagggtatttttgaccgacttgagaaagatatggactcgtttggtattagacttagtgttggtcaaggaagacctgtgaatacgaatctgggtagtgagcacaagacagggtctggtcagcactcggacacaaaagatcttggtggtaatggcactagcagtaccggtgcttcatcagacagagggtc

SEQ ID NO: 77450 - DNA, 262 bp, Zea mays
  Clone ID: LIB3079-004-Q1-K1-D12
ctcctagcggggatgccctcatgtttgtcgttggagtcaaccacaaggagtacaagtctgacattaacattgtctccaatgctagctgcacaaccaactgccttgctcctcttgctaaggtcatcaatgacaagttcggtatcgttgatggtctgatgaccactgtccatgccatcactgctacccataagactgtttatgggccctcatctaaggactggaagggttgaaaggctgctagtttcaacatcattcccaacaa

SEQ ID NO: 77451 - DNA, 445 bp, Zea mays
  Clone ID: LIB3079-004-Q1-K1-D3
tgcctcttcaacaacaggctgatataatctgcaacaaggtcaaggaaatgaaacaagtgagaggtggctacaacatagttggtctgtctcaggggaacttgattggtcgagcagtggttgagtactgtgatgatggaccgccggtcaagaatttcatctctctaggaggtcctcatgctggtaccgcttcagtgcctctttgtggttctggatttttttgcattattgttgatgctctgatcaaattggagatctactcagactatgtgcaagaacatcttgcacctagtggctacctcaaaatcccaactgatatggcagattatctgaagagttgtaggtttcttccaaaacttaacaatgaaattccagataaaagaaatgccacctacaaggaaagattcagtagcttaaaaaaattggttctggatatgtttcaggatga

SEQ ID NO: 77452 - DNA, 191 bp, Zea mays
  Clone ID: LIB3079-004-Q1-K1-D4
tccctctctacccactcgtcctaaaaaaaaaaaaaaaaaaaaaaaaaatttaattaaaaaaaaaaaaaaaataaaaaaaggaaagtttaaaaaaaaaaaaagcacaaaaaaaataaaaaaaaaaaatataatatatcacctctttaaaaattccaatttttcttccccatcctttcaactccttccttttt

SEQ ID NO: 77453 - DNA, 111 bp, Zea mays
  Clone ID: LIB3079-004-Q1-K1-D6
tgagtctgtaataatcaggacatgattaatttaggtaaagtaatacatctatggccgtcttcctttcattcagaaaaaaaaaattaaaaaaaataattttaatataatagt

SEQ ID NO: 77454 - DNA, 401 bp, Zea mays
  unsure at all n locations
  Clone ID: LIB3079-004-Q1-K1-D7
ctggcaccattggcaagcgcctttccagcatcaatgtcgagaacgtggaggagaacgggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgtcctccctggcatcaaggtcgacaagggcaccattgaggttgttggcaccgacaaggagaccaccacccagggccacgatgacctcggcaagcgctgcgctaagtactacgaggccggtgcccgctttgccaagtggcgtgctgttctcaagattggccccaacgagccgtcacagcttgccattgacctgaatgctcanggtctg

SEQ ID NO: 77455 - DNA, 337 bp, Zea mays
  Clone ID: LIB3079-004-Q1-K1-D8
cgcacgcgtccgctactagtggcagcttcccgttgcagtcaagttcatcaggggccgcagaaacaatcgtttctgctttgcaagtcaatcaaactgagccagtgaagaagtttgagcccagatctaaactgtggtctgatactttgagccgaggtctagtcaatctggacatttctggaccaaaagcgaatcctcatgctgatattggagttgactttgattcaatcaatcgcaaggagaaaaggcaggaaaagaaaatcaaccaagcacctgtggtgtctacagtcaccatgggcaagggccatggagctggttccggcattggtcgggctggtgt

SEQ ID NO: 77456 - DNA, 394 bp, Zea mays
  Clone ID: LIB3079-004-Q1-K1-C12
ggcaaactggacattcttgtcaatggttctgccggcaacttccttgcctccggggaggatttgaagcccaagggattccggactgttcttgacattgacactgtgggtacatacacaatgtgttatgaagccctcaagtatctcaaaaagggtggaccagggagaggtccttcctctggtggcctcatcattaacataagcgcaacgctgcaatacactgccgcttggtaccaaattcatgtctctgctgccaaggtacttggaccttctctgaaccgctctgcaagagaaaatcgatgaagtgtgtagatttctgctgattgatcggcttctataagctggcgttgacggtatcacaagatcattggctctggaatggggaacagattacgac

SEQ ID NO: 77457 - DNA, 79 bp, Zea mays
  Clone ID: LIB3079-004-Q1-K1-E1
aaaaaaaaaaaaacaaaaaaaaaaaatttaattaaaaaaaaaaaaaaaaaaaaaaaaggaaaagttaaaaaaaaaaaaa

SEQ ID NO: 77458 - DNA, 418 bp, Zea mays
  Clone ID: LIB3079-004-Q1-K1-E10
cagattcagatcagatcgtagcagccttaggattccgcgctccgggggtgccgaggaagctgaagctcctctctccctgccttctcctcctcgccttctttgccaccgcggcgtacgcggcgtcggcgtcggcgtcgcgcgcggcggccgtcgtcaggggcgcgggcgccccgtcgcagtcggagttggagtcggacccggagaaccagtgcgtgtacacggtgtacgtgcggacggggtccatctggaagggcggcacggactcgaccatcggcgtgacgctgctgggccccgacggcacgggcatccggatccgggacctggcggggtggggcggcctcatgggcgccggccacgactactacgagcgcggcaacctggacatcttcagcggccggggcccctgcatgagccaggc

SEQ ID NO: 77459 - DNA, 339 bp, Zea mays
  Clone ID: LIB3079-004-Q1-K1-E12
gtcggatgttgagtaccgctgcttcgtctgcggcctcgcctgggccacgggggaccgctccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctactgcggtggcgggcgccgtgatggcggtgg

SEQ ID NO: 77460 - DNA, 342 bp, Zea mays
  Clone ID: LIB3079-004-Q1-K1-A5
cccaagaaggccgccgccgccaagtcttccaaaaaggtggccgcctcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcacccatttggcatgcactgtgtaaggtcacactggtctaagttttcaatctgggaaacaccggtttagattcaaggagcgtgaactgtgaaggcaggtgaaaaggtgggatctgggaatcattatgtgctgtttgtaataagattgcaaagatgt

SEQ ID NO: 77461 - DNA, 424 bp, Zea mays
  Clone ID: LIB3079-004-Q1-K1-A6
gagcaaaaagtcgtgactatatttagtgcacctaattattgctaccgctgtgggaagatggcatcaatcttagaagtggatgattgcagagagcatactttcatccagtttgagccagccccaagaaggggagagccagatgtaactcgtaggacacctgactatttcctgtgacgcaaaagtgatgtggatcatgcagagcgaaggtttgatagataggcgcagtttcctggttgcagatatatatatttatatatgtttttgctgggacccctccgtgtgctattcttattatttttgccctggctcgccggccgctctgccgcgtcgtgattcaagtgtatacctacagcctgctacagctggaaggactggactgtgttctcaccttttctcaaactggttggtgcttttggctcggtgt

SEQ ID NO: 77462 - DNA, 98 bp, Zea mays
  Clone ID: LIB3079-004-Q1-K1-A7
aaaaaaaaaaaaataaaaaaattaatttaaaaaaaaaaaaaaaaaaaaaaagggaaagagaaaaaaaaaaaaaaaaaaagaaaaaaaaaaaaaaaaaa

SEQ ID NO: 77463 - DNA, 396 bp, Zea mays
  Clone ID: LIB3079-004-Q1-K1-A8
ccagcttgttaagccccttgatagaatcaccaggtatgtggatgctattcttgcgagcccaaagggcaccctcttccctatgtgtggaatgaaccttgcatttgaccgtgagctcattggtcctgcaatgtactttggtcttatgggtgatggccagcctattggtcgctacgatgatatgtgggcaggatggtgcacaaaggtgattacggaccatctgggcctgggtgtgaagactggcctgccctacatctggcacagcaaagcaagcaacccgtttgtgaacctgaagaaggaatacaacggcatcttctggcaagaagagctgatcccgttcttccagtcggtctcccttccaaaggaggccaccaccgttcaaaagtgctacctcgagct

SEQ ID NO: 77464 - DNA, 428 bp, Zea mays
  Clone ID: LIB3079-004-Q1-K1-A9
cccacgcgtccggtcttttgctctcagtaatggccatactgtttatgacatggaacagccttgcagagcaaatgtggctgttcggcgagagcttcatacaccagcttctgaccgatcctgcattcatttagagtttgatattgctggaactggcctaaaatatgaaactggagatcatgttggtgtctatgctgaaaattgcatcgaaactgttgaagaggcagaaaaactgctaggttattcaccagatactttattctctatttatgctgaccaagaggatggtaccccgctctgtgggggttctttgccacctcctttcccgtccccttgcacagtgaggactgcgcttacgagatatgcagatctttttgaattcggctaagaagagtgctttactggcgctggctgctcatgcatctgattct

SEQ ID NO: 77465 - DNA, 229 bp, Zea mays
  unsure at all n locations
  Clone ID: LIB3079-004-Q1-K1-B1
gcggcggcaaaggcgacgttcccaactatgcgaacgaacattgccctggaacgcagggggaggatgcggtgaaggcggatgcctgcgctgggtgccccaaccagcagatttgcgccaccgcccccaagggccccgatcccgatgtggttgctattgttgagaagttggctactgtgaaacacaaattattagttntgtctggaaagggaggtgttggaaagagcacatt

SEQ ID NO: 77466 - DNA, 389 bp, Zea mays
  Clone ID: LIB3079-004-Q1-K1-B10
gcctcccaccgccaccggcggcgacgtgtaactcgcccgctgaccccagcaggcagccatgggagggcacggcgggttgaacatcctgccgcagaagcggtggaacgtctataacttcgacaaccgtgagaaggtgcaaaaagacgaggccgccgccgcccgggaggagcagctccagcgcgaggcggaacgccgccgcgagtcggatctacgcctcgctgcactacgccgtaaccgcggcctggtccaggcggagacgccccccgctcctccatctcaccccgccggccccgctgatccggcggacgcccttccttccccggcggacgcccttccttccccggcaacggatggagaccacatcaacctcttctcaggtggatcaagcg

SEQ ID NO: 77467 - DNA, 434 bp, Zea mays
  Clone ID: LIB3079-004-Q1-K1-B11
aacacaccaagcgaagcgcactagcatttacctaacaacaatggctaccaagggattagccctccttgcgcttcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgtctacttgcaagagcagctgcttgcatccaacccacttgctctggcgaacgtagttgcaaaccaacaacaac

SEQ ID NO: 77468 - DNA, 78 bp, Zea mays
  Clone ID: LIB3079-004-Q1-K1-B12
ctttttaaaaaaaaaaagttgttgcgttcaatttgtggactgagagcagggagaatagtttgggcgcaacaacttttt

SEQ ID NO: 77469 - DNA, 382 bp, Zea mays
  Clone ID: LIB3079-004-Q1-K1-B3
ggggagcagatggacttcgatacccttcttaagttcatcaatgagctcaatggtcagatcagtcttgaccgggctatccaggacgcggaggcattgtgtactattgcaggagaaaatggggcttcctgcattccacctggaaccccaccttcaatgcccgtcgagaccgatggtggcatgtacgtgcaagaagacgaggtcttgtgagatatcggtcaccctagaaaataatcgcatagaagcatcgcaagtttttatccagtaatgctttcgtcgtcgtcataaatgtgatccgttgtaagtttggaagaatcatgaaaacctagagttgggtgtatatactaccttgataaacctcgaaattgatactttcactattctg

SEQ ID NO: 77470 - DNA, 350 bp, Zea mays
  Clone ID: LIB3079-004-Q1-K1-B4
gtcactgggcgtggacagtccatctcaaatcttattcatcaccgatgtcttccaagaggccgttgctgctaaaaacgctggttttgaggtgataatctccattcgcccgggaaatgccccacttcctgacaatcatggtttccgcactatcaaatcattcagcgagatctgaggaatctggtgatctggacatgtctagatatatgtaattcgcgagtgctttagcccacgtgccacttcatgcagtagaagcattatagcaccgcagcatggcaaaaccattcgacgtaacccttagtttcattgcgaaataaaaactttggttcagtgggctaaaaaaaaaagaaaaa

SEQ ID NO: 77471 - DNA, 272 bp, Zea mays
  Clone ID: LIB3079-004-Q1-K1-B5
gtcaagggggaaccaaacatatcatacatctgctcgcgatactatagggctgcagagctcatatttggtgccactgagtataccacagcgattgacatttggtctgctggttgtgttcttgctgagcttatgctagggcagcctttgtttccaggtgaaagtggtgtggaccaactcgtcgaaatcatcaaagtccttggtactccaacaagggaagaaattaaatgcatgaacccgaattacacagagtttaagttcccacaaatcaaagc

SEQ ID NO: 77472 - DNA, 417 bp, Zea mays
  unsure at all n locations
  Clone ID: LIB3079-004-Q1-K1-B6
cccgcgggcgcacacagggatatggagcgaggcgccctcccggagctctccgttctgtccgccgagcagcgcccgcaggtccttccacgggaccaggccggtggcggcaagggactactacgatgtgctcggcgtcagcaagagcgccagccaggcggagataaaaaaggcctattatgggcttgcaaagaagctccacccagacacaaataaaggtgatgcggatgcagaacgcaagtttcaagaggttcaacgagcttatgagactttaaaggatgaacaaaaaagatcattatatgatcaggttggccctgatcagtatgagaaaactgcttctggcggaggcggaactggcttcgagggtggttttggaaatccatttgaggatatttttggtggtggccgtggcngtggtgg

SEQ ID NO: 77473 - DNA, 196 bp, Zea mays
  Clone ID: LIB3079-004-Q1-K1-B7
gtttcatggcgaccatataggcatatatgtacacacttcacatcccattgcgtgggggtgtcttccctagttcaacaactagctttctgctggaataaggtgttcagagttcagacagagtatgtactgtacatactatcttcttgcatttggtactcttgtttagtgaaaagcgttccgtaaccttcggttgcct

SEQ ID NO: 77474 - DNA, 378 bp, Zea mays
  Clone ID: LIB3079-004-Q1-K1-B8
cgcacgcgtccgatagaccagtccgtttgaaaacaatcctgaaaccaagccgtgggggtgcatgaggaatttgaggagcatgctgagaaggcaaagaccttgcctgagagcacgagcaatgagaacaagctgatcctctacgggctctacaagcaagccacggttggagatgtgaataccgatcgtccgggcatattctaccaaaaggacagggccaagtgggatgcctggaaggctgttgaaagcaaatcgaaggatgaagcgatgaatgactacatcaccaaagtgaagcaacttcaagaagaagctgccggctcttaaaagtctcttaatagtgttgccaaacagctatttggcagatgagctttgtgccatttt

SEQ ID NO: 77475 - DNA, 403 bp, Zea mays
  unsure at all n locations
  Clone ID: LIB3079-004-Q1-K1-B9
gcacgcccagacggcggaggaagggttaaagaggagggcagagcagcaacagggcatggagcgagggagtagagtaaattgaatcaggtttcgtgtcgattcggaggctttcgcttctgcttgcggagttgcggtggagatttgaggcctgcggcgaagatggcacctgcggaatccggggagaaggcgaccagcttcgccatggcctgcagcctgctcagccgctacgtcaggcagaacggtgccgccgctgccgatctcggactcgctatcagagctgaatccgatgcanagaggacgtcgacggacatggaaaagggggagacggngaaggagaccatggatctcttcccccagatcgctggattcggctcggaggccgncacgaaggaagcccctgatg

SEQ ID NO: 77476 - DNA, 382 bp, Zea mays
  unsure at all n locations
  Clone ID: LIB3079-004-Q1-K1-C1
ttggatcggacccagaggggcgactatgagaagctccaaggccagagctacgcgaggatggacggatatccggtgcttgctttgatgcggctttgggaatcattccagggctaaaggttcgtggaactgattactccactgcagatggaacttgtattagggactacatcgatgtcacagaccttgtagatgcccatgtcaaagctcttggtaaagctcagccaggcaaagttggaatctacaacgtcggaacaggccaaggtagatcggtgaccgagtttgtagaagcttgcaagaaggcaacgggagcttncatcaaggtcgaatatcttgcccgtagacctggagattacgccgaggtatacagcgacccgtcgaaaat

SEQ ID NO: 77477 - DNA, 381 bp, Zea mays
  unsure at all n locations
  Clone ID: LIB3079-004-Q1-K1-C11
cgccctcccgctgccgtccgggacgactcagaggccgtctgcccagggccggctcctgttcaccgccgcacccgcccgctcccgctgccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgctggagatttgttgcgggcggaaatcgctgctggctctgagaatgggaagcgggccaaggaattcatggagaagggccagctcgtgcctgatgagattgtcgntaatatggt

SEQ ID NO: 77478 - DNA, 287 bp, Zea mays
  unsure at all n locations
  Clone ID: LIB3079-004-Q1-K1-A4
ccgacccaagcaaaaccgcacgcaccctgccagcggccccccaactcccaacccaacggctactccagctagctcgcggcggcggccagcggccatggccttccggctgagcaacaacctgatcggggtcctaaacttcgtcaccttcctgctctccgtcccgatcctgggcgcgggcatctggctgggccaccgcgccgacggcaccgagtgcgagcgctacctctcggcgcccgtcatcgcgctgggggccttcctnctcgccgtctccctggcgggcctcgtcg

SEQ ID NO: 77479 - DNA, 438 bp, Zea mays
  unsure at all n locations
  Clone ID: LIB3079-003-Q1-K1-G4
cccacgcgtccgctcatttttctcgtctgaaaaagaagagagcacaacaggcatccctggtctaacctcctgatgatggcactcaacggcggttggagaaagaccttcgtgtccatcctgacgacatgctttcttgtggtggttgtaattgtttccctatcctgcgaagcaaaaggcggcgtcgtccccaggttgcggccaccattctgctttccatacgatcgtgaatactgcacgccatttcactgcggcaaagtttgccaagagtacaacttccctgctaagaatggcggctactgcgataaacgtggtgacccatggaagtgctgctgtccatattgaaacgtacaaaatgcatgcatccatccgtgctgctacctgatcgatatacatgtcaatcatcatcaatatatataatgaatgaantaaatgcatgtg

SEQ ID NO: 77480 - DNA, 70 bp, Zea mays
  Clone ID: LIB3079-003-Q1-K1-G5
aaagaaaaaaaaataaaaaaaaaaattaatttaaaaaaaaaataaaaaaaaaaaaaaggaagaattttct

SEQ ID NO: 77481 - DNA, 452 bp, Zea mays
  Clone ID: LIB3079-003-Q1-K1-G6
gtgggttggcttctcctccccctccggttcgggttcgggttcgtgaggttctccggggggcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggacgcgatgcggaacgccatcgagggcatgaacggcaaggagctggacggccgcaacatcaccgtcaacgaggcccagtcccgcggcggccgtggaggcggcagcggtgggtacggtggtggccgtggaggcggcggctacggcggtggcgggcgccgtgatggcggtggcggctacggcggtggcggcg

SEQ ID NO: 77482 - DNA, 293 bp, Zea mays
  Clone ID: LIB3079-003-Q1-K1-G7
ggagagggaagaagcatcttgagcagctcaagaatcctgatattactggactcgctaccgttgtagtaaagaaatgagcaagagaagaaggaagactagtcagacaaaatagaagacgagaagaactgatgtagccatgttcatgcttccatgtaatagttcattattccatacatatttctgtctatccagaatctactattgaaatacatatctagcatagcttgctcagctcctatatgttgtttcaacgttgatttaaaagaagagctggtagttgtgggcttttgaac

SEQ ID NO: 77483 - DNA, 399 bp, Zea mays
  Clone ID: LIB3079-003-Q1-K1-G8
cccacgcgtccgctggaacttcccttcttcatcagaagcaaacacatcacagaatctgggtgatggcattcagaaccatcacagtgaccttccatttgttcaagctcacagcaattttgctccatttatgtccccagatggggatgatttccagcaaattgagggtgtcaagagcaacctcaggaacatgcagtagagcccttacggcgttactagaagctcgattctaccctgtgaagcttaccaagggggcaacatgtgccgttttaatggcttgtggaactgaacataacaaaagcttgtgcctgttgcattctcccagaaattgatgtggttcggctcatttgcggagatgtgatgtggtcaacgatataagatacatgctctctttggttaagt

SEQ ID NO: 77484 - DNA, 447 bp, Zea mays
  Clone ID: LIB3079-003-Q1-K1-H1
aggatggtgaatatgttctgacttacgaggacaaggatggagattggatgcttgttggcgatgtaccatgggagatgttcgctgactcttgccgcaggctcaggatcatgaaaggatcagatgcaattggacttgctccaagggcagctgataagtccaagaatcgcaactagaatggttgcttcttacagtccagagcaagagggagatatccagtgactgtagggatctttgtggaagccggaaaacgtctaacagtttcaagaagaattctgccttatggtctgtaccacatgtttttgctgctacgcaagtaaagaactccacgtctgtcaatgttagttttacaacatcgtctacggacaaaaaaaaaaccccccgctatttgattgttgctaaacctttgtacgacgtgtaaaatgtttggtacaatgagtgctgcgacta

SEQ ID NO: 77485 - DNA, 389 bp, Zea mays
  Clone ID: LIB3079-003-Q1-K1-H11
gaaggattatgtgcatgtgcgcatccagcagctcaacggcagaaagagtctgactacggtccagggtctgaagaaagagttcagctataacaagatcctcaaggatctgaagaaggaattctgctgcaatggtactgtagttcaggacccagagctaggccaggtcattcagctccaaggtgaccagcgcaagaatgttgctactttcctagttcaggctgggattgcgaagaaagagaacatcaagattcacgggttctaagggacctgtaaatgcttgtgccctatattgtgtgcctccacatattggggagcttgaagcatcgacagttactagtcattgcttacttatataagaacataagtagtatttgctattgtcaagtgtg

SEQ ID NO: 77486 - DNA, 218 bp, Zea mays
  Clone ID: LIB3079-003-Q1-K1-H3
gagctttgctgttctgccgaggaaaaaggatccgcgcgcggctgctctccctactattgggttatcgtattccgcgagtaaaaaggaaaactgctcgatgtccttttgtttgttgcttggtaataccgttctgtttgctataattatcgatcagcgggatgtgaagtactgtttacattgctcgcgttctaataaagtactgtttggacttgcttaac

SEQ ID NO: 77487 - DNA, 307 bp, Zea mays
  Clone ID: LIB3079-003-Q1-K1-H4
cctgatccttagtctgagtaggaaacagcgcagtcagctcatcaatacattgtccaatggcagaaactgcaagtaaacaaaaactgaaaaactaaaaaaaaaacctctggatgtcatgtaaataagtgtactttgtatgttctccaatgttgtttccttcatttgtctgattgaatttctaattaaaaaaaaaaacagaaggtacaagcgttagatactacatcaaagtcactgaacatgtaaatgctcaagtaaaaactcttgaataaagcttaaccaagaaaaaaaaaaagggcgccccttttaa

SEQ ID NO: 77488 - DNA, 390 bp, Zea mays
  Clone ID: LIB3079-003-Q1-K1-H5
cgaccacggccacctcgcctactcccacatcaaccaggcgctcctccgccccagggggggcgcggtcaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgttcgccctacccggccagcttcatgctcgcccagctcaccggctcctacgccttcgtcctcttcgacaagtccaccaactccctgctagtcgcatccgaccccgagggcagggtgccgctcttctgggggatcaccgtcgacggctgcgtcgccttctccgacgacatcgacatgctcaaaggctcatg

SEQ ID NO: 77489 - DNA, 466 bp, Zea mays
  Clone ID: LIB3079-003-Q1-K1-H6
aaagaagcaatcaaatatggctgtcatgatcttaagatacttcaacgtgattggagcagacccagagggacggctaggagaagctccaaggccagagctacgcgagcatggacggatatccggtgcttgctttgatgcagctttgggaatcattccagggctaaaggttcgtggaaccgattactccactgcagatggaacttgcgttagagactacatcgatgtcacagatcttgtagatgctcacgtaaaagctcttggtaaagctcagccaggcaaagttggaatctacaatgtcggaacaggccaaggtagatcagtgactgagtttgtagaagcttgcaagaaggcaacaggagcttctatcaaggtcgaatatctggcacgtagacccggagaatatgccgaggtatacagcgatccgtcgaaaatccacatggaactcaactggacagcccagtacact

SEQ ID NO: 77490 - DNA, 435 bp, Zea mays
  Clone ID: LIB3079-003-Q1-K1-H8
cggacgcgtgggctagaatcttttgacatgttaggttttgaagaagtgtcaacgacaggctgcttagtgaaataacacatttttcatttttcttttgttaatcagttgaggtactttatagtactccattccagtatttttaattatgtccacttgattatgaaataaaggtttccttcttaattgaaacttggaattgggaaggtcgctcttaatggctattacttggatccttatatattaatctttaaatagtggagcgagccccaacccatatgtgtacactgggttttatttgagactcaaatatttttatatctccatatccgtgagcgtttcacatttcatttcacgaaaaagcgctattcttctagaagcccacaacagatcactctaacattgcctagccacaacattctttcgactgacggtgat

SEQ ID NO: 77491 - DNA, 394 bp, Zea mays
  Clone ID: LIB3079-003-Q1-K1-H9
ggacaaccactccaatatcatttgtgactgatttcatgttcccttatgctcgtgatagtgtaggaaaacatctgacttctacatttgactttgaggaaactaaagaagacatcaaactattgcgcatccaaattgaagatgatctacaaaatggagttgctggggctgttccagttccacctgatgagggtggcaaagaagaggttatcaattcattggttgccaatgttgaatcaatgattaaagcagaccggaagatcacatcattgaaacaacttcagggtcatatttggaggattggatttcaaaagaaagagctacagggagttgtctttgaggatgttcctgtggcgctaaagaactggcatgctaatggcataaaagtctacatata

SEQ ID NO: 77492 - DNA, 279 bp, Zea mays
  Clone ID: LIB3079-004-Q1-K1-A1
cccacgcgtccgcccacgcgtccggtgataacaagttagaaaatcttaacaaggctgctgagttggaccctactcttacatatccctatatgttccgagctgcatctttgatgaaaaggcaaagtgttgaagctgcattgatggagatcaaccggatacttggattcaagctggtgctggagtgcttagaactaaggttctgttgctaccttgcccttgaggattatagggctgccttatgtgacgtgcaggcaatactaactcttgccccaaattatc

SEQ ID NO: 77493 - DNA, 228 bp, Zea mays
  Clone ID: LIB3079-004-Q1-K1-A11
cttaaagacttcacgcataataatcctataaatctgcttacaaaacataccaagacccatcttgataccaatgctaacatccagtgcaccaaatcaacagtccttcaatgccacatagcacactcacctgacgttcattgaacccttacataacacacttatcacttccttcaccctaacgaagctaacactgactaactacaactaaatgcactccaccatttacac

SEQ ID NO: 77494 - DNA, 364 bp, Zea mays
  Clone ID: LIB3079-004-Q1-K1-A12
ctattctctatctctagcagtggtactttttggcggcgatcgccgtgctattgcttgggccttggactgagtaggtttggaggtagcgatacgagacactcgcccccgattcccctcccgttgccgaagcctgtgttgcacggatcgttcgcggaagcggtttttgatcggagagagagaaagagagagcgagggagggaggtggcgatggacgctgcagcagccgcggcggcgcagatggagaggcactcgtcggcggcagcgcacatggagaggcactcgtcgactgcggacttcgtggacggctgcgttcaagacggctgccatgacacctgcagcatctgcctcgagaccttattcgaca

SEQ ID NO: 77495 - DNA, 378 bp, Zea mays
  Clone ID: LIB3079-003-Q1-K1-G3
ttcccggtcgacccctcgtcctaaaaaaaaaaaaaaaaataaaaaaaaaaatttaataaaaaaaaaaaaaaaaaaaaaaaaaagaaggaataaaaaaaaaaaaaaaaaaaaaaaaaaaaaaaaaacccctacctacttaacaattccttccttccatacccatccatccaacttcaatcccctttattattcccccctatatccaatccccttccctcccttaaacaaccttcctatctcaaaaccccttcctttccccaacttaacctccttttcatcccaaccccttttttccacctaccatttaaccataaacccccccacctacctcccttccaacctctttctcatcccgaatcctcaatttaaccccccttt

SEQ ID NO: 77496 - DNA, 381 bp, Zea mays
  unsure at all n locations
  Clone ID: LIB3079-004-Q1-K1-A2
atgcatactatcaggctagaccggtttagtatattaattctaaacagctcgtgtgatgtttgacccagtcatcgccgtcgacagcgcgaggaaggcgatggagttcctcggcctcaaggacggcggcgaggagcaggccgtcgacatggtgctcacggactactgcatgcccgagatgaccggctacgacctnctcaaagccatcaaggcactgaaccccctggagccgatcccggtcgtcgtcatgtcgtcagaagactagccccagaggatcaacccgtgagccagccggctctggtctttcctctttttgagcaccggttcctttggtccctatcccgtcccctgtgaatgcatgctgaatcattccgtgagatagaa

SEQ ID NO: 77497 - DNA, 334 bp, Zea mays
  unsure at all n locations
  Clone ID: LIB3079-003-Q1-K1-F10
cgtaaaataaaattataatntctatataanttgattctatttaatttactggaaaacacatgtaacggttcccatgtagaccggcgccgtgagacccacatagtgctcatctcatagcaacgcatagacataccatgcatgcaacatagctactttggtaagaccaatactgacatagcgccacacggcgaacatacagacacggcttacgcacatcatgatgcctcgagatacatccggttcatacatcatcaccttcatgtcagtgttccatcagtgaccgcacgcatggtggccggcactacatactaagctcccattacatgcgtgctcc

SEQ ID NO: 77498 - DNA, 383 bp, Zea mays
  unsure at all n locations
  Clone ID: LIB3079-003-Q1-K1-F11
aggccattagctttatctactccagagcgcagttgaacccgatcgacaccatgagggggttgcgtcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgncggtccatgtgccgtcgccggttcatctgccgncgncaccatgccactaccctactcaaccgccccggcctcagcctcatccncagccacacccatgcccgtgccaacagccgcatccaagcccgtg

SEQ ID NO: 77499 - DNA, 384 bp, Zea mays
  Clone ID: LIB3079-003-Q1-K1-F12
cagggtatggcgtttggcacgggtagtgccatggcacacagggctgttgactctgtgttaggtccccggaccatccagcatgagactcttgccacagaagctcctgctgctgcccctgctgctccagcgatgaatgctgatgcttgcagcttccattctaaggctttccaagattgtctgaacaactatggcagcgagatcagcaagtgccagttctacctagacatgctgaacgagtgccgccgtggtggtgtgtctgtctaagctgcctctgggattattcatggattttcttttcggatgagggtatctcattaataagacaccgtgaaacttcgaccatctccacagcttgaaaccatacttcctgggattaatttattt

SEQ ID NO: 77500 - DNA, 433 bp, Zea mays
  Clone ID: LIB3079-003-Q1-K1-F2
gattgtagctttcaagatgctgatgtccttaaaccagacatacttgctcctggcaatctgatgggggctgcatgggcgcctaatggaacggatgaatcaaactatgctggtgaaggatttgcaatggtttctggaactagcatggccgcaccgcatatcgctggcattgcggcactgataaagcagaagaacccaaagtggagcccctcagcaataaaatctgccatgatgacaacggccaatacactggacaaagggagccgtcctctcagagcgcagcagtacactgcatcggaaatgatgacactttctcgggccacaccgtttgattgtggtagtggcgctgttaacccaaaagctgcccttgatcctggtcttgttctagatgcaacccacgaagagtacatcgcatttttgtgctcgatccctgacg

SEQ ID NO: 77501 - DNA, 437 bp, Zea mays
  Clone ID: LIB3079-003-Q1-K1-F3
cggaggaggagctggggctggtggtggttacggtggaggagcaggtgcaggtggcggcgggggcggagggtatggcggaggtgccggaagcggttacggtggaggagctggtggaggtactggcggtggatacggtggaagtgcacgagcaggaagtggctctggaggcggctatggtggaggcgctggtggaggctactgtggtggtgctggcgctggtagtggcagtggccttggctctagcggcggtggaggttatggtggtggtgccggaggctgaagctgatgtggaagttgaggtggcatcggaagcggtgtgtgattcaacctcttacatccatgcatggcgtgtacatgcaagtgctcgacgcactgctctttgcattttaagcatgcgtggagtcaagctaatagcatgtgtgcgatataccgatcga

SEQ ID NO: 77502 - DNA, 452 bp, Zea mays
  Clone ID: LIB3079-003-Q1-K1-F4
gactagttctagatacgccgccatcttcgtaagccaccgcaaccgaagcccgccttcggcgggccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggcgggaagacgtcgcagatctacgccattcgccaggccgtcgccaaggggctcgtcgcctactaccagaagtacgtcgacgaggccgccaagaaggaggtcaaggacatcttcacccggtacgacc

SEQ ID NO: 77503 - DNA, 456 bp, Zea mays
  unsure at all n locations
  Clone ID: LIB3079-003-Q1-K1-F5
cccacaccgaggaaaggagaagagagcgagggtcggaataatggcggccgaggagggtggcgtgatcgcgtgccacaccaaggacgagttcgacgcccgcatggccaaggccaaggagcagggcaagctggtggtcatcgacttcatggccccctggtgcagtgggtgccagatgatggccccggtgtacgcggactgcgccagcaagtacccttccgcggtcttcctcgaggtcgacgtggacgaactgctggaagtcgcgaagatctacggcgtccatgtgatgccgaccttctgcttcatcaggaacggcgagacgctcgagagctttgctaccgtcgacgaggacgagctccgggacgccgtcaggaagtacgccgncgctggcactacgacggctcctgccttcgcgtncgcctaattcaggagatgtgatgtgtagcaaatagcgcgcgc

SEQ ID NO: 77504 - DNA, 464 bp, Zea mays
  unsure at all n locations
  Clone ID: LIB3079-003-Q1-K1-F6
cacagaccgccaccgccagtcgccattgctcactgctctgctcagcgctccatgtcgtggcccaaattccgtgactcatcttccttctctttgccaggctgcgcgtgcataccacggacggacgcactgcccccaatctactgtaagtaatctactaatctgtaaatctgtaatccctaatcctagctttgtggccatatatggacgcacgcaccgcccggagaaggacctgcccttgccgctgccgtcggctcgcacgcgcacgcccatgccccgcttgccgccgctcctcttcctgaacagcctgcacggcttctcctcggttgctgcaagcctgcaaagagctccgtggttgtaggctgtagcctactagcctctccctcccccacccncacacggccacacacttgtcacttgnngttttgtttggatattgttcgaatccctcgctgaaatcatgtatt

SEQ ID NO: 77505 - DNA, 463 bp, Zea mays
  unsure at all n locations
  Clone ID: LIB3079-003-Q1-K1-F7
cccacgcgtccgcggacgcgtgggcgagctcgagctctgctcggcccccctctgtgttggcgcttgtgcgacaacacgaacctcctcttttcctccacaaaacagcagccccgatcccctccgcatcgcgtgcttcgttcgacctgcgcagtcccaacccgcgccgtcgcgatggtgtttgagacagcccatgtcgtgtcgttgatctgcgcagttcgaccgtctacgcgtctcacttcgccggatctgcgcagccccaacatcgacgccgttcaccccggtgagacgacgatgatctttgtttgattccacatcggcattgttctccggtgattaaattgtgtatatgtgctgttttgttttattttattttgtggaggcgaggaaccccatgttttgcgtggagaagaaagcaagtcgtcaacgctcgtccgatgttncgagtgatgcacaaaatcgaatc

SEQ ID NO: 77506 - DNA, 368 bp, Zea mays
  unsure at all n locations
  Clone ID: LIB3079-003-Q1-K1-F8
ccaacccgaccgacgcattcgtacgtccgctcnatacatctctatctccttttgttaccgcaacctaaaccccccttcggggtgagtttctatacaatccgcgcagggtcctaaacatgtctactgtgctccagcgtccgacctcctgcacgtttcactgcttccatctcaagaacacctctgcacccaatccctacacctatcagcggcaccaacttatcatcgccaactgcgtccagattgagctcatcagaccgcacattctacatcttaatgacttcgaactcatccttctgccagagcactctacgttcaaggacatctacatgatgatacgtttacgacgccattttaagacatatcagatc

SEQ ID NO: 77507 - DNA, 435 bp, Zea mays
  Clone ID: LIB3079-003-Q1-K1-F9
acgtcacaaaaaccctcgctccccacaacccgtcgccgcccacgccgccgcctgtacgagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgctggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaaagtgattgggacaaatgggttgacgaagatgatgatggtgctgatgtcaacttggatgggatgga

SEQ ID NO: 77508 - DNA, 381 bp, Zea mays
  unsure at all n locations
  Clone ID: LIB3079-003-Q1-K1-G1
cccacgcgtccgctcaccgaggtgcgcatgaacggcacctgcgcctggctgaggcccgacggggagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcggcgggccccacggtgacgccggcctcaccggccgcaagatcatcatcgacacgtacggcggctggngagcccacggcggtggcgccttctccggcaaggac

SEQ ID NO: 77509 - DNA, 399 bp, Zea mays
  unsure at all n locations
  Clone ID: LIB3079-003-Q1-K1-G10
gcgatccgaagctcaatcaattcactcaaacctcttccccaaatcttcgattagatggtcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggccgacgtaccggggctgaagaaggaggaggtcaaggtggaggtcgaggacggcaacgtccttcagatcagcggcgaacgcaacaaggagcangaggagaagacggacacctg

SEQ ID NO: 77510 - DNA, 389 bp, Zea mays
  unsure at all n locations
  Clone ID: LIB3079-003-Q1-K1-G12
ccgaaacaaaaataatgcacagtttcatatctaagcttttgagggagaagtgtangagattaatgcattctgaatttaaaaagattacacaaagaaatagacgtatttctagaagtaaggttgaagtacatacctatcttacagtgaggttcttttttctttcagagtgaatatgatggtcattggagtaatggaatagttattgacagagaggaaagagaaacagtagttgtgtaattcctcgcagtgaagaaaaacaataatgtaagtgtatgctctaaaaatgaagagaaaactgcacaacctaacccagtttatatgaaactataactctgcaatgtgtcacttcgatccttagatatcctttaagttgggaacaaatagttttg

SEQ ID NO: 77511 - DNA, 409 bp, Zea mays
  unsure at all n locations
  Clone ID: LIB3079-003-Q1-K1-G2
cctctccctccgctcgctctctccctccctcggtcaaagccagcacgacaacgcagcaggctgggtagctgtccccctcgccctcatccctcctcggcgccgctgccggcccgcctcccccctcgtgccgctctgccgcggcgcattccgcgcccgcctcgccaccgaatcgggcggaatctcagcgggaccaaaatggggtcgccgggtgcggggagcagcggcggccacgagtgctccttcaagatcctgctcatcggggactcgggcgtcggcaagagcagcctnctcgtcagcttcgtcgccgccttccacctcgacggcgacatcgcccccaccatcggtgtggattttaaaatcaaagtccttacagttggtggaaagaaactaaagttgacaatatgggata

SEQ ID NO: 77512 - DNA, 436 bp, Zea mays
  unsure at all n locations
  Clone ID: LIB3079-003-Q1-K1-F1
ccagtcctcacataatcatcttcattcactcactctcttcgatcactgtactgaagataccatggccaagtcgaccgcgatgtttgtagccgccctggccctggtggtggtgatggcgacgacgagcacaggcggtggcagggcggcagcggcgtgcgatcccaagccgctggtggtgtgcgatccggcgttcatggacggagcgaaacccgcggcagcatgctgctccaccctgcgtgcgcaggaggcatgcttgtgcgtgtacgccaaagaccccaagtttgcaaaatacatcaacaaccccaacaccggcaaaacctttacctcgtgcggcatagccatccccaaatgctaagcaagcgctctgcgtcgtcgcttcgctagctcttgctctcgngtgtaacatatncagcttatgaantaaatatgtggatca

SEQ ID NO: 77513 - DNA, 422 bp, Zea mays
  unsure at all n locations
  Clone ID: LIB3079-006-Q1-K1-F7
gggggactactacagataccttgctgatttcaagactggagctgagagaaaggactgtnctgataacaccatggtggcgtacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagt

SEQ ID NO: 77514 - DNA, 339 bp, Zea mays
  Clone ID: LIB3079-006-Q1-K1-F8
agacggtctagaaagacaagcccatatgtttggaatggaatattatcgtttttatagattttgttaatctgttagtatgtgtttggctgcactctaatacatcatatatttcatccgtctcaaaaaaaaaaaaaaaaaaacaaaaaaaaaaaaaaaaaaaaaaaaaaaaaaaaaaaaaaaaaaaaaaaaacaaaaaaaaaaaaaaaaaaaaaaaaacaaactaataacaaaaaaaaaaacaaaaaaaaaaacgcctgcccttttaaagaacccaagctaacgaccccgaccatgcaacttataacgttttacatggggcccccaaaattaaatcacctg

SEQ ID NO: 77515 - DNA, 397 bp, Zea mays
  Clone ID: LIB3079-006-Q1-K1-F9
atgatttggggatactgcaccgtgaatcaactgatgacaaggtcacagtggaggctggggaggctactctcaagtacaacgtggctattaagtgtgcgaccattactccagatgaaactcgggttaaggagttcaatctgaaacacatgtggaagagcccaaatggcacaattaggaacattataaatggcactgtgttcagagagcctattatatgcaaaaacgttccaagacttgttccaggatggactaagcccatctgcattggaaggcatgccttcggtgatcaataccgagctaccgatgcagttctgaaggggcctgggaagctgaaactagtttttgagggaaaagaagaacagattgatctggaggtattcaacttcactgggtgctg

SEQ ID NO: 77516 - DNA, 341 bp, Zea mays
  Clone ID: LIB3079-006-Q1-K1-G1
ggcgaagctggtccctgaaaccaaaggtaagacactagaggagatccaggactcactaagcaccataagatagtaatgaatttacttcacactacagaataattaattctaagatggaaaaatgggaatttacaggacacagcagaataattccaagatggaaaacgaatgtaccgtcagacctctgctcatcgatagatatgtatacaagaaacaatatatataattctcacgtcctcccgcttcccctccctttctctcccgcaccacctccgtgtaatacgtagtgtactgtgtaccctatgtaagttaaggaatgctgcagattcagattacgcatt

SEQ ID NO: 77517 - DNA, 410 bp, Zea mays
  Clone ID: LIB3079-006-Q1-K1-G11
ctgttgttcaggagaaagtaccaagtgctcatggagttcagtctgacaatgatcctagcaatgcatccatttttgttggtggtcttgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgcaaggcaccttggttggaaggcagaatgtgaggctttcatggggtcgcagcccttcaaacaaacaagttcagcctcaacaggactccaaccagtgggccggggctaatgctggatattatggctacggtcaaggctatgaggcctatgggtacccccagtctcaggacccttatatgtat

SEQ ID NO: 77518 - DNA, 309 bp, Zea mays
  Clone ID: LIB3079-006-Q1-K1-G12
cggcgacctcccgacgcgtgctcacctcctcttcggatcgtggatccgctgctgcgcggcgggaataatcaattccgagtgaaataaattacatatagccatctagaagagagtcctttctaggtgagtaggtgtcctcttacgcgtgggtgagagaacccactaggagccacagccacctaacagtctgttctcctgttgaatcggaaggaccaaagccgacccaacgggatcaaaatttgaatttgaacccgaacaacggaaggagtccgaggcccagtcatggaggaggagaaccaagtgatggag

SEQ ID NO: 77519 - DNA, 360 bp, Zea mays
  Clone ID: LIB3079-006-Q1-K1-G2
cacgcgcgtcgcgtcggccactgctcctctttccgcgcgcgcctgtcggcgccgactggtcagatcgtgccggcgtaccggaacctgctgtcgggcaagtgcgcggcggcggcgggcggcgccgacgaccccgtggtggccaacaacgtgcgcgacgaggacccgcgcgccgtcgcggcggccttcccgtccttcctcgggaagctgcgcaaggccagggactttctggacaacagctactaccacaacaacctggcaaggatcgtcaccttcaactccgactggcaactgctcacggagaaggaggcgctggggcacgtcaaggagtacgccgagaacggcaccctctgggacgaggac

SEQ ID NO: 77520 - DNA, 432 bp, Zea mays
  Clone ID: LIB3079-006-Q1-K1-G3
ccgacgcgtccggcccgtgcacaggtgggcgcccgccgccacctgcggctcggtggagtcgggcatcgacacccctggcccccagcgccgcagatcgcaagctctcagcaacgcgtgcttggtaggaacccgtgccgaccgactcttcctctgcgggacggtctcgagtttggtcgggagatgggtgacgggagctgctgcgtctgcaaggaggcgccgcccaagtacaagtgcccttcttgtcgcacgccctattgctctgtcacatgctttaaaaagcacaaagaggaatcttgtcaaaagatattgcatcaggaagaaattagcaagtcagcattgcaggaggaagttacactgcacaccacatgcactgcagaatctccaaatacagcgtgccctacaaaagctcttgaagttgaggacctaagctgg

SEQ ID NO: 77521 - DNA, 390 bp, Zea mays
  Clone ID: LIB3079-006-Q1-K1-G4
gatgtcttctcttggataagctgtttggatcttcgcactctcctgtgctgacaaatggaccctgtccagctcaagtgagccacataatatatctttccattacttaatacctgaaggaagcatactattagacataccggtatatattattgttcttagtcatcgcacaagactcttgtcaacaagaccaacaacaggatgaggactgccgtgcatgctgcgctttgcattgtgcttgtgataatgtcttcaacactgtcatcttgcgaggacgatgagaaggtatctatcgcatgtgacacaggatgcaatgccgcgatctcccgtctcaaatgcttcctgatggcctattctgaagggaaagtgttggtcagcagcaactgcgaaacg

SEQ ID NO: 77522 - DNA, 433 bp, Zea mays
  unsure at all n locations
  Clone ID: LIB3079-006-Q1-K1-G5
cggacgcgtgggcgcgtccgcgtgctctctgccccctgcccccctcccatctgcgccgccctcctcatccaccgcccgggccgccgccgccagcccaaggccaggcatccgccagcctctcgcaccacgcgtatcgcgtgcccgcccgaccggctcgtggcgatggcgtaccgggcggacgacgactacgactacctattcaaggtggtgctcatcggggactccggcgtcggcaagtccaacctgctctcgcgcttcacgcgcaacgagttcagcctcgagtccaagtccaccatcggcgtcgagttcgccacccgcagcatccacgtcgacgacaaggtcgtcaaggcccagatctgggacaccgccggtcaggaaaggtaccgtgctatcacgagcgcgtactaccgcggagcagtangggcgctcgtcg

SEQ ID NO: 77523 - DNA, 393 bp, Zea mays
  unsure at all n locations
  Clone ID: LIB3079-006-Q1-K1-G6
gtgaagttggaaaaggaagctgaaattttggctgcacaggatgatggtggtggtgagtcattggagcgtgtttatgagacgtctagatgcaatggatgctggaactgcagaaaagcgagctgctgaaattttatttggtctgggttttgacaaacaaatgcaagcaaagaaaactaaagatttctctggaggttggcgtatgaggattgctttagcaagagcactgtttatgaatccaacaatccttttgcttgatgagcccacaaaccatctagatcttgaggcttgtgtctggttggaagagacactgaagaaatttgaccgcatacttgttgtcatatcacactcccaagattntctaaatggagtgtgtactaacattatccatatgca

SEQ ID NO: 77524 - DNA, 406 bp, Zea mays
  unsure at all n locations
  Clone ID: LIB3079-006-Q1-K1-G9
ccgacgcgtccgcccacgcgtccgcgctcgagggttcggtttcgtggtcttcgctgaggccactgtcgccgagcgcgtgaccatcgaaaaacacatgatcgacggccgaatggtggaggccaagaaggctgttcccagggatgaccacagtattgtgagcaagagcaacacaagcagcatagggtcacctgggccgggccgtaccagaaagatctttgttggaggtctgccctcaaatgttacagaggctgacttcagggggtattttgagcagttcggtgtcataactgatgtggttgtgatgtatgatcacaacacacagagaccgangggctttggattcatcacctatgattcagaagatgctgtggacaaagccctgcacaagagctntcatgagctaaat

SEQ ID NO: 77525 - DNA, 436 bp, Zea mays
  unsure at all n locations
  Clone ID: LIB3079-006-Q1-K1-H1
gcgcaaggagcaacggacgttgctgatgagacacgccagcacgtggtcatggctggggtcgcgaccgggatgctcttcacgaggaagagcttgcttccagggacagccctaccggaaggtaccaagttctgcggccacggcttcctcgatcccgagaggtttgaactacgagcggatgcggatgccatcccgttcagctacagccagctcgacaccatcctgaggatgtttcggatccctcgggggtccaagaaggcagagcaagtcgccgncacgctccggacatgcgaggctgagtccncagaggctcatgcctgcgccacctccgagcaggcggcggccgacttcgctgcctnctcgctcggggtcagggccagcaagctggtcgcgctcgtcaccaccgtccatggggngaaagacgccactagatacgtgg

SEQ ID NO: 77526 - DNA, 394 bp, Zea mays
  unsure at all n locations
  Clone ID: LIB3079-006-Q1-K1-H10
cggacgcgtgggcggacgcgtgggtctacgtcggtatcctcagcatggcagtccatgggtgggaattctgaccatgcagaaacttatgaagaagtttccccaggatttggagactgccgacgcaagcctttctgcttctcagaacactgcagcatcggtcgttccttccacaccgacttccaggacttcaccatgcaagcttgaggggaggaagtctcgccaaatgatcgcgagcgggattctgctggttggaagcatcgcttgtctatctcgaggccgatccaacctcggggcgcagctcgcgatggccttcttcctgaaaaaggccttcaagcaagagaggcaatcaagctcctcatcgacatgaatggtgnaaacatacgtgactagatgc

SEQ ID NO: 77527 - DNA, 423 bp, Zea mays
  unsure at all n locations
  Clone ID: LIB3079-006-Q1-K1-H11
cccacgcgtccgatttgcgccgccgcagcccgcagtcgcttgcgcgcagcagcacttggcaccgccgccccatcccattgccgccagtgtctgctcgatccgatggctcccacgaagaagtcgaagaagagcacagagagcatcaacaacaagctgcagctggtgatgaagagcggcaagtacaccctgngctacaagaccgtcctcaagacgctgcgcaactccaagggaaagctgatcatcatcgcaaacaactgccctccacttaggaagtctgagattgagtactacgccatgctggccaaagttagtgtgcaccatttccacggaaacaatgttgatcttggcactgcctgcggcaagtactacagggtgtgctgcctcagtatcatcgacccangtgactcggacatcatcagtacc

SEQ ID NO: 77528 - DNA, 360 bp, Zea mays
  unsure at all n locations
  Clone ID: LIB3079-006-Q1-K1-H12
agaccattagctttatctactccagatcgcataagaacccgatcgacaccatgagggggttgctcgttgccctcgctctcctggctctcgctgcgagcgccacttcacgcatacaagccgcggctgcggctgccagccaccgncgccggttcatctaccgncgccggtgcatctgccacctccggttcacctgccacctncggtgcatctnccaccgccggtccacctgccgncgccggtccacctgccaccgncggtccatgtgccgncgncggttcatctgccgncgncaccatgccactaccctacttcaaccgcccggcctcagcctcatccccagccacacccatgcccgtgcca

SEQ ID NO: 77529 - DNA, 318 bp, Zea mays
  Clone ID: LIB3079-006-Q1-K1-F6
tagaaaaaaaaaaaaaaaaaaaaaaatataaaaaaaaaaaaaaaaaaaaaaaaaaaaaagcaaaatttaaaaaacaaaaaaggcctacctacttcatccatccaaccttcatctaccatccttccaacatcaactctctcattttaccccacctaaatcacaattctttccccctccaattcccaacactcactattcttaaaaccctatacttacccaacttaatcatcttccacaacatacacctttctccaccttaccaaatttctaacagcccctacttcatctcccttactaactacttctccactctattct

SEQ ID NO: 77530 - DNA, 421 bp, Zea mays
  unsure at all n locations
  Clone ID: LIB3079-006-Q1-K1-E11
ccgacgcgtccgcccacgcgtccgcccacgcgtccgtggaaacccaggtgcagctgggtctggttaccaaggtggacatccaggctcaaatagaggaccttggggcagtcaagctccatctgcatatggaactggagggtatggtggcagtgctgggtatagtgcttggaacaactcttctggtggcggcaatgctctgaatagtcaagcccctggtggacctgcaggctatggaagccagggctatgggtatggtggatatggaggggatccatcatacgctagtcacggaggatatggngcttatggagcacgtattgatagtgctggcaatcctgctactggtggatcatctggatacaatgcangctatggaagtggtggtgccaactctggctattcaagtgctnggagtgatcct

SEQ ID NO: 77531 - DNA, 425 bp, Zea mays
  Clone ID: LIB3079-006-Q1-K1-E12
ggaaggcgtttaatgtggcagaattctttgggacactgtgtcttgaaagcagactgtgccaaatgcaaaaaggaacttgcagtatcattgttccagagcgtggttttgatgttgttcaatgacgcacaaaagttaagcttcattgacatcaaagattccactggtatcgaggataaagaattgagacgaacattgcaatctcttgcatgtggtaaagttcgggttctccaaaagataccaaaagggagagatgtagaagataaggatgaatttgtattcaatgaagattttagtgctcctctctaccgcataaaggtaaatgcaattcaaatgaaagagacggtagaagaaaacacgagcaccactgagagagtgttccaggatcggcagtatcaggttgacgcggccatagttcgaataatgaa

SEQ ID NO: 77532 - DNA, 352 bp, Zea mays
  unsure at all n locations
  Clone ID: LIB3079-006-Q1-K1-E2
gggagatcgcgcaggacttcaagaccgacctacgcttccagagctctgctgtctccncgctgcatgaggcggctgaggcctaccttgtcgggctcttcgaggacaccaacctctgcgccatccacgccaagcgcgtcaccatcatgcccaaggacatccagcttgcccgccgcatccgcggggagagggcctaagcgtcatattttctgtcatcagtgcccgatcagaagatgtagagatatgctgggttctgtagtttgggttactgtcgaatcatcgagtgttggctgttcactgctgtaacttaattatcatgatgcatatgaaatggcaatgaactctgttatcagtt

SEQ ID NO: 77533 - DNA, 416 bp, Zea mays
  unsure at all n locations
  Clone ID: LIB3079-006-Q1-K1-E3
cccacgcgtccggtgatatggacattgtcatgggttcggctgtgtgcaccaatgttgggcgagagctggggagcgggcctgcccaagatgagcaggtgaagaagaagcggggtaggccaaggaagtataagcctgatggggcggtgactctcgggttatcaccctcttcatcattaacacctcactcggccagcttggggatgggaaccatgattagtgctccaggttctggatttgggtcggagggatcaggggcttcaggcttgggtgcgccatcagagaagcgtggcaaggggcggccacctggctctggaaagatgcaacagttggcttcgcttggaaagtggattcttggctctgttggaactggttntactcctcatgtgattattattcagccaggagaggacgttgct

SEQ ID NO: 77534 - DNA, 186 bp, Zea mays
  Clone ID: LIB3079-006-Q1-K1-E4
gtggccaactattgtaagaggccgttttaacctggctacaagtgcgggagttatacacgtcctcttagtatgtaaaaggagtggttgggacatgtggtactctctcctagaactttaatttgagatttgtaacatgtgagagactattgagaataatatgtatggagtaatatgcttccttctttt

SEQ ID NO: 77535 - DNA, 432 bp, Zea mays
  unsure at all n locations
  Clone ID: LIB3079-006-Q1-K1-E5
gagtccgcagccaccgctcctctcctctcgtcgcttcttctatctctcggcgtcgaagctcatccggccagtgaccacgctctactagccgcccggaaggagttcttccgggattcgagccgttgctgccctcacctctgcaggcccagcgtcgagcggagatccaatcggaaattgaactgacttcatcttttgtcgcatcccagtcaggagaagcaatgtcaggagtgatcacaaagttcgcggttacatccatggtgatgtggatggcccctgttgcgatcatgtatgggttttactaccaggtgtttccaggtgtgagtcagatgtcatcctcggcgcagacacttgccagtgggttcctggctgtcatatcagttaatctagtgatcggctnttacatattcatggcgatgaatgagactccacacc

SEQ ID NO: 77536 - DNA, 417 bp, Zea mays
  Clone ID: LIB3079-006-Q1-K1-E6
ctgaattctgatatcaaagaagataaatttcatctggaaggcaaacgcgtattggaggttggatgtggacatggcctggctggcatttttgcgggtctcaagggtgctgacctgattcatttccaagatttcaatgccgaggtgcttaggtgcttgactataccaaatgtaaaagtcaatcttttcaaggattcaccagaaggaacatgtacatgtccgattgttggtttctttgctggtgattggagtgaaatggataagctactactttgcggggatgctgagcaagacaaaacagccagtggtgatacagaaggtaaaatgtgtaatggttatgatatcatcctgatggctgagactgtttacgcggtatcttgtcttccaaatctctacaggctcatcaagaagtgcttgcgc

SEQ ID NO: 77537 - DNA, 416 bp, Zea mays
  Clone ID: LIB3079-006-Q1-K1-E7
gtgtctgcttttctcgctgatctaaatgctgtttcttcagcctcagctttgtgttccgcattccaaaatgcttcttcattcatggaaccagtaaatctagaagctttcagttttcaaggggcacaaagtgattctgttttgaacaaaacaacacatccaaatgggaatatctcagtatttgacagtgctgccttggcatcactacatgatagcaaagagtttatcagtggtaggctcccctcatttgctagtgtccaggaaacaaacgtagctgctagtggtttcaagactcagaagcaggagcaaaatgcagtgtgcaacgttcctatccctacgttcactgcacgtaatcaaattgcagttgctgcaatgcccggatcactgatccctcaaaagattccttcatggatcaatga

SEQ ID NO: 77538 - DNA, 431 bp, Zea mays
  unsure at all n locations
  Clone ID: LIB3079-006-Q1-K1-E8
gagtaacgaacgaactcttgctccgatcacgagctagctgaggtcgacgatggctggtntgctgaacagcaggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactgcaacangatcagctaagttacgacga

SEQ ID NO: 77539 - DNA, 287 bp, Zea mays
  Clone ID: LIB3079-006-Q1-K1-E9
aaaaaaaaaaaaaaaaaaaaaaaaaattttaaaaaaaaaaaaaaaaaaaaaaaaaaaaaagcaagattaaaaaaatataaagagatacaaataaaaaaaaaaatacatacaacataataaacatacataaataaataactaaatacaattaaataacaaaaaattttacaacttttaaaactgctaaaaccttgaaactacccaacttaatctcctagcactaaatccgccttttaaaaaatactttaatctccaaaaatctcacccctatctcctttaaaaacatt

SEQ ID NO: 77540 - DNA, 309 bp, Zea mays
  Clone ID: LIB3079-006-Q1-K1-F1
ccacccactcatccgaaaaaaaaaaaaaaataaaaaaaaaaatttttaaaaaaaaaaaaaaaaaaaaaaaaaaccgacaaatttaaaaaaacccaactcaacaaacccatacaaacaacaacatacatactacaaaataaccacctacaaacacttcactaaatcccaattacacacaccacttactcaaaatcccttactttaaaaacacttccattacctaacaaaaaatccccctaacaaaaacccctttaaacacaaaaaaccctaccccaaccccccttaccaacctttccccacacccaattt

SEQ ID NO: 77541 - DNA, 435 bp, Zea mays
  unsure at all n locations
  Clone ID: LIB3079-006-Q1-K1-F2
aatgttaccagcaaattcctgactcctttatgggtgacccaaacttgattaggtacctgggagaggaccatcaaggacttgggaaaggccaaggttttgaggaggagcagcaagggcgtccacaacaggaaggagatcatgtcccagtcggctgcgactctatctcgggttccaggaccagtatgcactaaaatggacgcccaagatgcatccggtctccgattgcgacggactggacatggttggaaagataacgagattaaccaccccaactggttccaccctaaaattcatccggagtcaacgggaatcgtcgaaacaagtcagcgttcagattctgttttggtgctgcgacaccgtctgttgngttgttgggtcgagtatcgcgtcggagcccattangggcgagtccagngctacgcacgcnctaatact

SEQ ID NO: 77542 - DNA, 419 bp, Zea mays
  Clone ID: LIB3079-006-Q1-K1-F3
gcgataatgggctggttactgctttcatgtcgaatctgattacttctgattgatgcatgtcctttttggctgttggctggcgaatgctttcagaaaccacctcttctgtttagctattttgggcagtaagtcaagcagtgctttgtattttgtaaataggcattctttatgttaataaatctgtatagaaacaaaattggtcattcaataatcaatagtattatcagaattacatttctgtactacaacaattattttatcaaacaagttaaaaaactatcttgggaattttatccaacctatttttttctaagtcatgtttaggaaggtaggtttgtaatttttactattacaagcagttatactaattgctattaaatactactcaatttacatttagcattctgtattcagtgctg

SEQ ID NO: 77543 - DNA, 430 bp, Zea mays
  unsure at all n locations
  Clone ID: LIB3079-006-Q1-K1-F4
gtggcagatcggtgctcctctcaccactaggccgccacagctcgccggctttcccctcgctgccatcgagcaccacctgggacgctctccgcttgatctccccttcctgctgcggagccgtgcgagcaaaccttaacgtagtccgtaggtacgccctccccttgttcttcccttcctcctgtgcgaaaccgtgcgtccaaaccctaacatactattcgtactcggacctaaatctaatgacaagtgtatatgcatgcattacgcctacagccaactaacttcgattgctctgcaaaaattatggagtgtagtgtacatgtgtatacccatgtccttcactgagtccacccctgcttgacagagcaaacagagcaaggaaatagtttaaaatggctgcgcggagcagntctatgggtgccgaggatgacta

SEQ ID NO: 77544 - DNA, 428 bp, Zea mays
  unsure at all n locations
  Clone ID: LIB3079-006-Q1-K1-F5
gaggctctgccttgtcgatcatccatctaccgcctcctgctcggcttcccacccctgctgcctgcgttgcacaccagggaggagctcctccgaccgaccggccatgagctaccaggctcctcctccgggcacctcagcctacccgccgccgggcacggcctaccctccgccaggccagccgcaggcgtacccgccgccggcatacggcgcgccgccacccatggccgccggcgggtaccctcccccgccgcagcaggactctaagggcggcaacgacggcttcctgaaaggatgcttggccgctctctgctgctgctgcatgctcgacatgtgcttctgagttcgtcgtcaggggctcagggcacggngatggcgcgcctagagtccagaccgatctccatcatgcagtcaggcgaaaaacaatgcat

SEQ ID NO: 77545 - DNA, 431 bp, Zea mays
  Clone ID: LIB3079-006-Q1-K1-E10
ccgacgcgtccgcatcataaatcatccttcagggtggcgacgtctatgctggggtgccgaaggattacactgggcgagaggtcaacgtcgacaatttcttcgctgttctgcttggcaacaaaactgctctcaggggtgggagcggcaaggttgtggacagtggccccaatgaccatatatttgttttctacagtgaccatgggggtcctggcgtccttggaatgcctacgtatccatatctctatggtgatgacctcgtagatgtcctgaagaagaagcatgctgccgggacctacaaaagcctggtcttttatcttgaagcatgcgaatctgggagcatctttgagggccttctgccgaatgacataaatgtgtatgcgaccaccgcgtcaaatgcagaggagagtagcttggggacgtactgccctggc

SEQ ID NO: 77546 - DNA, 430 bp, Zea mays
  Clone ID: LIB3079-006-Q1-K1-C5
gaggaagatggtcttcgtgataaacatgctgatgtggctcgcgtgcctctgcatgtgggcggccttcatagcgctgacctacgtcgtcgtgggccgagacgacgagtggctggcctggtgtacgatggcgatcggcaccgtcatcatggtggccactctgggttcaatgtgctactgcattgtcgctcacaggatggaggagaagagcatgaggaggatcaggaggacctccacgagccagtcgtggtccatatcgatcgactccgaaacggagctgatgaacagcgagtacaagaagatgtacgccatttaggataggcaacggccatgcttgccatctgagtcctgtatatactggtacccaaagtccatggcattggattgactgagctatattttagtccgtagacatggcacctgtatgtaactg

SEQ ID NO: 77547 - DNA, 430 bp, Zea mays
  Clone ID: LIB3079-006-Q1-K1-C6
cccacgcgtccgcccacgcgtccgctttggcgcccgttcaggatccacatcttccctgtcgagttcttggttgacctggtcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcaactccagggtgatcagaggaagaacgtctcga

SEQ ID NO: 77548 - DNA, 434 bp, Zea mays
  Clone ID: LIB3079-006-Q1-K1-C7
ccgacgcgtccggccgcgcgctaggctcacgagcgcgaacacgaacacgaacaccagaacgcggcggccatggtgggcggcggcggcgacccaaggccggaggacgagcccttctccgacggagacgccacggagtcggacaccgacgagtctcctccgcaggggattagtgctcgccgccccggcgccaccactaacccgatcctgactcgcctcgcggtgtcgcggaacccgagcccgctggccgcggccaccgcggcccccggggtgtgcctcctccgcttcgcctgggagtccgccgcgggatccctcgtcggcgccgttgtcggatacggtaaaggtctggtcatgaggaagggttttaaaggatcatttcctgatgctgcttcgtctgctaagatatttgctgtccttgctggcgtacaaagtttggt

SEQ ID NO: 77549 - DNA, 435 bp, Zea mays
  Clone ID: LIB3079-006-Q1-K1-C8
ccgacgcgtccgagcgcctgtctgttgtctatggcaagaagtccaagctcggtttcggcgtgttcccatccccccaggggtccacatccgtggttgagccatacaacagtgtcctgtccacccactctctcctcgagcacactgatgttgctgtcctgctcgacaatgaggccatctatgacatctgccgccgctcccttgacattgagcgcccaacctacaccaacctcaacaggcttgtctcccaggtcatctcatccctgacggcttccctgaggttcgatggtgctctgaacgttgatgtgaacgagttccagaccaacctggtgccctacccgaggatccacttcatgctttcgtcctacgctccagtcatttctgctgagaaggcctaccacgagcagctgtccgtggctgaaatcaccaacagcgcct

SEQ ID NO: 77550 - DNA, 299 bp, Zea mays
  unsure at all n locations
  Clone ID: LIB3079-006-Q1-K1-C9
gtgatgtagagaacatccttgttgaaatgggaacatactttcaagtccaggatgactgtctggattgttatggtgatcctgaatttatcggcaagattggaacggacattgaagattacaagtgctcatggctagttgtgcaagcccttgagcgtgctgatgagagccaaaagcgcattctatttgaaaattatggcaagaaagatccagcctgtgtggcaaaagtgaagaacctctacanagaacttgacctagaggcggtatttcaggagtacgagaatgagagctacaagaagctg

SEQ ID NO: 77551 - DNA, 398 bp, Zea mays
  Clone ID: LIB3079-006-Q1-K1-D1
ttccggctcgagccacgcgtccggagccgatgaacatgggagcatacagctacatcaacccgcggttgctgacggcgattagggttctgggccggggtggcatcgaggacatcaagtacgtcggcagggccccgtcggctgctaccgcgacgggcttctactcggtgcacgtgcaggagcagacggagctggtgcagaaggcgctgcagcgcgaccccctcaactaccctttctgaaagaaacgaggcccctgtagattcttggaattggggaccttttgaatttgatataataccaatatagagagaacatgccttaaattttatctgtgcagccatttggtgaaataattgtttcgactctgcagtaccgcatgaaacaaaccgttgtaagtttgg

SEQ ID NO: 77552 - DNA, 420 bp, Zea mays
  unsure at all n locations
  Clone ID: LIB3079-006-Q1-K1-D11
ccgacgcgtccgcggacgcgtgggccgtcgctaagaagcccaaggccgctgccaagagcaaagctaagacccccgccaaggcgaagcccgccacaaagcccaagcccgccgcgaagccgaaagccgtagtgaagccgaagacacccgccaagcccaaggccaagccagctgccaaggcgaagcccaagaccgtcggcgctaagccgaagccacttgctaagaaagccggccgccccgccaaggcggcgaagacgtcggccaaggacacgccagggaagaaggcgccggtggccaagaagtccgctgctgccgcgaagaaggcccctgccaagaaggccgctccctcgaagaaggcggcgacccccgtgcggaaagcgccgtnccgtaaggccaagaagtaaagcggccaagaaggggggc

SEQ ID NO: 77553 - DNA, 285 bp, Zea mays
  Clone ID: LIB3079-006-Q1-K1-D12
gcgtcttctccggcggcgaccagtactatctaccatgggtaaagcgagtcggcgcgagatgcattacgcagcatgtgtactgtgcgcgtgcaaatccagaatgacgtagctctgacgtgggctcgcaatattgtcgcgagctctttacaatcatgatgataactatgaggaataaataaaacagaaaatcgactgaacacataggaaaacaaagtgtatcaaaatgctgaactcaataataatgcatctacatgcttatctaaggcacgtccattttagagggcc

SEQ ID NO: 77554 - DNA, 313 bp, Zea mays
  unsure at all n locations
  Clone ID: LIB3079-006-Q1-K1-D2
ccgacgcgtccgcccacgcgtccgctccttcagacctcgcgctccgccgagaagatgtggaagatcgactcccacctggcgtgcgccgtggccgggatcatgtccgacgccaacatcctcatcaacaccgcccgcctccacgcccaacgctacgcgctctcctaccaggaacccatccccgtcgagcagctcgtccagtccctctgcgacaccaagcagggatacacccagttcggaggcctncgccccttcggggtctccttcctattcgccgggtgggacaagcaccacggcttccagctctacatgagcg

SEQ ID NO: 77555 - DNA, 360 bp, Zea mays
  Clone ID: LIB3079-006-Q1-K1-D3
taagtaattaaagaatggcattaacagttttctataaaccacttaaaaaattataataatccgacaatttcaccactttttagagagcatcaaagattctgtcttcccaactgagcttatacccttttttgacaaatctatactgaatgtcaatcttgtccctactgattaagaatttactgagccattcaagcattctactccttttgaaaggtaactaataaacctcatcgaaccttctgataataatacttccaatgctacttcttattcttctgcttccactagtacaactgcttctaggactatcacaatgaaccattctttaccatcaaccttcctacaaatcacgttctcaaa

SEQ ID NO: 77556 - DNA, 294 bp, Zea mays
  Clone ID: LIB3079-006-Q1-K1-D4
cagggtatttctctctgacagaagttcctgattccctcggcagtggcgtggttgcctaggtttgctgtctgtttttgagctactcgttttttcgctgtcttgtgctcgctgtcttccgtggtgtttcagtagcaatggaaaagggtgagtgagcctgtgttgtgttacaagcatcccagttcaatgggaaaacaaacacataagacatgaaccaactgaacagcttgatttaatggaaaatgctaacacaactaacatgacaaataaaaaacagatataacaagaacaacagat

SEQ ID NO: 77557 - DNA, 362 bp, Zea mays
  Clone ID: LIB3079-006-Q1-K1-D5
ctgctgttcatattttgtcactcaaaatattcatctggtccacactttgtaacagttgaccagtcgtgaaggacagccgagccaatgttgcgtttgatctcaagaatgacgtcatccaagataagatggtctcatatgagttcatcccattaactttaatgggatgactttatcctttctgttgtactaatgtgcttgtaagatgagaaagtatctagatctttagtggttttggtgattaatgccaacacaagattattgtaactaacatgtgtgtttacaaagataaattaatgttaggtcacaatgatgaaaaaaaaaaaaaaaaataaaaataaaattaaaaataataaacataaaaa

SEQ ID NO: 77558 - DNA, 433 bp, Zea mays
  Clone ID: LIB3079-006-Q1-K1-D6
ccgacgcgtccgcccacgcgtccgagaaaatctagatttgcaccttactccatacgcgggttcttgcaactggacaagatgaagggatgcttgaatttattagttccagttctcttgcacagattctatcagaacatcgcagtattacaagttacctacagaagttccatcctgatgaggatggtccttttggtataacggctcaatgtttggagacattcataaaaagctgcgccggttactctgtcattacatacatattgggggttggagacaggcatctggataatcttcttctaactgatgatggacgcctttttcatgttgactttgcttttatccttgggcgagacccaaagccatttccgccaccgatgaagttgtgtaaggaaatggttgaggccatgggtggtgcagaaagccaatattacac

SEQ ID NO: 77559 - DNA, 424 bp, Zea mays
  unsure at all n locations
  Clone ID: LIB3079-006-Q1-K1-D7
ctgagctgtcgaggaggtggtggtggttgccttgtgagcttctagtaaataccaatcgtctttgtatgttgtgtggatggtggttggcaacgttgtttatttatgcgcaagctgctgctggtttcgggatggaaggaaagacctggtccctgaaacaagctgctgagagtgagcctgtcagtgtattgtgtctggcgtggtcaagaaccaaatcaatgttggaccgaccgactgagagtttggagtgtgtatgttttgctattactcttatctctagtagagtgtgggtatacctgggcagaatgtgtccccaaaagttgggggcctgtctgtgtactgtgtgcgatggacgccctaagtaaaaaaagggcangtgatggtcgtgctccaggtttgtgttttgtactctgttgtaccttgaacc

SEQ ID NO: 77560 - DNA, 431 bp, Zea mays
  Clone ID: LIB3079-006-Q1-K1-D8
gcgggcgcctggtttccggtttccctgtagtgaaggaagaggaagcccaaccccgagacagcatcgtacaatcaggctgatgcttgttggaactcagctgttgatgcttgtaagcctcgctgcctggctgcgtcctgtgctgtagatacgagatcccgcagcgttcgtttgttgcacttgcaccggcttgctgctagcttgcgacaggactaggaggagctagccgaggaggaggtgtgtgactccatggacgcgggccagcaggatgcgtgggactgggactgggaggtcctgctgccagaccacaggagctcatcctccgtgcgccaccaccacggcagcaacaataatacccttgacgatcaagaagaagcagaggagctcgacctgctgctgcctgcgccaggaggggacgacgtcgttgacgcgca

SEQ ID NO: 77561 - DNA, 419 bp, Zea mays
  Clone ID: LIB3079-006-Q1-K1-D9
ccgacgcgtccgaacgacttcaagcattcaggggagaggtaccgctcctgggacgccggccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaaggcaaacatgtgatgcttctgctgaatagaataataatgaagacgcatgcatgtcgtcgccaggaacaagagaaataatacaagaccaccacgcatgggcatactccatatatatatgtatagcccgtgcccgtgtccgcctttgtaccaatacaagccaagactagtggatgtattattattattattattgcgctatcacatacatgtacccct

SEQ ID NO: 77562 - DNA, 97 bp, Zea mays
  unsure at all n locations
  Clone ID: LIB3079-006-Q1-K1-E1
ccgacgcgtccgnccacgcgttcggctgaacacagcgctgtaaagtagtgttggtgtggtaaattcagaatgtgtaagttgaatttatgttattacc

SEQ ID NO: 77563 - DNA, 381 bp, Zea mays
  unsure at all n locations
  Clone ID: LIB3079-006-Q1-K1-C4
caggtctgaagtattatgacacataccttcctttccttttggaggcatcaaacgatnagagttcatatgttcggcaggctgctgtctatggtgtgggtgtatgtgccgagtttggtggtcatgtttttcgccctctagtaggagaggccttatcaaaattaaacaatgttataaggcatcctgatgcacgacttcctgataatatcatggcatatgacaatgctgtttcggcgcttggaaaaatatgccaatttcatcgggatggtattgatgcagctcaggttgttccagcctggcttagctgcttgcctataaaagacgacaaggttgaagctaaagttgtacatggacagctttgctccatggtggaaaggtcggatg

SEQ ID NO: 77564 - DNA, 400 bp, Zea mays
  Clone ID: LIB3079-006-Q1-K1-B1
ccagggggtctgccaaatttttaaatccaatggttccgtatacatccaaaaagaaagcaagggggagattatttcaggtgccacaagaccagtatatgctctagagccacatgacgtaggacgctatttgcaagctgaaatcgacgtaggcggcgaaatcgcagtagcaaagactgctgggccagtagaccctgatgctgggttggttgattatgtggagacgctcgtaaggaaacctgaaactgaattcaatgttgttgtgcttcaatccaatggcgtcgatcagccaaaagagtcggttcatgtactaaatgtcgggaggctgcggatgaggcttactaaagggaagtcggtagtcgccaaggaattctattcctcatcgatgcagttatgtggtgtg

SEQ ID NO: 77565 - DNA, 389 bp, Zea mays
  Clone ID: LIB3079-006-Q1-K1-B10
ggcgccgacaacagcgtagtgtagtgttgttccggagagggttggggagagtagtagggatccgcaatgtcgacggaggaggctgttgtggctgaagtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgc

SEQ ID NO: 77566 - DNA, 415 bp, Zea mays
  unsure at all n locations
  Clone ID: LIB3079-006-Q1-K1-B11
ccgacgcgtccgcagacaaatgcacactatcttattaggtatctagctactgcagttggtgtcaacaaaaggagaaggaatatgcttaaagagttgattaaggtcattcaacaggagcaccatagctacaaggatcccgtaactgaatttctggaatgcttatatgttaactatgattntgatggtgctcaacaganactcatagagtgtgagcaggttatactgaatgatccattcctgggaaagcgcattgaagagggaaattttgtcagtgttcctttgagagatgagttccttgaaaatgctaggctttntattttcgagacatactgccgtatccatcggtgcatcgatatcagcatgcttgctcagaagttgaacatgagctacgatgaggccgagttgtggatcatga

SEQ ID NO: 77567 - DNA, 155 bp, Zea mays
  Clone ID: LIB3079-006-Q1-K1-B12
aaaaaaaaaaaaaaaacaataacaaattttattaaaaaaaaaaaaaaaaacaaaaaaaagaaggcttaataaaaaaaaaaaaaaaactttaacaacttcattaaaatccaaccttacttcctctttcattccaaatcatacctttcttataaagc

SEQ ID NO: 77568 - DNA, 379 bp, Zea mays
  Clone ID: LIB3079-006-Q1-K1-B2
ctgaaggtgctggctgcagaaaatgagcttcatggcttcaataactagctgtatgatctgcagattcttggactgttgagctgtttaacggcagatattaacagttgcagccttacaggtgcttcgtcaaatgttgaggcattgctgcttaataactgtttgggggatagagtttgggttatacactgtaggtgaatcttcacgttgataccacaaacaatgtgtggaagtttcaaaaccattaaaaaagaagatgtgctacaatccaatggcgtcaaatcaaacaaaaagagtctgctcatgtactaaatgctagtaggctgctgatgaagcttactatagggaattcaaatagggccaacgaattctattcctcatc

SEQ ID NO: 77569 - DNA, 430 bp, Zea mays
  Clone ID: LIB3079-006-Q1-K1-B3
gtgggaagcaggttgaaataaagaaggctgaaccaaagaaacatggatctgataacatgggtaatgggagatcaagccaagggggtggaggttaccgcagtacttaccgtggtggtggtggagctggtagtggcagcagcggcagcggtgggggtggttatgggtttggtgatgcttatcgatctgctgcagcgagttatggatatgatggtggcgcacgagcaggatatggctatggtagagggtatggctatggaggcaatgctggctttgcgtctggttttggtggtgggtatggtggatccatgtatggaggcgcatatggtgcatatggggcatacggtggtggtgcttatggaggtggtgcctatggaggtggtgcatatggaagcagcgcctatggtggcgccccaggtggtggttatggcac

SEQ ID NO: 77570 - DNA, 437 bp, Zea mays
  Clone ID: LIB3079-006-Q1-K1-B4
agggcgtgcaatcacacaaccctcctggtcaatgtcgccgacctcaactcgtcgccgtagcgggttgtacctgggatgtggggcagcaacaagaaaccgaacctcgacttcaccctaggacggatataatccgcactgtctatctacacctcgaccatcagctgagccaaccgagatcgatcgatcggccggccatggatacgaagctagatacaggctagagctagctgcactgcatacataggttgatctgcttctaagctgccatgtttatgatctgatggagcatgtgcgtgcggtatgcatgcatggtcgtagcgagggaacaatgaagaagaaccaaaacgcttgaagaaatgaaaaaagaaggcgcgctaggagtaaagaataggagatatggcaaccgtggatgggatccaggaacaaattaaagctag

SEQ ID NO: 77571 - DNA, 420 bp, Zea mays
  unsure at all n locations
  Clone ID: LIB3079-006-Q1-K1-B5
agggagagcaagcaagagaggacgacatggcggcgccacggagcctggcggacctcgctctgctcggcgtggcggacctgataaagctgctcccgagcggcacggtgttcctgttccagttcctgagcccgctggcgagcaacaacgggcactgcgccacgctgaacaaggcgctgagcggggcgctggtggcgctgtgcggcgcctcctgcgccttctcctgcttcaccgacagctacgtgggcgcggacgggcgcgtgtactacggcgtggtgacgcggcggggcctgcgcaccttcacgcccgacccggacgccgncgtccgggacctgtcggcgtaccgtctccgcgccggcgacttcgcgcacgccgcgctctcgctgctcgtcttcgccaccctcgcgctcctcgacgccgaca

SEQ ID NO: 77572 - DNA, 420 bp, Zea mays
  Clone ID: LIB3079-006-Q1-K1-B7
ggagctagaaattactgcattgcacattaatctccatgctactgatggaaacaagagcaaaacctatggccctggcgctcattctgatcttagagctctcgctcaatctggcattaaaataggacgtattgacgatgttactccagtcgcaacagacaacacacgcataagcgatatagaacagaaagatcttaatttcagtactgacttactgccctgtacagaagtagcagttacaagtctctatggatatcatatactgaattattatgcttattatcgattgaactattgactgaactcatgaatgattactaatactcattcttgacatggaatacaacataactgtacaattactagaaaagaccctggaacaacagctgcgccaactcctgacaacaatgggtgtgccaaaac

SEQ ID NO: 77573 - DNA, 415 bp, Zea mays
  unsure at all n locations
  Clone ID: LIB3079-006-Q1-K1-B8
ctggtagacaagaatggtcatatgaaattgtcagattttggattgtgtaagccaatgattgttcgaagttgtcaacgctgaatgaaaatgaaccaatgactgatgaaaaccttagggagtctatggacatcgatcattctctctctgatactgcaaatggtaggaggtggagaagtccaaatgaacagcttcagcattggcagaacaacaggagaaaattggcattttcaacagtcgggacacctgattatattgctccagaggttctactaaagaaaggatatggactagagtgtgactggtggtctcttggtgcaatcatgtatgaaatgctngttggttatccaccattttattcagatgatccactagttacatgccaaaagattgtgcattggagaagctatttgaattt

SEQ ID NO: 77574 - DNA, 408 bp, Zea mays
  Clone ID: LIB3079-006-Q1-K1-B9
ctgccacaagcacctgctatagttgtgtggtgcaaacaccaaaatgttgcctgccaaggtgtgatttgttttcctgatagtgtactgcgcagtaacattttcgctaggtcagatagctgttggcgaggcatgcacagtggatcagagggacaagatcacaacggactgcagagagttcatcaagctgaaaggccccgtcacagccccgtcgtacaccgacgactgctgcgtcgccataagagcggtgcccaatctcgacatggagtgcatcattcgcctgctctccaataaacagaagaagaagtacgacgtggacaagatccggcggctcggcagcgtcctctgcaatccacatccggtgatgacgtaaaatggggtgtggcagtagtttctgatggagtgcatcgc

SEQ ID NO: 77575 - DNA, 381 bp, Zea mays
  Clone ID: LIB3079-006-Q1-K1-C1
ccgacgcgtccggccgctctcgggacctttctctgctcctcgccgacgatgccgccgccgcctccttttacaccggctgcgggctcgcctcgttcctcgcgtcccaccgcaaccgctccttcggccgcgcgcgggcgtcgccgtcccgcgcctcgccctccgcgcacttacgctcgctgtcgtggagcgtgtcccgcacctggtcggcggcgcgccagctgcaggccatcggagccggcctggccgcgccgcgcgccaccgaggcctcctgcggcttcgccgcgcccgcctacgccatgggctgcctgctccacctcgccgcctgggcgctcgtttgccccgtgccgtgcccggactcgcgccgcgcgctgcaagcgcacc

SEQ ID NO: 77576 - DNA, 422 bp, Zea mays
  Clone ID: LIB3079-006-Q1-K1-C10
ctgcatcagggataaaggattcaattccagcctggatcaagtactcagtgcaggcccgaggagaaataccatatgatgggatttattatgatcctcctgaagaggtaaagtatgtgttcaggcatgcgcaacctaaacgaccaaaatcattgcggatatatgaaacacatgtcggaatgagtagcccggaaccgaagataaacacatatgtaaactttagggatgaagtcctcccaagaataaaaaaacttggatacaatgcagtgcaaataatggcaatccaagagcactcatattatggaagctttggataccatgtaactaatttttttgcgccaagtagtcgttttggtaccccagaagaattgaagtctttgattgatagagcacatgagcttggtttgctagttctcatggatgtg

SEQ ID NO: 77577 - DNA, 417 bp, Zea mays
  Clone ID: LIB3079-006-Q1-K1-C11
gtgtaggaaaaacaatgatcatcaaagaagttcgtcaaatcatgctggtgtttctacggtagatgaactagaagattgggccatgggtaagcctcagagtgtgcatgctttaaatgcggaagaatttgagagaagtacagcagcagcagcatctgcagctgctatgaaagaggccatggataaagcagaggcaaagttcaaacatgcaaaggaggtacgagagagagagcgtgatgcgaagattaaaaatagagaacaacgggaacaagatagtgtaacaaggtcgtatccccagaatcgtgaggacaaagagagaaaggaaggactagaacaggaaagagagatgaagcaaaatgaggaaagggaaagagagcaaggaagacttgaagaggaaagagaacttgagcgacttagaaa

SEQ ID NO: 77578 - DNA, 118 bp, Zea mays
  Clone ID: LIB3079-006-Q1-K1-C12
atgtattatgcaaaacattgtccacacatgttataggctgaaatcggaactattcgtgatagttttagactaaagaagggcgactagctacaagtgcagaatcaactaccaaaactgc

SEQ ID NO: 77579 - DNA, 344 bp, Zea mays
  Clone ID: LIB3079-006-Q1-K1-A9
caggatcactggaaactatggtgaacatcctgatgacaaatatgacagcactgctggggctgtgataagcgatattacagtcaacgatgttgttggcgttaacattggggttgctggtatattggaaggcattcagggcgacaatttcagcaacatttgtctagtgcaatgtttccgtcagtgtgcaatctgcacatccatggaattgttcacttattgaacggtattccaactcggtgatcccagaatcatgcgaacagctcagaagcaattgtagacagacatccatttgctacgatggaagcaattcttcactgatgagcgtgcagtaaccaagacataca

SEQ ID NO: 77580 - DNA, 261 bp, Zea mays
  Clone ID: LIB3079-006-Q1-K1-C3
atggaacagggatttgtttggcttccaaatggtttgttggtcctaaaatagtcagaatgacatgacatctgtgctatagatatggacctcggtggttttctccacattaggaaagctagaagagccttttgaactcagtttttttgctaacagtggtgttatggtgaaacagagttttgtgtgtatgtaccaacaactaaaatgtaaacacgacattatcatagttgagtacaggaataattatctcttatatcttattgc

SEQ ID NO: 77581 - DNA, 211 bp, Zea mays
  Clone ID: LIB3079-005-Q1-K1-H12
gcaaccaggacctccatgccgccgccgccgtcaacgtcgccgccgacgaggtctacatcgtcagggagcccgacaagtgcctcgccaagacggccagattgttggcctattgattgatccatcactcctagctactcctactctggtcgctgcctattgattgatccatcaatcctgttaattttcagaagagtttcagaagagtcttaat

SEQ ID NO: 77582 - DNA, 424 bp, Zea mays
  Clone ID: LIB3079-005-Q1-K1-H3
ggccactttagagcacagggagtgcctctgaaaagaaagctaagggaatttcctgtcagtgaggatgcgcttcttcctgttggcacaagcatcacagttcgtcactttgttcctggacaatttgttgatgtcactggaatcacgaaggggaaaggttttgcaggtgtaatgaaaagatatggttttggtgggatgcctgcatcacatggaacatctttggcgcatcgcagtggtggctctactggtcaaagagatgctcctggaagggttttcaaaaacagaaaaatgcctggacgcatgggtggtgtgcaacgcacagtgaagaatgtatgggtctatcaaatagacccaaccaggaacttactgtatctgaaaggccaggttcctggtcctcaaggtaagcttattttcgttaaggattcta

SEQ ID NO: 77583 - DNA, 377 bp, Zea mays
  Clone ID: LIB3079-005-Q1-K1-H4
ctgcattttggatattgaatcagttgtttctggaacgttttgcagatcaccagcaagagggaaatctcctaatgtttctccagcaaatggtgaagcagcaagccccaagaagcagagcccaaacaggagcccatctggctcacgctctcctgatgcgaagcctgaataaaattgctatgctgttaaaggattgcagatggagtcaggagctcttcttttcttaacatttgtcctctgttctagtaccatcagtgtcttatcgcagtacgagattggatgatattaactatctgtatcagcttgtatcgatggactccaagtgttgtcactcttggtgtctagtgtgctgaaagacccatttacttttgctaaacttt

SEQ ID NO: 77584 - DNA, 418 bp, Zea mays
  Clone ID: LIB3079-005-Q1-K1-H5
ggggcggtccctttttgcaaaccaacacatacgccgaatcgagtcaatcggcattcgggcgtccccagtccaccggaaataattgccttgatcagcaacgatggcgggagatccggccgccggggtcggcggcaacgcccaccccgcgtcggggagcaagagctcccgctcgtcgacgcggcaccgtcagttccgcgaccgagccaaggtccgagtcgacgacctacaagagatgttctgcggcctccaatccgctcgcaaggagagccgctccgccgacgccgctgtcctcgaggagcaggtccaccagatgctccgcgagtggcgtgccgagctcagcgtcccatccccggcttcctctctccagaactcgcaggggaacaaccgggaggcttcggatccaccgtcggatacgctg

SEQ ID NO: 77585 - DNA, 435 bp, Zea mays
  Clone ID: LIB3079-005-Q1-K1-H6
ggagagaaggaatccgatccatccaagccaagccaaggcagagaagaagaagaggaggaggaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacacctagctagtcatccttgccgacgacgatccatgtctctgtatctgtgtctgttcatatgcctgatgccgacttgtgctggatgtagttgcttgaattcagtcgtgttcctgttttgctaccgtacccaccccatgcatcatctgtcaccgcgacgcaataatcatagtaataacaagttcagatt

SEQ ID NO: 77586 - DNA, 191 bp, Zea mays
  Clone ID: LIB3079-005-Q1-K1-H7
ctagtcaagagaagagtcgaggaacaaccttgcattcgcagacggcgatcatggaggcgtgagctactgcggctgcttgtctctcgaggttctcctcgaaaggttagcttcaacctgaccgccagttggtccgtagggcgtacaaggacgctgagtgcgcatctactcaccaagcctctgccgtggtgcgc

SEQ ID NO: 77587 - DNA, 458 bp, Zea mays
  Clone ID: LIB3079-005-Q1-K1-H8
cccacgcgtccgctaaaatatggatgagtgatacaacatgtgtgaacatgcttagacttggtaggtctagtttctttcgcttttgtaagggctttagagactgaggtttacttgaagatacaatacacatgtgtgttgaggaacaagtggccatgtttttgaacacagtgggacagaaccttaggaataggttggtgggaacaaattatggtagatctggtgagactgttagtcgctacttcaacaaagtgcttcgtgctattggagagctacgagctgaacttattaggccaccatcattagagactccatccaaaatagcatgaaatccaagatgggatccctactttaaggtgtgatattcagctattcaatattctccttcaagaattttcactatttaaacccataagacccttaattgtattttggcttgtattggataaacataggattgc

SEQ ID NO: 77588 - DNA, 437 bp, Zea mays
  unsure at all n locations
  Clone ID: LIB3079-005-Q1-K1-H9
gggatgcaacacaaccagaagatcacctttcctggtgaagctgatgaagcgcctgatactgtcactggagacattgtattcgtcctccagcagaaggatcactccaaattcaaaagaaagggtgaagatctcttctatgagcacaccttgtctctgaccgaagcactatgtgggttccaatttgttcttacacatctggacaacaggcagcttctcatcaaatcagaccctggtgaagttgttaaacctgaccaattcaaggcgattaatgatgaggggatgccaatttaccagaggcctttcatgaacgggaagctgtacatccatttcacggtggagttccctgactcgttggcaccagagcagtgcaaggctctcgagacagtacttncaccaaagccttcatccaagctgacagacatggagatagatgaatg

SEQ ID NO: 77589 - DNA, 226 bp, Zea mays
  unsure at all n locations
  Clone ID: LIB3079-006-Q1-K1-A1
ctcgccgggcgctttccccccgaccggaaacggagtccggatgcagttgcttcgggccatccggccgtcacatcagccacacgccgncgcgccagtcgccgcacgagggggcccgtgatgccgaagaagatgggcgtgaactccaaggcggaggcggtccgcgaccgccgctccgccgcggaggccgaccgccgcgaccgccaggagcgcgccaaggaggagcagt

SEQ ID NO: 77590 - DNA, 109 bp, Zea mays
  Clone ID: LIB3079-006-Q1-K1-A10
aaggaaaaaaaaaaattaaaaaaaaatttttttaaaacaaatacacaaaaacataacaagaaagatatccaacgcttccggccacgcgtccgttagtcctagatcgcaa

SEQ ID NO: 77591 - DNA, 262 bp, Zea mays
  Clone ID: LIB3079-006-Q1-K1-A11
gtactcggtccggattcccgctcgagcctgcagaaaggtggttgttattgtgggtgatgatcctgatggtctacttattgatgcaaagtctggaaagacagttcattccataaaaggacatcgggactactcatttgcatcggcttgaacccctgatgggcaaacatttgctaccggcaaccaagacaggacatgccgaatctgggacgtaaggaacctttcaaaatccgtccatgtgttaaggggtaaccttggagccatc

SEQ ID NO: 77592 - DNA, 233 bp, Zea mays
  Clone ID: LIB3079-006-Q1-K1-A12
gtaagccatggttcatttaagctgctgctgtccctgggtttctgcgtcgtctggtgcgctctggtgtccctctttatggatgtcgtcgtctattaaccatctgtggtttgtgtgtcatgaatcgtggttgtggcttcgttggtttaatggacctgttgtgtcctctgtgttgtacccaaaactcttctgcagcagtatggcttgaatccttatgaagtttgatatttgaactt

SEQ ID NO: 77593 - DNA, 438 bp, Zea mays
  Clone ID: LIB3079-006-Q1-K1-A2
ctgaaaggttttatctgtaactttggatgattggtctgatagtgatatcgactccatcgttgatgttggtggaaactcatatgcaaattcaatttatgaggcttttcttccaaaagatcacccaaaacccaaaccagattcaacgatggaatataggacaaaatttataagagctaagtatgagacacaagattttttgaagccaagtttgcgcatttcatcaagatcatcttttaaatctaccacttctgtgaagagtgtagatagcaatttctctagcacttcaaggaaggatgtctttgaagatacaagagaatttgttggagagttgaatatcacactggtcaaaggcaccaacttggccgttagagacatgctaacaagtgatccatatgttgttttaacgctcggagggcagaaagttcaatcaacggttaa

SEQ ID NO: 77594 - DNA, 358 bp, Zea mays
  Clone ID: LIB3079-006-Q1-K1-A3
ccgacgcgtccgcctagctccagccaccatgaagggcaaggctgacacctccaagaagggcgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcaccctggcaacaagagcgttgcgaccgtgagcaaggcagcaggggaaaagtggcgtgctatgtcagatcaagagaagcaaccatatgtggaccaagctggacagaagaagcaggactatgagaagactaaggcaaactttgataagaaagagagcacaagctcaaag

SEQ ID NO: 77595 - DNA, 61 bp, Zea mays
  Clone ID: LIB3079-006-Q1-K1-A4
ttttaaaacatacaaaaatacacaaaaaaaagcataatttaaaaaaaacctaggccccaaa

SEQ ID NO: 77596 - DNA, 390 bp, Zea mays
  Clone ID: LIB3079-006-Q1-K1-A5
ctgatctgcgtacacggtctccctcttcctgtcagtagtagagtgagagtgaggcgagcgagtatgagacaaggggaaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctcagggagatgcgcatcgcgcacttcgtggtgaaggagccgatggtgatcgggcacgagtgcgcgggcgtggtcgaggaggtgggcgccggcgtgatgcacctgtccgtgggcgaccgcgtggcg

SEQ ID NO: 77597 - DNA, 432 bp, Zea mays
  unsure at all n locations
  Clone ID: LIB3079-005-Q1-K1-H11
cccacgcgtccgggttggtgtggataaaaggactggatctgctggtggaactggcgggcaagtaggtgttcgagacattgaacttttctcctattgtgagtcatgcttgcttccattcagcatacagtgccatgtcgggtatgttccctcaggtggaagagtggttgggttaagcaagctttctagagtatctgatgtctttgccaagagattgcaaaaccctcaaagactagctaatgaaatctgtggtgcactgcatgctagcattcaacctgctggtgtggctgttgctctgcagtgctggcacattcctttaccagaaaacttggaatgcaagactntggaaggttggattagaacttcacattcatctcgctctggagtctttgaaggtgaaaagcagcactctctggagtgacttcttggctcttg

SEQ ID NO: 77598 - DNA, 431 bp, Zea mays
  Clone ID: LIB3079-006-Q1-K1-A6
tgatctgatattaacgggacaccaggaaaatgcagaatttgcgcttgccatgtgtccgtcagaaccatatgtcctgtcaggaggaaaggacaaatttgttgtcttgtggagcatccaagaccacatatctgcccttggggattcctcgtcttctcccggagcatctggcagcaagcagtctggcaaaattgcaaatgaaaaggagagtcctaaagttgatcctagaggtatattccatggccatgacagtactgttgaagatgttcagttctgcccttccagtgcgcaggagttttgtagtgtgggtgatgatgcttgtcttattctgtgggatgctcgaactggcactgacccagctgttaaggttgagaaagctcacagtggagatgttcattgtgttgattggaatccccttgatgttaactatatct

SEQ ID NO: 77599 - DNA, 435 bp, Zea mays
  unsure at all n locations
  Clone ID: LIB3079-006-Q1-K1-A8
ccgacgcgtccgcgaaggggcatggctctggtcagattggcgtttcccgtgttcgtgttcctcgcagcggcggagttcgcggcggggacgcggtcgccgtcggctttcgtacaaaacgccatctactccaaccgcatcaccatcttctccaagacttactgcccctactccatgcgtgctaagcacatatttcgagaccttaaggaagatccatatgttgttgaactagatacccgagtggatgggcgtgacattcaaagtgttctcctggacctagttgggcgtcgtactgtgccacaggtgtttgtcaatggacagcatattggtggctcagacgatacagtaaatgcgctttcaaatggacagctccagaaacttctcgggaagagtcagtcacaatgatgggtcgctggacaagctngcactgtcaagaac

SEQ ID NO: 77600 - DNA, 237 bp, Zea mays
  unsure at all n locations
  Clone ID: LIB3079-005-Q1-K1-F6
tcgccttctctcgcgagaaccgagaggctagtaccgcatccagtggntggggcttcggtatggggcggaagcgaatggcgccctgggcgaacgccgctataggcgtaggaaacccctaaattacgacggtcgatgactgttgaagatgtngccgacgccgacttcggataccggaggaaagcccgaagcagctgaaggtcttccgctgcaactggaaggatcccgccggaaggtgtt

SEQ ID NO: 77601 - DNA, 234 bp, Zea mays
  Clone ID: LIB3079-005-Q1-K1-F7
gaatacccgacccgacccactcatacgactggataaccatatctacaatatttcctttaacactgtatcctttaatccaagggcgagatctaatacacacaaggcatcgcctcacttaacatagataaattcacttaatgcatctaatacttaaaacttgaatgtttatcatgaattactcaataaactattaaatgaaaaaaatatctattaaatttacaaataacacttata

SEQ ID NO: 77602 - DNA, 400 bp, Zea mays
  Clone ID: LIB3079-005-Q1-K1-F8
cccacgcgtccgcctcaaggagacatccttactaatccacaataccactggaaggagttcaggttcacattcaaggaacctgccaaggatgctgaggacttctgccgcatgctggttgggttagaggaagagggtttgcagaccgtgaagagctgtagcggttacggttgacaacccacttgcaaggttcacattcaaggaaccagccaaggatgctgaggactctgccgcatgctggttcgattagagggattttgcagcgcgtgaagagctatagcggtctaggtgacagctcacttgccacaaaaccagtgagaaactatatatccgttattttggaactttgaaatatggttttagattgctatgttttattcgaagatctatggcttctcgaatt

SEQ ID NO: 77603 - DNA, 442 bp, Zea mays
  Clone ID: LIB3079-005-Q1-K1-F9
gaacattttgatagtgttagcgaggacgatcaacaatctgatggtaacatatctgacactctagcggaatctgacagtgatgatgtcatgcataattcaaagcgtataaggttatacgaggtcaaggatgaacaccatgcggaagcatttttgaacagcgtctctttatcaaacgaggatgctgttccccttgaggataggatagctgccctggaaaggaaacagaactccaaagcacttgatgcggtcaagtacgggcctggtggctcacgagagatttcgtttttctctaaaagccgtagaaggcacaaggaagagtcgtctagcgacgatgaacccaagggtgtcaaaaagagagctgtgcagccgctgggcttgaagcagggaaaagccgagttctaatatgttggcggaaatcgtggcaaaagtagaaggcgtggtg

SEQ ID NO: 77604 - DNA, 329 bp, Zea mays
  Clone ID: LIB3079-005-Q1-K1-G1
gcttcagttgctaagacaatgaaaaatattgcttcaaaccctgatgccttcaatcaatggttgaggtggaagtatgatggtccatccgattctttcaaagctcttattgacatggcagcggttcattcatcttgtcgtctttgtatacatattgctaccaagatccatttaaaggaggaaaggactccaaaatttacaaatcgtccttgtagctgttccaccaaaaagggaacaatttaccacttatttatccgagagagagggcggtttaagtcagagagcatttacatgagatcaggccagttaactctgggagccttggaatccgc

SEQ ID NO: 77605 - DNA, 416 bp, Zea mays
  unsure at all n locations
  Clone ID: LIB3079-005-Q1-K1-G12
attgaatgagattacatcactgtttttttcttagcgatatgttgagctcatgtgctcgtttatgttagtcgatctctggctcttgtagtaacttggaaagcttgctgnctttttttaagggcatacatgcctgtgatgtgtggtcatgatcatttttttctcctgttattttagttgtcgtatcataaatgccatgtttgcattggtgttccaacatgtcaatattattgaataaatgtttgcattggcggcagcggggacgacgctaagtcgagcaatggcgaagcggcccgtggtggcagtaacggtggagagaagcagggggatgaatccaacggtggcgggatacttagcgctgtggcttccaggattggcgtggtcgtgtccagcgccaacggggaccgcagcggcagcgc

SEQ ID NO: 77606 - DNA, 437 bp, Zea mays
  Clone ID: LIB3079-005-Q1-K1-G2
cttccccgtcgcgattcgcattgcccttccctcgggttctacccccagcctcgcgccggcgccgccgccgccgcccttgccagagagatcaccccccattcccacaatcccgtccctccctccgtccctcgaggagccgagccctccgcgcggccgtgggatggggcagtgaccggtgagtggcgtggggagccggtgggcggtggcgagggcatatcatggtgcagtgcctggacggggtgaggcagctgctcgcggtcctgctcaattgctgcgacgtcgagctcaagcagccgcgggggctccaagacccccaggtcctcgcgagggagaccgtcttcagcgtgagtgaggtcgaggcgctgtacgagcttgttaagaggatcagcaacgccgtcattgatgatgggctgattaacaaggaggaatttcagttg

SEQ ID NO: 77607 - DNA, 417 bp, Zea mays
  Clone ID: LIB3079-005-Q1-K1-G3
gacgagtcgtccgtcccaggctcccagccccggcgccccgtctcaaatcaaaaaaattgggctcaaatctcaaacccataaaaaatactgtattttccaaccaagccactcgcccgaccttcatccgcattccacgcgcactccgctgcctcactccgagactccgccgctgcttccaacttccgttgcgcacgagcgaaacatccggagctagcaagggaggaggaggaggaggcgatggcggggggcggggataaggtggactacgtcttcaaggtggtgctcatcggcgactccgctgtcggcaagtcgcagatccttgcgcgcttcgcccgcaacgagtttagcctcgactcgaaggccaccattggggtcgagttccagactcggacgctcgtcatcgaacacaagtccgtc

SEQ ID NO: 77608 - DNA, 402 bp, Zea mays
  Clone ID: LIB3079-005-Q1-K1-G4
ctcatctgcgtacacggtctccctcttcctgtcagtagtagagtgagagtgaggcagggggtaggagacaaggggaaatggggaagggagcgcaagggagcgatgcggcggcggcgggcggcgaggtggaggagaacatggcggcgtggctggttgccaagaacaccctcaagatcatgcccttcaagctcccgaccgtcggcccttatgatgtccgcgtgcgcatgaaggcagtggggatttgcggcagcgatgtgcactacctcacggagatgcgcatcgcgcacttcgtggtgaatgagccgatggtgatcgggcacgagtgctcaggcgtggtcgaagaagtgggctccggcgtgatgcacctgtccgtgggcgaccgcgtggagctggagccgggcg

SEQ ID NO: 77609 - DNA, 346 bp, Zea mays
  Clone ID: LIB3079-005-Q1-K1-G5
cccacgcgtccgaaaaaaaaaaaataaatttaaaaaaaaaaaaaaaaaaaaaaaaagaaaagaaaaaaaaaaaaaaaaaaaaaaaaaggggggccgcccttttggatccacccttctttcctcctccttcctccgacttaattcttcttttatggtgccacattacttttatttgctggccgtttttcaacatcgtcactgctgaaaccctcctgttgcccccctaattaaccttgttgcacatcatccttttttcacctggtgtcgtattaacaaagccccccccaatgatctttcttaccaacagttccgcactcttggtgactattgcgccccctctttttgc

SEQ ID NO: 77610 - DNA, 220 bp, Zea mays
  Clone ID: LIB3079-005-Q1-K1-G6
cttccccgtcgccattctcattgacctactatcgagttctacccccaacctcgcaccgtgtccgtcttcaacgacctttccagatagatcaccccacattcccacaatcaccttacctacctacatacatcgacgaacctagccctaatctctgacaacgcatagagcaacgaccacttaatctccacattaaccagcaatctgtcacaagatcatatca

SEQ ID NO: 77611 - DNA, 293 bp, Zea mays
  Clone ID: LIB3079-005-Q1-K1-G7
aaaaaacaaaaaaaaactaaaaaaataaatttaaaaaaaaaaataaaaaaaaaaggggaggattataaaacggcggccgctttctagattccaacatttacttccacttgcatgccatttattagcttttctctcgcactcccttaattcactccactactccaccgtttataacatcttcccttgcaaaccctctgtgtatcccaacttattcacttatcaggatattccctttttgccagctggcgtaaatacgatgagctccctaccaaacgtccttctcatcagttact

SEQ ID NO: 77612 - DNA, 439 bp, Zea mays
  Clone ID: LIB3079-005-Q1-K1-G8
ggactggggcgccatcccgcggctcctctcctccgcctgcctcttcctctgctccggaggctgttttggttgctgcgataagactgtaaagcaactgggtgaactgtccagaaacttgatcacccaggaccaaattaccattggagagccattttggagcacaaccaccatcgaggttgaaccagcagatctcagtggtgttacttcagtcaatacatctaacttggcctctggaactggtagcagtcataaccttcctggacttggtaataatggacttgttctgtgggaacatacaaggcaggagtggactgaaactagaagtctgcggctgaaggtgaagcatgttcgtgaaccagtattgagttggaatgcagcatatgagagtctgcttggatcaaataagccattttctcaacccattcctcttcatgagatg

SEQ ID NO: 77613 - DNA, 456 bp, Zea mays
  unsure at all n locations
  Clone ID: LIB3079-005-Q1-K1-G9
ggcttaggtcggaaagctaatcaggtctatatcattgattatgggcttgctaagaaatacaaggagcttcagactcataaacacatcccatacagggagaacaaaaatctgactggaacagcacgttatgctagtgtgaatactcatcttggaatagaacaaagcaggagagatgatctggagtctgttggctatcttctgctatattttttaagaggaagcctcccatggcagggccttaaagctggcactaagaaacaaaagtatgataaaattagtgaaaagaaaatgcttacctcggcagagattctgtgcaaatcttacccgccggagttcgtctcatatttccactattgtcgctccctgcgatttgaagacaggccagattactcttcaatgaagaagctctntcgtgatgtatntatacgggaaggatacccaattgattacgtattt

SEQ ID NO: 77614 - DNA, 455 bp, Zea mays
  unsure at all n locations
  Clone ID: LIB3079-005-Q1-K1-H10
gtcgcgcgccgctgcgttgagccaaggcgcaatggcaacctccacctcagttcccgtcctcctgggcctcgccgccgccgccggcctcctcctgctccccggctcgctggcgtggcagagcagcaactgtgcaccgggcgcgcccggcagtggctcgccgacgtggccttcacccggctccggctccggcggcggccacagcaagccgcccaagcaccaccatggcaagccgcccaagtgcccgccgtgcaaccctccgtacgtgcctccgacgcctcggccgtcaccgccgtacgtgccaccgtatgtcccgccgacgcctcggccgtcaccgccctacgtgccaccatacgtccccgtcccgccgacgcctcggccctcaccgncgtacgtgccaccatacgtccccgtncccccgacgcctcggccctcaccgncctacgtgccaccatacg

SEQ ID NO: 77615 - DNA, 438 bp, Zea mays
  unsure at all n locations
  Clone ID: LIB3079-005-Q1-K1-F5
gataattccaataatgcaaaagaggcccgatttcggttttgtaagtttcctggagtctgagtccgtaaaacagatcttatcagaaaggggccctcatttcatctgtggaaatgaagttcatgtcaaagcatacagggaaaagcatgaattggagtacatgatgttaactgagaaagatatccattgtaactgcggtgtacgcgatgtgtcagatgtgggcgatttgcaattttgccaccattggcagtggacttcgctaatttgctatcggacacacaaatcatagacacataccggacccacaaatcatagacacttgggggtggcgacattgcaaatatttcgtcagatgtagatgcagttggtgagcatcatacagtgactattggtgactntgggcttcagacgaccttggaatttgactactgagactctgag

SEQ ID NO: 77616 - DNA, 356 bp, Zea mays
  Clone ID: LIB3079-009-Q1-K1-F3
gttgacaggaggggtggagagggagtgggtcgaagtggttcgcttgtttttgaggaatggctagaacccgcatgctaaaggaatatttttactcaaaaccaacctaacatgtgaaccttttgaaccaaacacggattgatgcatgttcaacccgttccaacccgctaaccaaacacaccctctgtgacgcgagcaggttggggacttgggattggggttcggggagagctgaaagggaaatgtgcccttgggccatttctaagtattttggtgattgagtgccaacacaagtgattaaatgtgaatctatgcccatggatggacaaagtgcaaatcaagagtaaaggtatgtttct

SEQ ID NO: 77617 - DNA, 341 bp, Zea mays
  Clone ID: LIB3079-009-Q1-K1-F5
gttactcatcaagcccgccgtattccacccgtggcgcgaccgcgccaccacgcaacccaggcacgggcgccgccctaataaatcccctgcgctccgcgcccgccggctcgcaaccctaaccttcctcccctgctccgccgccgccacggtcgcctctactgccatggtgagcgctgaagtcggcatcgattacgtgctgtggacggaggacgaggtgtccacccgcgtgggcgaggtcgccgccgagctcgcgggcgacctgcgcgcgttgccggagcccgccgtcatcgtcggcgtcgccacgggcgcgttcctcttcctcgctgacctcgtccggcgcg

SEQ ID NO: 77618 - DNA, 334 bp, Zea mays
  Clone ID: LIB3079-009-Q1-K1-F8
gcactgcgacaacaacgaggtgctcatggcgctctgcaacgaggccggctgggtggtggggcccgacggcaccacctaccgccagggaagcaagcccatggaacgcatggatcccatcggttgctccgtgtcaccaagcccatgttcctcgtaccaaccaagtccgcgggcgtcatacaatgcaagccctacctcgtcctcattccccagcggcgcatcctcccccttcctccctcccaacgaaatgcccaacggtatcgacggcaatccaatcctaccatggctcaagacattctccaacggcactccatcaaagaaacacccgctcctccca

SEQ ID NO: 77619 - DNA, 345 bp, Zea mays
  Clone ID: LIB3079-009-Q1-K1-G1
ccaacccgtccggccctggcaaactggctggcaaacccgcgccgaaacccgctggcgcgggtccacttgcacgcggtttgctcgcgcctcaggaaatacggactgaggtccaacgacctctacaacccctacttcaatctggacatcatggacgcgctcggtaggctgcctagggaggtggcaacccccgcatcatcgcctaaagcgtgccatggacctgtccatgaagcaccagcacctcccggaggacctccaggcacagcaggttccattcagaggatatttgagtgacatgttggcgttggtgaaaaaggaaagcgccgagcgtcagtcactgggagcccc

SEQ ID NO: 77620 - DNA, 173 bp, Zea mays
  unsure at all n locations
  Clone ID: LIB3079-009-Q1-K1-G3
ctctgctagcatatanggactatcacctgatctacgttgccagcatctagcttctcgcacacggcggcncgattccgaagcgcacacactcgctccagccaaaagcatcgcagcttctaatcgatcggagagcacacacgaatgtcgtacgtgcagctctatgctgctggagt

SEQ ID NO: 77621 - DNA, 103 bp, Zea mays
  Clone ID: LIB3079-009-Q1-K1-G5
cccacacgtacgaaaaaaaaaaaattaattttataaaaaaaaaacaaaaaataaagacaaggatatatataaatgttgggtgtgaattaatttataggccatt

SEQ ID NO: 77622 - DNA, 343 bp, Zea mays
  Clone ID: LIB3079-009-Q1-K1-G6
ccaagatgaacggtgcatttccgccgtacagatcggactccacttgcgatatacttgatgttatcctcagtaagaatgactcggatggagattcgagcagccaggtgggcttcttatgcggctcacctccgatacgcgctgacaaccctgttatccatgatccacagtttggtaaaagactgccatccttttctcctctaggagggagctcctatggcaaaatgccagcagtacgagttgaagtaggctcgccatcttgcggcgttagcagcagcccaaaagtaaggattgaaggtttcgcctgtggcaactccgagacccactatgcagttacctttgtctg

SEQ ID NO: 77623 - DNA, 330 bp, Zea mays
  Clone ID: LIB3079-009-Q1-K1-G7
ggtacggctagaacgcatgagaggcaacccaagacgcgttcgcgacggccggccacgcgggggggacggcgtggaacctcttcaagatccggaaggccgtcacgccatcgtcctccatgcccgggaacatggtcaagagcgccatcaagaacaggaactgacgtcggcaccagacagttgctcattgtgctcctcttgatgatcatatacccagaatgatcggacagtaattcaatgcgctcctcttactctggatgataatgtacccataatggcgtgtaactatcgtgtgtgcaccatcgacattaacaaatacttgttccaacaact

SEQ ID NO: 77624 - DNA, 249 bp, Zea mays
  Clone ID: LIB3079-009-Q1-K1-G8
cccacgcgttcgggaggaagcccgtggtgcatgacgagcgcgacaaccgcctggtgctggtggactgggtgctggaccgctggcgcgcttgctgcgtcacggacaaccgggacccgcgcctgcagggcgactttctcgagcgcgaggccagcctcgtgctgaggctcggcttgctgtgctcacacccgctgcccggcgcgcgcccggtcatgcgccagatcgtccagtacctcgacggcgatgcgccgc

SEQ ID NO: 77625 - DNA, 230 bp, Zea mays
  Clone ID: LIB3079-009-Q1-K1-H1
cccaaaatctaatatctttcgtgcccgcccgcccgtgcccgtagacgctttgttcttgccggccgcgcccaacctccgccctttcttctctaagggggatcggatacgccacaggctgcccgatggtgctgtgggtcttcggctacggctccctcatctggaaccccggcttcgacttcgacgacaaaatcctcggcttcatcaagggctacaagcgcacctttaatctc

SEQ ID NO: 77626 - DNA, 266 bp, Zea mays
  Clone ID: LIB3079-009-Q1-K1-H2
gcacgtcttgcaagttttaaagtaacagaagaaaaaccacccgaccccaaggtttaacgaggggccttttgttcaacctttgtggtccacaacccaaccagttccggagattaatttatgctggaagtaggggcctgaacccgctggaggtaaaaaggtcccaaaattaaaaccttcaatggcatgtaaaataaggttccggaaaaaggaagggggtggggcgtcttttgccataaggtttcgaataaaaggaccgcggtcctttt

SEQ ID NO: 77627 - DNA, 234 bp, Zea mays
  unsure at all n locations
  Clone ID: LIB3079-009-Q1-K1-H4
aaattttatttaaaatttattaaaaaactaagatatacaatttatacggcgagattgtcttcaatctttctttccaaaacctcctttnncatgtttctctccctctttattaaattactttttacccatcttcacattcttatctacatcttttnttaaaacacattgtttggttttatttggttgatcattaaaacaaaccttgaagacacccataaaaacacattccaacac

SEQ ID NO: 77628 - DNA, 388 bp, Zea mays
  Clone ID: LIB3079-009-Q1-K1-H6
ctgagctccgccatttcatgaccaacctcggcgagaagctgactgacgaggaggtcgacgagatgatccgtgaggccgatgttgacggcgactgccagatcaactacgaggagttcgtcaaggtcatgatggccaagtgaggagcgatccccgttatctatgaatgaattgaagtgaaatatcaggcacacaagctgtactttgccatgtcccttttgagtacacatcagtatcatgcaggaggtaatgtctagtagtggtcggtttaggtggtgtagtcatgggaactcgacatcagatacctggtctcttttgattgtgatgttaatctgcattattgctcctgctggagcctttaggatttgttgtaagctcatattttcagggg

SEQ ID NO: 77629 - DNA, 52 bp, Zea mays
  Clone ID: LIB3079-009-Q1-K1-H8
cccacgcgtccgcaaagtttataaaaggtactgttactattgttgcagtgtg

SEQ ID NO: 77630 - DNA, 216 bp, Zea mays
  Clone ID: LIB3079-010-Q1-K1-A10
tcgatttccgtccaaagcgtttccccgaggagtatctcgtgcctaccatgttgcgtatgcgctggggcttcaagacgggagcatcgcatgccgagatggaccctgacgctcgagtttattatctgcggtgaccaactgaccacaaaattgtctatttttacgtgctgaattcaacaaccaagtcgcattactaaaaagtattgaacataaaaactt

SEQ ID NO: 77631 - DNA, 355 bp, Zea mays
  Clone ID: LIB3079-010-Q1-K1-A11
ctttcaatatgcgtcccccaataactaatattcatggcaaaaccgttgacccttgtgttaggcctctccttagtgacagctatgtctgccataatctctcatgctgatggatactgcgagaatgaccttcaaagccttataagtgactgcactacatacgtgatgttcccatctaatccaaatgtccctacttccgatgcttgctgtcgtgtcattaaaaaggcaaacgtctcttgcttatactccaacgtcaccaaagatactgataaagctgtgtgcatagagaaagttgtgtatgttcctcagcactgtaagacgccatttgagcattgcttccaatgccgcagctacaaag

SEQ ID NO: 77632 - DNA, 198 bp, Zea mays
  Clone ID: LIB3079-009-Q1-K1-F1
ggccaacgtgcgcctggtcgccgacgtcaggctgctcttggacttaaccaaaaggaactgggtgcccttcccccggttggactcgtccttcgtcaaataccggccgggggccaccgtgccaggggtcgacgtcagcgagtggctggctttaacccccgtttgtttcggcaaaaaaaccaaaacctttgccgccttttt

SEQ ID NO: 77633 - DNA, 215 bp, Zea mays
  Clone ID: LIB3079-010-Q1-K1-A2
cccacgcgtccgatctttattgtatagataacgaatggttatagttatttattcttgtgtggaagtggtattggatttttttagcttggggttaaagaaaagacagtcatgtactttgcatcttttttgtatttatgttttatgctaaattgtggaataacactatattagttgttagcaaagaatttctgagatattaaggttgatgataaaaa

SEQ ID NO: 77634 - DNA, 421 bp, Zea mays
  unsure at all n locations
  Clone ID: LIB3079-010-Q1-K1-A3
cccacccgtccgttcacacccacgaagcatcaaaccagtggactggactagcaaggtgggcaacatgaagcctgcggccaccggcagagttgctggcctcctattcttcctcgccctcctcctggcgctgacttacctccgagtctccatggctggatcagggttctgcgacggcaagtgcgcggtgaggtgctccaaggcgagccggcacgacgactgcctcaagtactgcgggatctgctgcgccacctgcaactgcgtgccgtccgggaccgcgggcaacaaggacgagtgcccatgctaccgcgacatgaccaccggacacggcaaccgcaccaggcccaaatgcccctgatgatattccttccttcgctcncgggagccaacttccagctggggctgtccngcatgcctatgtaat

SEQ ID NO: 77635 - DNA, 364 bp, Zea mays
  Clone ID: LIB3079-010-Q1-K1-A4
tccgggtggccaacgcgtccgctcgccgacgcccaagccgcccctggccgacccggaggaggaggccaagccggggaacagcgccgtcgacggcgtcggaaacggcaaggagtacgagaagatcgagttcccggacctgaatctcgtgcaggagaaccagatcatggtctccgagtacaccaggctgtcgtgcgcggccgtggaaacgcagagctgcgacagcctcctgacctcggagcacgatgactgctccacggtcctgagccgggacgccgacgtgcgcctcgtagatagcttctcgaccgacaacaacaccgccgactcggtgggcgccttccagagcgacacgccggtcagcagcgtg

SEQ ID NO: 77636 - DNA, 324 bp, Zea mays
  Clone ID: LIB3079-010-Q1-K1-A5
gtgaagggcatgatccacgacaaggggccgacggcgtcccaggcgctgacggtggcgacgctgctccctctgggcgggctgctcctggtgctgtcgggcctggcgctggcggcctccacggtggggctggccctggccacgcccgagttcctgctcttcagccccgtgctcgtccacgccgcgctgctcatcggcacggccgtcgcggagttcctcacgtcgggcgcgctggggctcggcggcctgtactcgctcacgtgcctcgccaacacggcgcggcaggcgttccagcgcacctcggactacgtccaggaggcgcgccgc

SEQ ID NO: 77637 - DNA, 270 bp, Zea mays
  Clone ID: LIB3079-009-Q1-K1-B8
gccttgccaaatgcaaatattggagctcttgaaatattgactacaatgatacattaactgtgaccgaaaatgatattcttctgcaatgggatggcagttaatttcttggaaaaaaattccctcccatttgtgcggtgattggtgattggaattaaagccggagtgagggagatgcctgcttttgactctatggcgggtattaattgtttgttgggattatgcattagcctcaagagttgcttggccatcggatgggaaagactttttatt

SEQ ID NO: 77638 - DNA, 328 bp, Zea mays
  Clone ID: LIB3079-009-Q1-K1-C1
gcctcactctgtaccccggacgagttgcagttggatctcagatcggcgatcacataaacggtggtgaaagctgttgctgtgcttggtagcaacgatggtgtcaagggcaccatcttcttcacccaagagggagatggccctaccactgtcaccggaagtgtctctggcctcaagcctggcctgcatgggttccatgtgcatgcacttggtgacaccaccaatggctgcatgtctactggaccacactacaatcctgcgagcaaagaacatggagcaccagaagatgagaaccgccatgccggtgatcctggaaatgtgacaactggag

SEQ ID NO: 77639 - DNA, 283 bp, Zea mays
  Clone ID: LIB3079-009-Q1-K1-C2
acggtcttgccaaaatcaaatattggaactcctttagggtctcaagatactcgagaatttggcgggatggatctaatataaccactgggctggagcatcaattgccatttttcttgtgcaaacacttaaccaagtttctgggtcgatggctttgataacgatgaatcagccaccgagcaggctctcttgcagaaactgttaaggagtattgccatcaaaattttgtcggaacatctgtccgtgctgcagcgtatcctgatcatgaaaaacacgacatacattc

SEQ ID NO: 77640 - DNA, 330 bp, Zea mays
  Clone ID: LIB3079-009-Q1-K1-C3
agagcataggtttcttgaaggaagataccgagtcaggctcatacttcgcaatgaaatccttagtgatggaagagctcaaggcatttttccgtccagagttgctcaatagaatcgacgagatggttgtgttccgtcctctggagaagactcagatgctggccattcttgatatcatcctaaaggaagtcaagggccgacttttggccctcgggataggtttggaggtgtctgatgcaatgaaggacctgatatgccaagagggctacgacaaaagctatggcgctcggcctctgaggagagctgtcacccacattatcgaggatgtcatca

SEQ ID NO: 77641 - DNA, 342 bp, Zea mays
  Clone ID: LIB3079-009-Q1-K1-C5
cgtctgatcaacattgtttaaagacgggggacgctttttagcaatcaaaggaatgaaaagggattgggtcatttgttatttgtcctatcaacaccctatattatggctacaacactatgtacaaagtgacatcatacaatatatatatagcatacgcctaatccactggaggataatgtacattcatcgtgcaagctatacgacatggataaaacatggttaattgaacagagagatgataatcggttgttcattgctcttctaagagaatcaaaaatgaggctatctgatgatatcattgagacaatcctggataagacattctctgatgctgatgcaaat

SEQ ID NO: 77642 - DNA, 56 bp, Zea mays
  Clone ID: LIB3079-009-Q1-K1-C7
agagcataggtttcttgaaggaagataccgagtcaggctcatacttcacaatgaaa

SEQ ID NO: 77643 - DNA, 254 bp, Zea mays
  Clone ID: LIB3079-009-Q1-K1-C8
ccaggcgtacgtgtagatcgcgagcggctgcccttttttttttttttttttttttttttttttttttttgggtcagcgcagtgatcaacctttttaccatttaagtgatcagtcttaatattgtacatgcacttgggcacacacttggaaacacaggtgccctaccagacacacgcatgatgcgtgcatacactacatacaaagacgggagccatgtccacgccacgtacaggcacagggctcgccggtcacac

SEQ ID NO: 77644 - DNA, 193 bp, Zea mays
  Clone ID: LIB3079-009-Q1-K1-D1
gtctaccaccctattaagcgcaaggtctcagtctcaccgacacctattcaatcccaatcggacacactagtttctcctcgatcctcatctcctccctctctcgagtcaagagcagatcatctaccaaacaagctcttctttcgcttgcaatccatggagctcgacgccgacaaactgatcgccaccgatcttc

SEQ ID NO: 77645 - DNA, 411 bp, Zea mays
  Clone ID: LIB3079-009-Q1-K1-D3
gtcgcttccagccgccgccgcgtccgcctcgccaagcgcagcagccgccgcagcacatcgctctctcgatctcagccatggcggatgtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggagatcatccacctgctcaccgatgccaaccccattcaggtcgtcgtcgacgcgatca

SEQ ID NO: 77646 - DNA, 322 bp, Zea mays
  Clone ID: LIB3079-009-Q1-K1-D4
tcgtaccctacctcacgtcccggatcctatccttcggccaaggtgagttacacgctgggcgggggttggtcagccgtcggcaaccacctcattcccatcagtctcaccgtcgccttcgaggcaaactcgaatcctcctccgtcaccacatccacagccgttccgagcttgagccgtctgttgctccggtaaattgcccttcatcttgtttcctgtagagagaggtcatttattgtgaccgcatgccttatattaagacaagtcgtgtcaagttttctgaacgatgggagcttattgaaccaaccatcctggtgttggatgcc

SEQ ID NO: 77647 - DNA, 385 bp, Zea mays
  Clone ID: LIB3079-009-Q1-K1-D5
ctttgacatcaggatggtcaaccactttgtccaggagttcaagaggaagaacaagaaggagatcgggggcaacccgagggctctccggaggctgatgacctcttgtgagagggccaagagaactctgtcttccactgcccagaccaccattgagattgactcgctgtacgagggcattgacttctactccaccatcacccgtgccaggtttgaggagctcaacatggacctgttcaggaagtgcatggagcctgttgagaaatgcctgagggatgccaagatggacaagagcagcgtccatgatgttgtccttgttggtggctccactaggatccccagggtgcagcagctgctccaggacttcttcaacggcaaggagctgtgc

SEQ ID NO: 77648 - DNA, 312 bp, Zea mays
  Clone ID: LIB3079-009-Q1-K1-D6
cttagattgacaagtgacgaccaaaccctatgccatggcttggcgcggcgccgccttccgatccattatcggcgacgtacgtgctcgcgccgcatcccagtcttccaccgacgcctcgcgcctccggtcgacagatccacttaccgacccctcgcgccggacgttggcggggatgtcggggtccccggctgcggccgcggtgaagctcaccgggcactctgcaacgagcgtgctggcgtgctgtgagctctcccagggccaaaatgggaaggatgggtgatgaggagatcagaccgaatgattcaatatcct

SEQ ID NO: 77649 - DNA, 306 bp, Zea mays
  Clone ID: LIB3079-009-Q1-K1-D7
cccacgcgtccgcatagacatgtcataaaatcaaaaggtcattagcgagtgctcggaagcggagagttggctaatggagaaaaggcagcagcatgatgctctgccaaagcatgctaatccggtcctccttgctgctgaccttaagaagaaagctgaaacacttgacaggttctgcaatgccgatcatgacgaaaccgaagccagttcctaagccacagactccgcctgcggcaaatacccaagctcctgagcctcatacaccggagcatcagcgatcaaatggcggaagcacaaccagcgagggag

SEQ ID NO: 77650 - DNA, 312 bp, Zea mays
  Clone ID: LIB3079-009-Q1-K1-D8
aaccctacctcacgtaccggatcccatccttcggccaaggtgagttacacgctagccgggggtcggtcagccgccgccaaccgcctcatccccatcagtctcaccgtcgtcggcgaggcaaactcgatgccacccccgtcgccgcagccacagccgctccgagcttgagccgtcgttgctccgctgaatcgcccccatcgtctctcctgaagagagaggacatttattgagacagcatgcctaagataaagacaagtcgtgcctagtatcctgaaggacgggagcttattgaaccaaccatccttgagttgg

SEQ ID NO: 77651 - DNA, 234 bp, Zea mays
  Clone ID: LIB3079-009-Q1-K1-E1
gtcacttacatccaccgtctcgttttcctatccaagcgcaccatccaccgcagcgcataggtgtctctatctcagccatggcccacccagaacaccaacaggacactccgaatctcttcaaccgatggaccttctatcatctcctcacgaacgacatctcccttaacgactacctagctgtgaacgctacgaagcacgcgatgtacctgccgcacacacctgtaccttactcca

SEQ ID NO: 77652 - DNA, 238 bp, Zea mays
  Clone ID: LIB3079-009-Q1-K1-E3
cccacgcgtccgcagaaacacaccaagcgaatcacattatcaacaacctaacaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaat

SEQ ID NO: 77653 - DNA, 275 bp, Zea mays
  Clone ID: LIB3079-009-Q1-K1-E4
tctccctctgctcgaaccgcgccgacgagcgtacgacagaactgctctattcttcaaaacgaatggcgaccggtccagttaacccaaaaccctttctgaacaacctgacatgaaagcctgttattgtcaaactcaagtggggtatggagtacaagggttatcttgcttctgtggactcatatatgaatctccagcttgccaacactgaggagtacattgatggtcaattctctggaaacctgggagagattctgatcaggtgcaacaacgtcatg

SEQ ID NO: 77654 - DNA, 374 bp, Zea mays
  Clone ID: LIB3079-009-Q1-K1-E5
atagcgagattgttgtttgatttatacatattccggggttctacattgtctagggggagatggccacattcatttcttcccaaaacctccttgacaatatttttctccctctttatgaagtaactgtagacccagcttcacatcctcagctccatgttttcttaaaacaggttgttgggttggatttggtggatgatgaaagcaaacctgaaagacgcccaacaaaacacatgccaacacctgagcaatggactaatattttcaatccagcctatgcgtattatgtgtactattgctatgccaatctgtatacactgaacaagcttcgtgagtccaagggcatgacaaccatcaaacttcgtccacactgtggg

SEQ ID NO: 77655 - DNA, 334 bp, Zea mays
  Clone ID: LIB3079-009-Q1-K1-E6
gccggatgctaatatgtcgtcggtgttcagcggcgatgagacggcccccttcttcggctggcttggcgccgccgccgccctcgtcttctcatgcatgggcgccgcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcacggggatcaaccccaagtgcctgccctactacctctttgatggctacgcccacctttcgtccggggctgcctgtggtctcgctgggctt

SEQ ID NO: 77656 - DNA, 360 bp, Zea mays
  Clone ID: LIB3079-009-Q1-K1-E7
gttcctcatcaagcccgcggcattccacccgtggcgcgaccgcgccaccacgcatcccacgcaccggggccgccctaataaatcccctgcgctccgcgcccgccggctcgcaaccctaaccttcctcccctgctccgccgccgccacggtcgcctctactgccatggtgagcgctgaagtcggcatcgattacgtgctgtggacggaggacgaggtgtccacccgcgtgggcgaggtcgccgccgagctcgcggccgacctgcgcgcgttgccggagcccgccgtcatcgtcggcgtcgccacgggcgcgttcctcttcctcgctgacctcgtccggcgcgtcgacgtgcggctcgtggt

SEQ ID NO: 77657 - DNA, 139 bp, Zea mays
  Clone ID: LIB3079-009-Q1-K1-E8
attcccgagctcgacccatctcgtccgaaaaaaaaaaaaaaaaaaaaaaaaatttttttaaagcactaccgatttaaaaaaaaaaagggtgtctttctctagagtgcccagcctttcttcctctttaattcaacctaat

SEQ ID NO: 77658 - DNA, 403 bp, Zea mays
  Clone ID: LIB3079-009-Q1-K1-B7
tcccgacccaggcgtcccgcctgatcaacaaggaagaattccagttagcattatttaagaatcagaggaaagaaaatcgtttgggtaatcggatatttgaccttttcgatgtcaagaaaaggggtgccattgattttggtgactttgtccgagctctaaatgtgtttcatccaaatatcccaatggatgaaaaaattgatttctcgttcaagctatatgatatggatagcacagggtttattgaacggaaggaggttaagcagatgttaattgctcttctaggagaatcagaaatgaggctatctgatgatatcattgagacaatcctggataagacattctctgatgctgatgcaaatcaagatgggaaaatagatagaacagagtgggagaattttgtcac

SEQ ID NO: 77659 - DNA, 321 bp, Zea mays
  Clone ID: LIB3079-008-Q1-K1-G8
caagtttttgggaaattcagtggaaatttacccagttggaaggactcgagtgacactaagaaaatctggtgtcgtgttggatttggtgccaccactaacaaaggttaacaacctgatatttgggcgcacttgggttgattctcctggagagatggtcatgacgaacctgacaactggagacaaagttgtgctatatttccagccatgcggctggtttggggctggccgttacgaggtggatgggtatgtgtacagtgcagcggaagaacccaaaatcatgattacagggaagtggaacaagtccctgagttgccaaccatg

SEQ ID NO: 77660 - DNA, 439 bp, Zea mays
  unsure at all n locations
  Clone ID: LIB3079-008-Q1-K1-G9
cgagcgaatccctcgcatcgcattcgcagcctttgctgcatcacaccaccgcgaaacccgagcagccgcatcgatggcgcccaaggcggagaagaagccggctgcgaagaagccagcggaggaggagcccgctgccgcgaaggccccggcggggaagaagcccaaggccgagaagcgcctcccggcggccaagtcgtccggcaaagaaggcggcgacaagaagggtaagaagaaggcgaagaagtcggtggagacctacaagatctacatcttcaaggtgctgaagcaggtccaccccgacatcggcatctcttccaaggccatgtccatcatgaactccttcatcaacgacatcttcgagaagctcgccggcgaggctngccaagctgcgcgctacaacaagaagcccaccatcacctctcgggagattcaaacctct

SEQ ID NO: 77661 - DNA, 295 bp, Zea mays
  Clone ID: LIB3079-008-Q1-K1-H1
aacaaacaaacaaacaataacaaaaaaaatttacacataaacaaaaaacaaaaaacaacaaagaggacaagatcaaaaaaaaaacagaaaacaaaaaaccaaacaaaaacaataaacaaaaacaacaaacgggccgccccctcaaagactcccaactttacttccccgcacttccaacctcaaacctctcctatcacccccccaaaatcaaactgcctgccccccactttcaaacctatatacctggaaaaccccagccataacccaactaaatcccctctcaaaccatccccct

SEQ ID NO: 77662 - DNA, 402 bp, Zea mays
  Clone ID: LIB3079-008-Q1-K1-H10
cccacgcgtccgcccacgcgtccgcccacgcgtccgcccacgcgtccgcccacgcgtccggacgaagtgccagaagcgcgcgagcatccaaggactttggctcctttccatggttcttctagcgtcgtcctctcttgtctgtgcaagcatggcggtagatgggcaaaccaaagaggacatcaacgcaacgagtgtgacgagcatgaacatgacgaggtcgtcgtcggcgagctacaacatgactggcggcggcggagaacttaacagaggtccgtgcgtcgtgagatctggattctactggtgccagaacattggctatccgaccatgtcggagtgcttgaagaactgcgaatcgtaaagcactggagtatagaaaaggaataaagtggtctctgctagctt

SEQ ID NO: 77663 - DNA, 439 bp, Zea mays
  unsure at all n locations
  Clone ID: LIB3079-008-Q1-K1-H11
atttcattcttatgcatgccattgcgttacctactctataacacaagaatttgatggatgaatcttcttgttttctttcatctttccagaactcacaacaggggtccaaatttgttaagacaggtttagatagttcaagtaacattgggagctcatcaattgcacctccgaagaaagttcaccctggatcaaatggaatgcttccgcaagaagaagcggatatgccatcacatctctctatatccactaagatgctaccaccacccctgaagagcatgctgccactgccacccagaagcatgcccccaccaccacctaagagcatgcctncaccgncaccaaaatttccttcagatgagtttttgtcaagaaacgagaacaagttttttcctttaaaggagccaacagcaccttcaaggtcctttgatgcaatatcagt

SEQ ID NO: 77664 - DNA, 205 bp, Zea mays
  Clone ID: LIB3079-008-Q1-K1-H12
cccgcacgttcgcccacgccgtttttaattctaccgccgacaaggtctacatggggagggatccatacaagagcctcgcgccgacggtcagattgttggcctattgattgatccatcactcctagctactcctactctggtcgctgcctattgattgatccatcaatcctgttaattttcagaagagtttcagaagagtcttaat

SEQ ID NO: 77665 - DNA, 433 bp, Zea mays
  unsure at all n locations
  Clone ID: LIB3079-008-Q1-K1-H2
cccacgcgtccgaaacgttttgatagtgaagttagcggtgatagagaagttcagcggacgatgttggaattattgaatcaactggatggattcagcagcgatgagagaataaaggtcatagctgcaactaaccgtgctgacatccttgaccctgctctgatgcgatctggacggttggaccgaaagattgagttccctcacccatccgaagaagcaagagctagaatcttgcaaatccattcaaggaaaatgaatgtaaatcctgatgtcaactttgaagaattggctcgctcaactgatgacttcaacggagcacagctaaagggccaagtttttggtgtaggaaagcttggtnnatgcttggcccttttacggcgggaatgccttacagagggtannactcacgaagggatttcaatgaaagggaatccgt

SEQ ID NO: 77666 - DNA, 368 bp, Zea mays
  unsure at all n locations
  Clone ID: LIB3079-008-Q1-K1-H3
gtcggacataaaaaccagaaaaggggcgtcgaacctagggtttcgtctgtctcccgacgcggccgctaggctttgcgcctttgcctgcatcactcgctcattcggagcccctctcttcgccggcgtcgtaagaagagatggcagagcgtttgacccgtatcgccatagttagcgaggacaagtgcaagcccaagaagtgccgccaggagtgcaagaagagctgccccgtcgtcaagactgggaagctttgcattgaagtgacttcggcgtcgaaactcgctttcatttctgaggaactgtgcatcggttgtggtatctgtgtaaagaaaaatggccccncatttgatgccccattgannaatcatcaa

SEQ ID NO: 77667 - DNA, 323 bp, Zea mays
  Clone ID: LIB3079-008-Q1-K1-H4
cagaagcggcggcggcggagcaaacgcatgcgaaggcgagggtgtgagggaaggagcacgagccgtggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggc

SEQ ID NO: 77668 - DNA, 415 bp, Zea mays
  unsure at all n locations
  Clone ID: LIB3079-008-Q1-K1-H5
cacaaagtggtcaaccgccccaatgtctacataaagatcccagctactgcagaatgtgtgcgttccatccaggaagttatcgctaatggcattagcgtcaacgtcacgcttattttctcaattgcaagatatgaggctgtgattgatgcttacctcgatgggctagaggcttctggcttgagtgacttatcccgagttactagcgttgcatccttctttgtcagccgagtggacacccttattgacaaaatgcttgacaagattggaacacctgaagcccttgccttgagaggaaaggctgcagtagcacaggccaaactaagccaaaaaattcggcttcttaccanngaagaaatnntctctggcccaaagggtgggaaggccgttggcccaaagaaaagggtgccaaagaaac

SEQ ID NO: 77669 - DNA, 316 bp, Zea mays
  Clone ID: LIB3079-008-Q1-K1-H6
gccgcaggcagccctcttctctctcttccgccgtctcgcctcctcacgccattgaacccgacccgcgcgcgcggcggccggcggcgagccctcacccatccgagcaagccgtggaggaagcgagcgcgcgaaagtatcaggaggaggcatgggtaccctggggcgcgcgatcttcacggtgggcaagtggatccggggcacggggcaggccatggaccgcctcggatccaccatccagggcggcctccgcgtcgaggaacaggtttcaaggcatcgtacaatcatgaatatttttgagaaagagccaaggatccat

SEQ ID NO: 77670 - DNA, 320 bp, Zea mays
  Clone ID: LIB3079-008-Q1-K1-H7
caaaggttgtctagatcgatccatcagtcttgcgattggcgacttggcgttttatgttagattgttcatgttacccaatttgttctttattgatggttcaagataagatttttgtatggatgttgctgaggtataaattagatgctccaaaggctgcatggagcagatgaagacgatgtattccacttcccatttgcatgttgtacttccatagagagatcaatgaactgttatgaagagtcactgcaactgtggcttttgatctttgtgaagtcacatacagtaattgttgttagatttgcaaatacaaggctgtctgt

SEQ ID NO: 77671 - DNA, 250 bp, Zea mays
  Clone ID: LIB3079-008-Q1-K1-H8
aaaaaaaaaaataaaataataatataaaattaaaaatagactactaacaaaaatggaaacggacaaatactcacggcggaacgtctactagatctaagctatccgatcaagccatgcaacaaaagagcgctcgaatatataactttactccaaatgactgatggacgttctatactcactgtactcaaataactatggggatcctcaacttacatggattgattaacatccacctttcaccagttactgc

SEQ ID NO: 77672 - DNA, 433 bp, Zea mays
  Clone ID: LIB3079-008-Q1-K1-H9
cccacgcgtccggtgttgttccaactgttaatcaaactgggagtccggcatcggtagggcagaaagatgttggttctcccaggaacaacaacacagttggagcatcccccccagtgaagaacccggaacagacctggagccaagttgctcccggcgggagcagtggtacagtgaataatccgaaaggaaatgctgctgctcagggcagtgctggttcatcagagaaccattcggcccaagtaaactcctcaaaatctggaaataacagcaagggtagcaggtcatcaataacacaggatggtggttctggtggaaataagaaaggtgattggtacaaggaaatggctagttgcgatatgtttagtgggaattgggttagggatgactcataccctctctaccctgagggatcgtgtcctcacattgatgagcc

SEQ ID NO: 77673 - DNA, 311 bp, Zea mays
  Clone ID: LIB3079-009-Q1-K1-A6
cactccgattatcatgattggtcctgggacagggctggctccttttagaggtttcttgcaggaaaggttagcactgaaacaatctggagcagaactgggcacttcaatccttttctttggatgcaggaaccgtaatatggactacatatatgaagatgagctgcaaactttccttgaggagggggcgctttctgagctaattgttgcattctctcgggaagggccaactaaagaatatgtgcagcataagatggtggagaaggccacagaaatttggaacatcatctcacatggtggttacttatatgtat

SEQ ID NO: 77674 - DNA, 362 bp, Zea mays
  Clone ID: LIB3079-009-Q1-K1-A8
cccacgcgtccgggtggagcatcatcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtctacgaccgcttctgcggcctgccgctcgacgtcctcgccttcgtcgaccgcaaggtggacgacacggtgcacgaggtggacaagcacctcccgggcgcgctgaatgcggcgtctgcgcatgtctacgcggtggttcggtgcgtgcctgatgtggcgcgcgagcttg

SEQ ID NO: 77675 - DNA, 233 bp, Zea mays
  unsure at all n locations
  Clone ID: LIB3079-009-Q1-K1-B1
aaccgaaagagctcctcccaggctgttcgacgagtccttccgcagcaccgcaactttctctttttccaagtactccgtcgcggacagctccatggacctgggcagctgcccgttctccgaggtcgaggtgggcggnggaagtctgcgagaaggtgacgagtcggagaaggagagggccactgttctgcgcaacaaggcgccgatgtggcacgagcagctgcagtgctggtgcc

SEQ ID NO: 77676 - DNA, 59 bp, Zea mays
  Clone ID: LIB3079-009-Q1-K1-B3
aaaaaaaatacaaattataaaaaaaattattcaaaacacaaaaaataaaaataccaaaa

SEQ ID NO: 77677 - DNA, 322 bp, Zea mays
  Clone ID: LIB3079-008-Q1-K1-G7
cgccatgcttctggaccagtaaccgctgcaaaaacaatatacgaggacagcaagggctacttgatcatcgttagcctgcctttcgctgattttcagaaggttggcggatcctgctcctgagcattgcccgccgggagagtttgtccgggagatcccactccctacccgaatccctgaagacgccactctggaagcgtactgcgatgaaacagggacagggctggagattattgtcccgaagttccgcgttggccctgaagaacacgaagtgcatgtgtccatgaggccaccctcgtcctggtgccaatgaaacctgtttcca

SEQ ID NO: 77678 - DNA, 326 bp, Zea mays
  Clone ID: LIB3079-008-Q1-K1-F1
cccacgcgttcggacgagcgcgtacgtaacttattgggaggctgcgcgtacggcaactcgggtcggctccgcgctcccctaaccggctgccacttgtctcatggcggaagtggaacaaccctccgcccgcgccgctgcgaagtgagaagggaaaacacgaaacgatcgagggaggggacgacggagcgagctagctagcggcgcggcgggcgtcgctcggcatggacgcggaggctgcagcggccgcggcggcgacagcggtggacgagagggagcggctgctgacgaacttcgcgtccgggaggacgcagccggctgcgtggcgg

SEQ ID NO: 77679 - DNA, 419 bp, Zea mays
  Clone ID: LIB3079-008-Q1-K1-F10
ctttcgtgttcatgatcaagaacggcgggatcgacaccgaggccgactacccgttcactggccacgacgggacgtgcgatctcaaactgaaaaatacaagggttgtatccatagattcgttcgagcgtgtgcccatcaactacgagagagcgctgcagaaggccgtggcgcaccagcctgttagtgccagcattgaagcatctcggcgcgcgttccagctctacagttctggcatcttcgacgggagatgcgggacgtacctggaccacggtgtgacggtggtggggtacggcagcgagggcggcaaggactactggatcgtgaagaactcgtggggcacccagtggggcgaggccgggtacgtccggatggcgcgcaacgtcagggtgagggccggcaagtgcggcatcgccatggag

SEQ ID NO: 77680 - DNA, 429 bp, Zea mays
  Clone ID: LIB3079-008-Q1-K1-F11
cccacgcgtccgtgaagatccgacgtcgttgtccctagtggctgattgggaaacgaagagacttcagttcgagctttgtcacatatcactcaattgttaagaacctcactccaactctccaagccattgtagaacatagaggcgtattgccacttgcgatgattcgtcgttcacacacaaaatattatcatgtgctacaccaattctggaagctactagaggaaaatgtgaggaatataaagaaactcttgttgagcagatgtagtctagtggtctccgtgtgcttgctgcagtgtaaccaaactccaagtagatgtgctctgggctctggcatgtggtatgtgatgaagtcgaggatggtttcttgccgtttgatgaccagtgtagtcgttggttaacttgtcagtcgtaaactgatgttgtcagtta

SEQ ID NO: 77681 - DNA, 342 bp, Zea mays
  Clone ID: LIB3079-008-Q1-K1-F3
cgctcttggatcactagctagctctcgctcgtcgcaacaagcgaagagcttggtcgtttgggttgtggcggtgatgaagagcaggacggtcatcgtcgccgccgttctgttggcggttgtcattctgtcctcgctgtgtccatgctacgaagccggcggctgtatcgggaagccgcccaagacgccggcgccgaaaaggccctgcttctcgccctactccgaggaccactgtgaccgccagaactgccgcttcgtctgcatgtcgcacggttacagtgacggtggctggtgtgacgagagggaggtgcgcaaaatgtgctgcttgctaaccccattttagtt

SEQ ID NO: 77682 - DNA, 398 bp, Zea mays
  unsure at all n locations
  Clone ID: LIB3079-008-Q1-K1-F4
ctcggcagtgcagacgcagcgcatgcaggtagcaatggcgggggagacgaagaagggccgggtgcggctggacttctgggtgagcccgttcgggcagcgctgccgcatcgcgctggcggagaagggcatcgcctacgagtactcggagcaggagctgctgggcggcgccaagagcgacatcctcctccgctccaacccggtgcacaagaagatccccgtgctcctccacgacggccgccccgtctgcgagtccctcgtcatcctcgagtacctcgaggaggccttccggaggcctccccaggctgctcccgacgccgctacngcgccgcgcgcaggcccgcttctgggcggcctactccgacaaggtctacgaggccggcacgcggctgtggaagctc

SEQ ID NO: 77683 - DNA, 189 bp, Zea mays
  Clone ID: LIB3079-008-Q1-K1-F5
gattcttgcccctatcaagtactgatgagctgtgctttgtcatcagttttggggagacatgtagtctttgttttaagtgttcggtaacagtttgtgacagtataatctggtaaaccgtgttatttttctgccactcctatttgaacacattttctagctggtgaatgaactgtttggtcgatcttgttc

SEQ ID NO: 77684 - DNA, 300 bp, Zea mays
  Clone ID: LIB3079-008-Q1-K1-F6
ggacctggcacgaggacgtcctaccgacatccataacgcgcgacggaggggcgcgcaccggcggtcctggcaccgcgcgggtcggacatgttctccacactgagaaagacttcacggacatacacttctgacctgccggctttactcttaggactgccggcagagtcgcaacgtgcctctcggccgcacaagtcacatcgcactagaggctgccgagagcctgtggaagacatcgacgcgcgcaacgtgctggagcggctgcagacggcgcacctgtaccggctgccgaggctcagggcg

SEQ ID NO: 77685 - DNA, 319 bp, Zea mays
  Clone ID: LIB3079-008-Q1-K1-F8
actagctgtggcaaaccctgttgcctacttgcaacagctgcttccattcaaccgactgacgtctgtcgaactctgctgcgtacctacaacagcgacaacagttacttaatccattggtagtggctaacccattggtcgccgccttcctacagcagcaacaattgctgccatacaaccagttctctttgatgaatcctgtcttgtcgaggcagcaacccatcgttggaggtgccatcttttagattacatatgagatgtactcgataatggtgccctcataccgacgtgtgtttcctagaaataatcaatatattgattg

SEQ ID NO: 77686 - DNA, 445 bp, Zea mays
  unsure at all n locations
  Clone ID: LIB3079-008-Q1-K1-F9
ctgggaagagctcgtgagccgtgcattgaaggcaatggccgctgttcgtagatgctgcgtgctggccgcggtgctgctgtggtcggcgctcgcttcagcggccacggccgcgccggcgcctgtggtggccgggccggtgtccagggtggaggacgccaccatgttccggatatactacggtcagagcttcaaggtcatcaagaactccggcgatggcaagagctaccttctcatgcagaacacgtccaagatggcatccaagacgaagtactgcacggngaggattaagtcgttcgtcatccccctcgccagcttctccgtcgacaccacgacctctccagtgtcattctttgagctgcttggagtgctagagagcttgaaaggaataacatcgaaccaagtcgcttctcagtgcgtgctccagtcatatacaagtggaaatgcc

SEQ ID NO: 77687 - DNA, 320 bp, Zea mays
  Clone ID: LIB3079-008-Q1-K1-G1
gcaactgccttgctccttgtagcataatgacagtcgttcgtgagtctgatacgactgccatgccatcactgtacccaaaactgtgatgggccctatctaagactgagggaagggctgtgttaacatcattcagacctgactgtaagctgtgcaaatgcttctgtcttaacgaagtgactgaatgcttcggtcaccgcatgtctgtgtgatgactgtagctgaagtacacctatgaggacaagctgcgcaagggccgaggcagaaggtagcctcaagggcatcctgggttacgttgaagaggaccttgtttccaccgattt

SEQ ID NO: 77688 - DNA, 310 bp, Zea mays
  Clone ID: LIB3079-008-Q1-K1-G10
gcggccggcgacaggctcgtcgtcgtttacttcttctctcctggcttgagatgctggcgtgcgtttcaccccaagatttgtcaatttgcggagcacaatccatatttgctgttcttgcaagtgaactactaggagcacaagtctatgtgccacagccttcatgtccatgtactacccttgttcagattctacaggggagcacagggaccactctgtagctttagttgtaccaacgcttctattaagaagtttacggatgcacttgcgaagcacaagcctgatacatggaaccttggcccaaccagggggc

SEQ ID NO: 77689 - DNA, 412 bp, Zea mays
  Clone ID: LIB3079-008-Q1-K1-G11
gcaacatataaagcacaatagtgttccaacaatggcagccaaaatatgatgcttgcttatgctcctaggtcttactgcaagtgctgctaccgcaaccattttattacaatgcttacaagctcctatagctgcctatcttactgcatacctctgaccagcggtgtctacagtatgtgaaaacctaattcttcaaccctacaggatccaacaggcaatcgcagcacgcattttacctgtatcacccttgttactccaacaactgtcagccctattacagcaggtacctatggtgcatttgatgacacatgacatcaaggtacaacaactacaacaacttgtgctaggaaaccttgctgcctactgtcagcaacagcacgattgttgcattcaaccgactggctgcatagaactc

SEQ ID NO: 77690 - DNA, 419 bp, Zea mays
  unsure at all n locations
  Clone ID: LIB3079-008-Q1-K1-G2
gctaaacccccacgccgccgcggcgaccttctccgccggcgggatggacagcctcaggggagtcaagttgccgggcgtgccgaagggcgggagtgcgctcgtgaaggtggcgctgctcggcggcgcggggctctacgccgtcctcaacagcttctacaacgtcgagggcggacaccgcgccatcgtcttcaaccgcctcgaggggatcaaggacaaggtgtaccccgaaggaactcacctgatgatcccgtggatcgaaaggccgatcatctacgacgtccgcgcccgacccaacctcgtcgagagcacgtccggaagccgcgacnctttcncaagaatggggtgaagaattgggnntcttcgtggtcccttaactcgacncnncatgccaagaaccaagcttaccttaaaaatctaca

SEQ ID NO: 77691 - DNA, 330 bp, Zea mays
  unsure at all n locations
  Clone ID: LIB3079-008-Q1-K1-G3
caagaccattctgagaaaagatcaggtatataagcagtcatcgttgctccttcgagagagtgaggaatgcagattgtgcgagaagtggagaagattttgggtcctaatgacaaaagactggtccagcaacttgttggcggagctaatcgttccaggcaggaagaagcattgaagaagaacaaaccaatcattgttgtcggaacacctggccgtatttctgaaatttctgcagcaggtaagctacacactcatggctgccgttttcttgtactagatgaagtcgaccagcttctgtcttttaattaccgtgaagatatgcatnagaatttt

SEQ ID NO: 77692 - DNA, 431 bp, Zea mays
  Clone ID: LIB3079-008-Q1-K1-G4
ctcttcgccgtccgcgagccccaccgcgtcaagttcctcggcagcgtctgcctcgccttgtccatggccgtcttcgtcgcgccgctcagcatcatcgtcaaggtggtcaagaccaagagcgtcgagttcctgcccatcagcctctccttctgcctcacgctcagcgccgtcgcctggttctgctacggcctcttcaccaaggacccctttgtcatgtaccccaacgtcggcggcttcttcttcagctgcgtccagatgggcctctacttctggtaccgcaagccccgcccggcggccaagaacaacgccgtgctgccgacgactcacgtgtaccgggcgctcaacgcccggtgcagggtgcaaggggcaggggtcatcgagccctgggcgcccaacacggggtgggccatcctgtcggtgaagccccccat

SEQ ID NO: 77693 - DNA, 421 bp, Zea mays
  unsure at all n locations
  Clone ID: LIB3079-008-Q1-K1-G5
gccctggtcgcgcggggcacggtggtgctggccgagttcgccgccgtctcgggcgacgccggcgccgtggcccgtcggatcctcgagaagctgccgcccgacgccgagtccaggctgtgcttcgcgcaggaccggtacatcttccacgtcctccgatccgacgccgccggcatcaccttcctctgtatggccaacgacaccttcggaagaaggatcccctttctctacctggaggacatccaaatgaggttcatgaaaaactacggcagagtcgcccactctgcgctggcttacgccatgaacgatgagttctccagagtgcttcncnattcaagncgaaatgggagtnntcttctccaggccaacccaaagcgcnncgacacacttccaacccgtcttcnncgtgggagaaagtcaagcg

SEQ ID NO: 77694 - DNA, 417 bp, Zea mays
  unsure at all n locations
  Clone ID: LIB3079-008-Q1-K1-G6
gccgattcgaaagcacccgtcctgtcccctcgcaaaaccctagctccagccacgatgaagggcaaggctgacacctccaagaaggacgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcaccctggcaacaagagcgttgcgaccgtgagcaaggcagcaggggaaaagtggcgtgctatgtcagatcaagagaagcaaccatatgtggaccaagctggacagaanaggaaagccagggactttatgagaaagactaaggggcaaacttttgataaagaaagggagagccacaagnnctcaaagaaagggctaagactg

SEQ ID NO: 77695 - DNA, 366 bp, Zea mays
  Clone ID: LIB3079-008-Q1-K1-E9
cttattgggcagataactgggatgatattcctttggataagagaggcaaccatccatgttttgatccaagaaaggatctagtgcttccggcatggaaggaacctaacccaggggccatatggttaaaactgtgggcaaggccaaggaacaaccgtacaacacttttttatttcaacggtaatcaaggttcagcatacgaaggaggccgtccagaagacacgtatagcatggggattcggcaaaagctagcagctgaatttggttccacaccaaacaagcagggaaggcttgaacggcagcatgcggccgatgtgacagttacctatctacgaactgaaaaatattatgaagaattagcacgctctg

SEQ ID NO: 77696 - DNA, 345 bp, Zea mays
  unsure at all n locations
  Clone ID: LIB3079-008-Q1-K1-D3
tcccgtcgccacgcgtcgcaaagcgcagcgtgcagctgagcagcgccggcagctggatggcagtggatggagtgaaaaagagccgccagaaacagaggaagcaggctggggcttcgtagatggggaagtctccagccagggccgggcgaggggtggcgagtcagtctgcagtcgtcggtcggacaggtcagtcgggcgcacggcgcggtccaagtcgtcgcgagagaaaagcctgtgccgcggaacggacactcggggaaggcctggtgccgtgggcgctggtggtggggacggccgaagctgctgctacatccacctgcggagccgcatgctgntcatgggcag

SEQ ID NO: 77697 - DNA, 108 bp, Zea mays
  Clone ID: LIB3079-008-Q1-K1-D4
aaaaaacacaaacaaaataaaaacaaaaatttaaaaaaaacaaacaaaaaaaaaaaacaaagaaaagtttaaaactaaaaatatgaacctcataaaaaaatacaaact

SEQ ID NO: 77698 - DNA, 317 bp, Zea mays
  Clone ID: LIB3079-008-Q1-K1-D5
cccacgcgtccggttcgtggccgttgcggtgctgctggggctcgggcgcggcgggcgtgggttcccgacccagatgtcccgccgctacggccggagcttctcctactgcctcgtcgaccgcacctcctccggcgcgggcgccgcgccgggctcccaccggtcctccaccgtcagcttcggggcgggctccgtcggcgcgtcgtcggcgtccttcaccccgatggtccgcaacccgcgcatggagacgttctactacgtgcagctggtgggcatcagcgtgggcagcgcgcgcgtcccgagcgtggccgagtcggacc

SEQ ID NO: 77699 - DNA, 369 bp, Zea mays
  unsure at all n locations
  Clone ID: LIB3079-008-Q1-K1-D6
ctcagcgcgacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccaggaggaggaggactggaagcgcatcgaggaccgaatcggatgcgggcaggtcgaggagctcatcgaggaaggctcggaggggaacggagcctcaaagctttcatcgcttannaaatgat

SEQ ID NO: 77700 - DNA, 386 bp, Zea mays
  Clone ID: LIB3079-008-Q1-K1-D7
ctgatgcttactccaactgcgcgaagaagccatcctgatatcccttttggcttggtcaggctagtagtttaggatttctcgtctgacactttgattctgaccaatctctctggcctgctgcttgctgataatcgaccagttccccagccttgctccttgcactcctccctccatctgcagcattgcgttctgattcacctgctccaatgctgtctttctgctgctgagcttcacggtctagctatcgttttgagggctatgagacgccctgagatccatcttgagcacctgcttgggccctatggagcgtacgtttgcgtgccctctccagggcccagattgactctgttctggatcttgcacgtgtgcacaattgtgtctgagct

SEQ ID NO: 77701 - DNA, 318 bp, Zea mays
  Clone ID: LIB3079-008-Q1-K1-D8
ggcgcggacggtccgcggcacagggccggacggtccgcgacctggcgcagggctagggggctcttgctggaatctagatctcgtcccctggggggaaaagatcttaaggtgctccgggtcgacaggtcacccggggcgtccccagacgacgtggagtcgcctaagaattaagagatcaaatcgaggaagaagtcttggatgaacaactagatcttgccccccgggaggggtgagatcctagggtcgtcttgggatcgacatgccacccaagacggatctagacgacgtaaagtcgaataggggtggatgtggatatgt

SEQ ID NO: 77702 - DNA, 298 bp, Zea mays
  Clone ID: LIB3079-008-Q1-K1-D9
atacccagcccgacccacgcatacgcccgcgcgtaattctcatacattttccctttctaaaaaaaaaggactcttaagggcactttaaaatttaaaaagggacaggcccagctaccgttcacaatctataaccttactcgactctcaagctcctaacgtcactattattaacaaattgaagcatactattgcctgtgagaaaattcaacgtgtcatacctggaataaatatctcacatccacataaatgttattcatataacatccaacatgaaaacactatattatcccataatata

SEQ ID NO: 77703 - DNA, 406 bp, Zea mays
  Clone ID: LIB3079-008-Q1-K1-E1
ccgctctccagaaccccgcgcgtcccctcgcatcgtccctctctccgccgactccaaacgctaacccgcgcgcttacctcctcgtcccctcaggccatggcgtcgtcccctacccccaagaaggtgctggtcccgatcgcgaatgggacggagccgatggaggcggtcatcaccatcgacgtgctccggcgcgcgggggccgatgtcgccgtcgcttccgtcgagccgggggcgacgtccgagctgcctatggggcatcaagcttaccgcgacgcgctctcgcgacctgcgacagagttcgatctatctctctaccgggaggggatgcctggttcttcgacttttggagagtgcaaaagttttggagaaaatggtcaaaaaacatgtagagaagggcaaagcttta

SEQ ID NO: 77704 - DNA, 218 bp, Zea mays
  Clone ID: LIB3079-008-Q1-K1-E10
gtggagcgtaaatgatagtatggtccttgttaaagtcaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatggcagaaacatattaaaaattaactaaacattattatccttagaaaaatcaaca

SEQ ID NO: 77705 - DNA, 378 bp, Zea mays
  Clone ID: LIB3079-008-Q1-K1-E11
gcggccagtagcagcggagcagccttcgcggcgcccgccacgccggcgctctcgcccgcgtcctcgtgcgtcaccagctcctccagcggcgacgtgcgcctcggcgcagcgtacacggagccgccgccgcctcggcagcacgcggggctcgtacgctctgacgctccgcggacggagctcgcgcccgtgccggcagtcgcgcacctggacggcgcctgctggccggccgcggcggcgctggacgtgctcctgcccgagctcggcggcgagcagctgttcccgtacgggtacggcgacttcttcggcgggctgcaggacagggccctggagcagcagctctcgtcgtgctacttccccaacgtggccgagatatggggc

SEQ ID NO: 77706 - DNA, 231 bp, Zea mays
  Clone ID: LIB3079-008-Q1-K1-E12
aataccctgctcgacccacgcatactcccaaccttcttaacacacatattttaatttaaccaaccattattatacacatggaactgttaaatttaaacaatgaattcccaaaccataaattcaacatcaactaatacattaaatatacttcttatttaaatccttacaaagcataatatatccaattccaatatattacttaattctacaaattatactttatatatcaac

SEQ ID NO: 77707 - DNA, 389 bp, Zea mays
  Clone ID: LIB3079-008-Q1-K1-E2
cttcatgtaaaatctgccatggcagaactttctagatatgaaagagtagatgatggagagagtgtcaagtactcagagttgttctatggtcgccacttcaatgttgtttttattggcacaacgctctttgctttacaacagttatccggcataaattctgtgttctatttctcatcaactgtattcagaagtgtgggggtgccctctaaccttgcaacatatgcatgggatctaatctatagacatgacatgctttaggacaagctagtaaaagtgctttttagagttctggatggcttttgcaatggggcttcaggctgttggagcaaaccgtcagtattcttggttctgcatgtgtatatctttcagttggtggccatttctgttgt

SEQ ID NO: 77708 - DNA, 379 bp, Zea mays
  Clone ID: LIB3079-008-Q1-K1-E3
cccacgcgtccgattcgtgcctgcctgccctgcctctcggacacctccctcgtcctccggtccgacccgccccgtcctcggccccacgcgctgccgggccgatgcgcgaacccgacctctctccgcgcccgtccctgccaccggtcgccgatattggaaggagctcgaggctgggcgctgacctgagttatggaagggatgccgactgcaacagtactcgccaagcatgcctaagtcgaagaagctgagactgcagctggaagcgctggaaccggctacctgtcgcaggggccaggaaagcgtgctcctacacgtgctgctaggggcagaaagggtgccactgggaaaggagtgccccctgcacctaccgactagaaga

SEQ ID NO: 77709 - DNA, 387 bp, Zea mays
  Clone ID: LIB3079-008-Q1-K1-E4
cgcctcgacgccgtcgtggcccgcctcgacacgcaggccaagatgcaggtcatcggcaagtccatgcagtccatcgtcaagtcgctcgactcctcgctcgccaccgggaacctccagaagatgtccgagaccatggacaatttcgagcgccagttcgtcaacatggaggtccaggccgagttcatggagggcgccatggccggctccacctccctctccacgccggagaccgaggtcaacagcctcatgcagcaggtcgcggacgactacgggctcgaggtctcgtcgctgcgcagcgcgccacgccatcctgccgccaagggataaggagaaagtcgacgaggatgacctttctcgccgcctcgccgagcttaaggcccgcggctg

SEQ ID NO: 77710 - DNA, 359 bp, Zea mays
  unsure at all n locations
  Clone ID: LIB3079-008-Q1-K1-E5
gtgaaaacccaattgttcaaccctacaggatccaacaggcaatcgcaacaggcagcttacgattatcacccttgttcctccaacaaccgtcagccctattacagcagtaccttggtccattggggccaacatcagcacacactcacactggctgcaacctgtgatactctacacatagtcttcatcccactggctgatgaactctgtgtattgcacacatacattcaccgctgtgctgctacccagcattcttcattcaaccactagcagncattggaactctgctgcttatttacagcagcaacaactactaccattcagccagctagctgatgtgagccctgctgcctttcttgaca

SEQ ID NO: 77711 - DNA, 355 bp, Zea mays
  Clone ID: LIB3079-008-Q1-K1-E6
ggaaaacttcagcacaactgttaatggtatgccaaacctatgtataaaactgtgccgggggctcctaatttcacttctatgaactgtactaatttgcatcgaagaaagtttggtcccaaacaactcgtgaactcgttttcttattattgggctgatggacaaggcaacgtgaaatttttcatggtacctgggaacagaacttagcctacaaactgcagaaccattctcatttcatcttgtagtcttgtcttgctaataatggactttgtgggctgtctgttccctgtgtaattcatttggccatgacagttcttgatcaatggttggatttattcataggaatggtgttcaaaaa

SEQ ID NO: 77712 - DNA, 329 bp, Zea mays
  Clone ID: LIB3079-008-Q1-K1-E7
ctcccccggcgtacctccggagatccaccccgactaccaccggtgcctcggcgatggccgcgtcaccaccgaaccaagtcccgcgtccctggtcccgccggcggggcccacgccaggcggtccctccgtctctcatcgacagactgcgcgccggttcgcgattatcagcttccgccctactcggaaggagaccggaccctctcagacgcgttccgggcttgcagcctgtccgctaccgcgcgcgatgcagcccgtccgggggagcctgagattgagtgcacaggggaaggggtgttggttcgtggaggccgaagccagctgctccctcg

SEQ ID NO: 77713 - DNA, 373 bp, Zea mays
  unsure at all n locations
  Clone ID: LIB3079-008-Q1-K1-E8
gcggcgtgccggtgctggcgtggccaaggttcgcggaccagcgagtgaacgcccgcgtggtggtccgttgcgggctcggcgtgtgggctgatcagtggagctgggagggggaagaggcgctggtgagagcggaggagatcacagcgctggtgatggaggctatggaagatgacgcgatggcagtgaaagcggcgaatgtccgcgaggctgcgtcgagagccgttgtggacggcggcacgagctaccgaagcctggcggcgttcgtgcgtcgttgcaccgcatgaagttatataaaaattacttatataacttaacttcaaccggggtccttatataaactttttaaaaaatatgccctnnattccagaacata

SEQ ID NO: 77714 - DNA, 430 bp, Zea mays
  Clone ID: LIB3079-008-Q1-K1-D11
gtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaagccaagccaagcaggaaggcccccggcattgctagctgtacgtgtctgtgtgtgcatctgcagcagggtgcaggcaggggcccgtacgtacgtgtctctttctctctctcatcttgtcaccgtacctatctagagtgtgtgtgttcgtactaattaaaat

SEQ ID NO: 77715 - DNA, 327 bp, Zea mays
  unsure at all n locations
  Clone ID: LIB3079-008-Q1-K1-B3
cccacgcgtccgcccacgcgtccgcagcgtgcaacctaggcgagaaccgcctncccctgcgctccttccagctcgctctgtaatctgcatcagcctcgcccgccgccgtcgccgccatggggaggggaaagttcaaggggaagcccacaggccgccgcaacttctccacacccgaggagatcgctgctggtacttcaggtcggccacgcacctttaagaagaaggaggaagaggaagatgaggaagaggtagaaagagaagagtctgaggaagaatctgaagaggattctgatgaaaagactaaacataaaggcactgagggtatta

SEQ ID NO: 77716 - DNA, 352 bp, Zea mays
  Clone ID: LIB3079-008-Q1-K1-B4
cgcatctctctaaccgccggcgccggcgcttgcgccggccatcgttcacatggctgcgatgccaccggccttcacgggcaacctgaagaaagcacttgcaggtctgagaagaatcaatttagatgggcttcgatggcgcgtatttgatgctaagggtcaggtgctgggacgattggcttcccaaatagccgttgtgcttcaaggcaaggataaaccgacctatgcgccacatgtggaaaatggagacatgtgcattgtacttaatgcacaggatatcagtgttacaggaaggaaaatgacagataagatttactactggcatacaggggggtattggtttgggccatttttg

SEQ ID NO: 77717 - DNA, 320 bp, Zea mays
  Clone ID: LIB3079-008-Q1-K1-B5
gccgcaccgcgtcagggtgctcgtcagcgtctgcctcgccttctccatggccgggttcgtcgcccccctgagcgtcatcttcgttgtgatcaggacgaagagtgccgagttcatgcccttcaccctctccttcttcctcaccctcagcgccgtcgcctggttcttgtacggcctcttcaccaaggacccctacgtcacgctcccgaacgtgggcggcttcttcttcgggtgcatccagatggtgctctactgctgctaccggaagcgcaagccggcgtccgtggtcgtcctgccgacgacgacggccgccgcagccgtgg

SEQ ID NO: 77718 - DNA, 209 bp, Zea mays
  Clone ID: LIB3079-008-Q1-K1-B8
aaaaaaaaaaaaaaaaaaaaaaaaaaaaaataaaaaaaaaaaaaaaaaaaaaacaagctagggtacacataaataacggcacgagatctattatataataatacaatacatacaattcattgatacgggttagataatgtattgactgacaaaacttttgtcgacctgaactctataacaacgagcagatcgtcaactccatagctttc

SEQ ID NO: 77719 - DNA, 400 bp, Zea mays
  Clone ID: LIB3079-008-Q1-K1-C1
agcaattcagaaagttgctgctgcttatgattgcaaaattgtggaaggtgttcttagccgtcaactgaaacaatttgtgattgatggtaacaaagttgtgctcagtgtctccaatgctgatacaaaggttgatgatgctgaatttgaagaaaatgaagtatatgcaatcgatattgtcaccagcactggggaggggaagcccaagttattggatgagaaacagaccaccatctacaaaagggccgtagacaagaatatacttgaagataaagcgtaaggtattttaggagacaccaattcaatatgcctttacctgctagggcattagaagagaagcgtgcgcgtttaggcttggtggaatgcatgaaccatgaactattgcagccgtaaccctgtactt

SEQ ID NO: 77720 - DNA, 118 bp, Zea mays
  Clone ID: LIB3079-008-Q1-K1-C10
taaaaaaaaaaaaaaaaaaaaaaaataaaaataaaaaaaaaaaaaaaaaaaaaaaaaaaaaggtgtaaatttaaaataataaaaaaaaattaaataaataataaaaaaatataatata

SEQ ID NO: 77721 - DNA, 414 bp, Zea mays
  Clone ID: LIB3079-008-Q1-K1-C12
aataccggcccgacccacgcgtcctatcagccgatgatttgcggataattccttttaatttggaaatcaacaatcaaggggtcggtgttattgatgttaagcctacaaacatggaatatctcactgaggtgataacatctgctgaattccatcctactcattgcaatacattggcgtatagtatctctaatggctccattcgacttgttgatctgcggcaatcagccctttgcgacaatcattcccaaatctttgagcatcatgatgccccatgttcaagatcatttttcactgagattatagcttcaatttctgacataaaattttcgaaagatggtaggcatattctcagtcgtgactacatgactctgaagctttgggatgttaagatgaattctggtcctgttgcaacat

SEQ ID NO: 77722 - DNA, 415 bp, Zea mays
  unsure at all n locations
  Clone ID: LIB3079-008-Q1-K1-C2
ggtaaatggacagctgcagacaagcgacagctctgtgtatgccgttggcgatgtggccgggttccccatcaagctttttgacgatgatatccgacggctcgagcatgtggactcagctcgtagaactggtagacatgctgttgcctccatcttggatccttcaaagacgagggacatcgattacctgccgttcttctactccagagtgttcacgttgtcctggcaattctatggggataatgtcggggaagtggtccactttggagacttcacaagcagcagtccgaggttcggtgcatattgggtcaacaaagggcggatcgcgngnngttgccccgtttcttggaagggggcggaaagtcgggaagaaggtaccgaagggcccatatccgnaatcgctgtnntcgggcgggaa

SEQ ID NO: 77723 - DNA, 419 bp, Zea mays
  unsure at all n locations
  Clone ID: LIB3079-008-Q1-K1-C3
gcagaaggttcttcagaactacaaaaatcttcaggatattattgctatcttgggtatgggtgagctcagtgaggatgacaagctgacagtcgcccgtgcaagaaagattcagcgtttcctgagccagcctttccatgtcgctgaagttttcacgggtgctccaggaaagtatgtggagctgaaggaaagcgtgaagagtttccagggtgttttggatgggaagtatgatgacctccctgagcagtcattctacatggttggtggcattgaggaagtcattgctaaggctgagaaaattgccaaggagtctgcttcataaggaggggcttctttggctttgggttcaacccttgtnnacaagttccaaatttttggaatnntttaaagcgtttaatttatgcctttttcccaagttaggc

SEQ ID NO: 77724 - DNA, 324 bp, Zea mays
  Clone ID: LIB3079-008-Q1-K1-C4
cggcgcctctgccctcctccgggctccacatagtgaaaaagtctcctcttttcctcttccgctcgcgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtc

SEQ ID NO: 77725 - DNA, 428 bp, Zea mays
  Clone ID: LIB3079-008-Q1-K1-C5
agcgagaacgccaaacgagaaaagtaacctaagccttcgccatcaaaaaaaaaagagagagggaaaaaaaagagcagaaaaagtagagtagactacgacagcgtccggcgaggaggcggaggcgaagatgaggaagaagctcggcacccggttccccgcggctcgaatcaaaaagataatgcaagcagatgaggatgttggaaagattgcactagcagttcctgttttagtttcgaggtctcttgaattgtttttacaagatttaattgaccgtacttatgaaattactcttcaaagtggagcaaagacactgaattccttccacactttggaaagccaatgttggtgaaggaaggtacccagttctttttgaatttccttaaacctgaaagtttgttcaagcaaagggtaccatgattcttgggtgg

SEQ ID NO: 77726 - DNA, 373 bp, Zea mays
  Clone ID: LIB3079-008-Q1-K1-C6
cccacgcgtccgcgatatcttctcttcacgctttggcgctgagggttccaccagtgtgcggcagccaccacgcaaggcagctgcaattgagaacccacttccagtcagccttgcagatctgtacaagggtgtcacgaaaaagatgaaaatctcaagagaggctatagatgccagcgggagaatctcaaacgcagaggatattctgacaatagaagtaaggcctggttggaagaagggaacaaagattacatttcccgacaaggggaatgaagctccaaacatgaaagctgctgatattgttttcatcctcgatgagaagcccccattggattgttttttcacctccgggattgggaaatgaatcttggtggtt

SEQ ID NO: 77727 - DNA, 218 bp, Zea mays
  Clone ID: LIB3079-008-Q1-K1-C7
accacgcatccgcaatatcttcttttcactctttggcgctcatgattccaccaggatgcgtcagcctccacacatggcaggtgcaattgaaaacccacttacagacagccttacacatctgcacaactctatcactaacaagatcaaaatctcaacatagcttatatatcccagctcatgtaatctcaaacacaacccatattctgacaatctaacta

SEQ ID NO: 77728 - DNA, 322 bp, Zea mays
  Clone ID: LIB3079-008-Q1-K1-C8
gcccatttgagcctccgaagccaaagacaaagcataaggttgacattgacactgtcgagggattccagacactgcgtgagcaagagcagaaatactttgatgaaatggttcagaagtgcaaggatgctggtgcaaccctggttatttgccagtggggttttgatgatgaagccaatcatttattgatgcatagaaatctgccagcagtgagatgggttggtggtgttgaattggaactgattgccattgctacaggaaggcggattgttccgagattccaagagttgagtcctgaaaagcttggaaaggctggattaagtca

SEQ ID NO: 77729 - DNA, 447 bp, Zea mays
  unsure at all n locations
  Clone ID: LIB3079-008-Q1-K1-C9
gagctgctggcaccaccaaaccaatcgctggatttgtccagagtatttccggttgcaccgccctagatctgacccgagacgccgcgtcttcgctgagatggcgattactgtgaggcggtcgacgatggtgcgcccggcgcgggagacgccgcggcagcggctgtggaactccaacctcgacctcgtggtgccgcgcttccacacgcccagtgtctacttctaccgccgcgacggccccgtgccggatgcggaggggttcttcgacggcgagcggatgcggcgcgcgctggcagaggcgctcgtgccgttctatccaatggcgggccgnctcgcgcgggacgaggacggtagggtcgagatcgactgcaatggcgagggagtgctcttcgtcgaggccgacgcgcccgatgcctctgtcgatgactaccgtgacttcgcgcccaccat

SEQ ID NO: 77730 - DNA, 322 bp, Zea mays
  Clone ID: LIB3079-008-Q1-K1-D1
tcccggtcgccacgcgtccgaccactgttcccacggaggccgcttcttcttggcgatggacgtgccgcgcgccattacctgggcatggccgacctatccaccggtcactcacacggcccgctagcggactgctggcggcgcagcctagcggggcggcccgagggaggcgctacttctgcggcgggaaggagcatcgggcgtcgcgcgcggggcggcctggccggctgaaagcgcggcgccgtgcgcgcccagagtcccgacggcgaggctcgcggtcgcggcggacaggccgcggaggctggtgctgctgggcgccgatacg

SEQ ID NO: 77731 - DNA, 328 bp, Zea mays
  Clone ID: LIB3079-008-Q1-K1-D10
taaaaaaaaaaaaaaaaaaaaaaaatttaattaaaaaaaaaaaaaaaaaaataaaagaaacagataaaattaaaattaaaaccaaccaacataaaaaatactcactaaaataataacaatcttcctaattccatcctactcactgccatacattcccgtatattcactctcacggcttcattcaactcgtctatctccaacttattaccctttacaacaataattcccaaatctctaaaccccattatgccccatgctcaatatcatttctcactcaccttatatctccaatttccaacataccattttcccccgatctaatacatat

SEQ ID NO: 77732 - DNA, 323 bp, Zea mays
  Clone ID: LIB3079-008-Q1-K1-B2
ggcttccatactgggctgttcacctcaccacatttgatggatgttagagagcgatttcagctagggttaatatttgaatatttctgaagagaaatttttgaagtacttctggtggtgctggaacaagttgaaggagaagactgatgatgatattcccatgccagcctatttcaggttcctcgcgctgctcgcattcaagatattttctgctgagcaggtagatgttgctgttctcgaggttggcctaggagggaagtttgatgcaactaatgtggttaaagcacctgtagtttgtggcatatcttcccttggatatgatcata

SEQ ID NO: 77733 - DNA, 257 bp, Zea mays
  Clone ID: LIB3079-007-Q1-K1-H5
aaaacatgaagtcctggggttattgttaatctggtgccattgtaaggacatatgagtggggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagaattgtgttacagtgcgtgt

SEQ ID NO: 77734 - DNA, 432 bp, Zea mays
  Clone ID: LIB3079-007-Q1-K1-H6
cgggaaagaaatcttcatcaagcaacaggtagcgggagcggacgcgaggtgaaccacgagctggccagtgccggccgaggctagggttccggggatcgcgggcgcgggctcgggctcgactttcgtagcctagccgccgccgccggccgcgcgggggaaccggatgctatgctgctgagctgcgggtcgctctcctcctgggtgcgccgcttcgtcgcctgcgttggaggttgttttggttgtgcccagcctactccaataatagctgttgacaagcctacaaaaggtttaagaattcaaggacgctcagtaaaaaggcgcaacgtatcagacgacttttggagctcgagcccacacgaaatggagaatagtgccttgcaaatcccgcacagtatgtcctcaatcagcacagcagcacagcctaatgatcag

SEQ ID NO: 77735 - DNA, 426 bp, Zea mays
  Clone ID: LIB3079-007-Q1-K1-H7
cccacgcgtccggacagcgtccggcgaggaggcggaggcgaagatgaggaagaagctcggcgcccggttccccgcggctcgaatcaaaaagataatgcaagcagatgaggatgttggaaagattgcactagcagttcctgttttagtttcgaggtctcttgaattgtttttacaagatttaattgaccgtacttatgaaattactcttcaaagtggagcaaagacactgaattccttccacctgaagcaatgtgtgaagaggtacagttcttttgatttcctaactgaagttgtcagcaaggtaccagatcttggtggcgctgattcctgtggagatgaaagaggattacctagaagaagaaagtcaaatggcagtgacccagagaatgatgaatcaagatctagtaaaatggccataagaaatgc

SEQ ID NO: 77736 - DNA, 286 bp, Zea mays
  Clone ID: LIB3079-007-Q1-K1-H8
cactaatgacttacactgattcctttacagcccatggtgacttaatgggtggctcaatctatccactgctagtacaactgtttctgaaggcttcacaagataagcgtattgtctgtgaagctgcacaggcagctcttatatcgatgacaagtttgatctcccctttactactcttgccaagaatgctgccttacctcaagaacaagaatccactgatccgagcaaaagcatcactgtgtttcatctaaagtgtaccactccttgatgtgctgggaatcaaagaata

SEQ ID NO: 77737 - DNA, 401 bp, Zea mays
  Clone ID: LIB3079-007-Q1-K1-H9
agaacaattacgacgtaccttacctagcggctgctgcttcggccggcaaattgggttgtgctcgtggtcatggacacccttgtgttcgttaggagggggtcggggtggaacggtgaaaaggaagctgtagatagaaaaggcaggcgtctcatgctcttgttgtctagtctaatttttaattttactcggcttattaatcacggtactgactagctgcctcaaaacctgctcctcccagcagtaccttgagctgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaggaagcaacaa

SEQ ID NO: 77738 - DNA, 261 bp, Zea mays
  Clone ID: LIB3079-008-Q1-K1-A1
gcgagccacagctatcagccgaggttagttctcgacttccgcacatggtggataagcagcgccaggggtactagcattaaaggcccgtagaccgctaggacgtacacgtggccgtctcgcacaatacgagtacaatgcgatgcctggactacgagaggaacctgctcacgtaaaccgaggtggacgccatcggactcctctagatgtagtcctacatcttcaagcacacgaaccgtgaatatgcgactgtgactgtgtttt

SEQ ID NO: 77739 - DNA, 446 bp, Zea mays
  Clone ID: LIB3079-008-Q1-K1-A10
ctgtcccaagttcgatctcatccttctcaccatgggctccgatgggcatgtggcctcgcttttcccgaaccaccctgccatggagctgaaagacgactgggtcacctacatcaccgactctccgcagcctcctcctgagaggatcaccttcactctcccactgatcaactcagcatccaacatagcaatagtgtccactggtgatgacaaagcaaaggctgttcacatagcagtttctgacatggccgaaggtcttgatgctcctacatcactgcctgctagaatggtccagccaacggacgggaagctggtatggtttctggacaaggcggcggcatcattccttgactccaagaacgacgacgacgacgcttgctacgatcgtcacgagtgactaactctgaggatcgttggtcgttttgaagcgaatgaacggaggtgtgtgt

SEQ ID NO: 77740 - DNA, 450 bp, Zea mays
  Clone ID: LIB3079-008-Q1-K1-A11
ctctctccgtctcttgtgttgaaggggagacagagaagggtaggcgacacgccatggaaccgacaaggctgctgcttcttctcctcgttctcggcgtgtcgctgcaaggatgcattgcgcagggcggcggcggcgccggagggctcacgcgggggagcttccccaagggattcgtcttcggcaccgcctcctccgcttaccagtacgagggagcggtgaaggaggacggcagagggaaaaccatctgggacaagttcgcgcacacgtttgggaaggttgcagacctgagtaacgccgatgtcgcggtcgatcagtaccaccggttcgaggaggatatacagctcatggcggacatggggatggacgcgtaccgcttttcgattgcctggtcgaggattctgcccaatggtaccggccaagtcaaccaggccggcgtcgaccactacaaca

SEQ ID NO: 77741 - DNA, 425 bp, Zea mays
  unsure at all n locations
  Clone ID: LIB3079-008-Q1-K1-A3
gcgaaccacacctagcagccgaggttagcacgcgtcctgcgtccatggaggacgaggagcacgaggtgtacggccaggagattcccgttgacggcgaggacgtcgacatggctgccggcgacgatgccaccaagctgcaggaacttgacgatatgaagcgccggctcaaggaaatggaggaggaggccgncgcgctccgcgagatgcaggccaaggttgccaaggagatgcaaggtgtagatcccaatgcaaccacatctgaaaacaaagaggagatggattctcggtcagtattcattggaaatgttgactatgcgttgcactccagaaaggaaaaagtgcaagcaagcactttccaaattcttgtgggaacctggtcaacaggagttaccaaatcnctgactggggacaagtttggggcaacc

SEQ ID NO: 77742 - DNA, 370 bp, Zea mays
  unsure at all n locations
  Clone ID: LIB3079-008-Q1-K1-A4
ccacgatcccgacaattggattcaacgttgagacggtgcagtacaacaacatcaagttccgagtatgggatcttggtggtcaaacaagcatcaggccatactggcggtgctactttccaaacaccncaggctatcatatatgttgtgattcaagcatacaatggctgtacacaagagaattcatgatcttgagaggaactaaagggcagtgtcttggatgcaatacagacttcaggcctcgagatgctgcaacaatattagactccaaataaaccgcaatgggcgattttcaaaacatctgcaataaagggagaggggctcttcgaaagtttggactggctcagtaacacgctncaaatctggaagcagc

SEQ ID NO: 77743 - DNA, 326 bp, Zea mays
  Clone ID: LIB3079-008-Q1-K1-A5
gcccaccaccgtcgccagccctcgctcccgctcctcactgaaggggacaggagcaccgaggagaggaggatcgacgccctggactaccgcaccggcgagcggcgccccatcgcgcggacaacaggccggaccgccgccaacggggacgacctgaacgtgctggcttcctgcgaaggcctcctcatcctcctcgccaacggcggcctccagatctgcaacccggcgacccgccagcgcgcgccactcactcttctccacggcgcctattgcatctccgcgctttatcctcacatcccgtccaggtcgtaccgtgtgctctgctggct

SEQ ID NO: 77744 - DNA, 140 bp, Zea mays
  Clone ID: LIB3079-008-Q1-K1-A6
cccacgcgtccgctgatgaaaagaatggtgcttctgaatctttccacaaacagtgtgctggtgcccggtaatggctgttggattaatgtaggtttgattcaattaatatttaataatagtcaatgctaatagtctacttt

SEQ ID NO: 77745 - DNA, 329 bp, Zea mays
  Clone ID: LIB3079-008-Q1-K1-A7
cggtctcggaatatcccgggctcgtacccacgtcgtctcgtgcgcactacacactacaactcgagatcttcctcccataatccacacctgtcggcaccctccgcgtgcaaggagtgcagatcgttatgtgacaaacccgtgactaggcaaagacgtatcagccgctcgagtgtgtgagtgcgtcatgacaaccgattgacacacgtataagtgccaagtatccagtgacacaggacgggccatccctcccagacgcagcagtcggtctcatcttttgcatggcacaacacgcttgaggaccgggccgcacgcctatgctgacatacaac

SEQ ID NO: 77746 - DNA, 450 bp, Zea mays
  Clone ID: LIB3079-008-Q1-K1-A9
gatctttcccccgtcctccctcgccttcgccttcgccggcaggagatttccaccaccaccgccgaaccgccccgaccctcctcccctctcgcgctatggcccagactgttgtgctcaaggttggcatgtcctgtgagggctgtgttggagctgtcaagcgggtcctcggcaagatggaaggcgtcgagtcctacgacgtagacatcatggaacagaaggtcaccgtgaagggcaatgtgacacctgacgccgtcctgcaaactgtttccaagactggcaagaagacttcgttctgggaggctgaagccgtgacaagtgaatccgccacacctgccggtgccaccgcctgacaggttcgatgatctggaagtgcccggcaaggcggcaaagaaaaaaaatgtgaatgtatttagcttggatctgttacaaataattgcaaactgctagctc

SEQ ID NO: 77747 - DNA, 322 bp, Zea mays
  Clone ID: LIB3079-008-Q1-K1-B1
gaactatagcagtagccggtctttgtctttggctctatgctacctgcttgtttaattgcgacaaagatgaacggtctctcatttaagctgaacctctacctgtattgatatccctggattttttctgagccaccacctgttgtgatttgtgaacgttgtaagaataggtttctttgcttgggttcgcttgttgctgtcgaaaatatgtaacgaatgttattaataaagaatttcttgtatgactttaaaaaaaaaaaaaaaaaaaaaaaaaaaaaaaaaaaaaaaaaaaagaaaaaaaatataaaggaaacaaacattaaaa

SEQ ID NO: 77748 - DNA, 326 bp, Zea mays
  Clone ID: LIB3079-008-Q1-K1-B11
gatgaggcaaaggtgcagaggttggagtatgatcactgtctttgtgacgagcggtgtagtgactattgaactgaccgtagcgctcctgttatgtggatgaagtggaatgctgatatggggaacggacttcatcacctgcaagtgcaaattgatatgcatggtatgagctagctcaaagtggatgggagtgatggtacattctacatgtgcaatgaaccctgttgaaaacgacagcattgttgctgagatgctgcggagatattacgactctgttgaactatttgatgtcactaatgaactaactgaattagtccgtcgtcctggac

SEQ ID NO: 77749 - DNA, 408 bp, Zea mays
  Clone ID: LIB3079-007-Q1-K1-H4
caaaactgcactaatgacttgtgctgacatctttaaggcctatggtgacttaatggtgcactcaatcgatccactgctagtacaactgtttctgaaggcttcacaagataagcgttttgtctgtgaagctgcagaggcagctcttatatcgatgacaagttggatctcccctttactactcttgccaagaatgctgccttacctcaagaacaagaatccacggatccgagcaaaagcatcagtgtgtttcagcaagagtgtaccacgccttgatgtggtgggaatcaaagaatatggtatggataagctcatccaaattgcggcaacccaacttagcgaccagcttcctgaatcaagggaggctgctcgcaacctggcactggaactgcaagcattctatgagaagtc

SEQ ID NO: 77750 - DNA, 272 bp, Zea mays
  Clone ID: LIB3079-007-Q1-K1-G11
ttgattttttttttttttttttttttttttttatttttttttttttttttttagtttgttttttttttatattttaattttttttttattattaattaaattttaatttaaattttaaaaaaaaaataaaaataaacaataacttcattaaactatataatataataaaaaacaaaataaaaataaacaaaaataaaaatattaaaaaaaaaaactaaatcaaaaaccataatataatacaacacattaccataaaaaaataacattacatt

SEQ ID NO: 77751 - DNA, 370 bp, Zea mays
  unsure at all n locations
  Clone ID: LIB3079-007-Q1-K1-G12
gaagaattctctcacatatgacatggataaacattgcaacacagaaatagctgctaaggtggttcgtgtgtcatctaacccaaatgatggagaacacgagaagtaccgtttggagggtttgatggagagtccagccgtcgatgatgatggggaatgcttctctcctatcttattgaatgcaacttctttgaatgttgaagtttattacaacaaagcagtcaactacacactgatggtcacttttatctctttccttcaagttttgctgctgattagacaaatggagcataacaacacacaatctggagctgctaaggtttctattntaatgattggccaacaagctatcatggatgcatatctctgtcta

SEQ ID NO: 77752 - DNA, 429 bp, Zea mays
  unsure at all n locations
  Clone ID: LIB3079-007-Q1-K1-G2
gagagccgaacgtgacctcccagccgccccatgctcaccctccccggtaccctccggcgggcgcgcgctcctcctggcctacctccccgccgacacctctcccgcctcctggaccgttacggcttcgtggccccggactccctcaccccggccccgcgagaacctcacagcgacaccgccgactccgccgccgctgcgaagaagcgccgcgcgaagaagccgccctaccgccctccgtcctcgctggaccgtggcggtcgcccgcccgcgcactccgacctccccttcgacttccgcttcagctacaccgagagcaccccggcctncaagcccatcgggctgcgcgagcccaggtactccccgttcgggcccgggcggctcgaccggccctggacggggctctgcgcgcgcgccgtcgacgctaccctg

SEQ ID NO: 77753 - DNA, 423 bp, Zea mays
  unsure at all n locations
  Clone ID: LIB3079-007-Q1-K1-G3
agagcctccaaaacctcgcaacaaccccgtgacacccacacccatccgccctgcgcctcctcgcgctccccaccaaccccgacgagcggcgatgaccggcacggtgtccaagctggcggcgccccggcctgcggcgccaccgctccggccggcgtccctccgcgccgccgcaatcgccttcgccccctccccgcgccgggtccgcgtctccgtcgccgggcgggccaggatcccctccgtcattgcgatggcttctgccaaggaaggaaatggtgcaccgaccaagaaaacctcgcttcacgatctctacgagctccagggcctctccccgtggtatgacaacctctgccgacctgtcaccgacttgctgccccttatcgccagcggtgttcgtggagtcaccagcaaccctgcaattntcca

SEQ ID NO: 77754 - DNA, 399 bp, Zea mays
  Clone ID: LIB3079-007-Q1-K1-G4
tcctcctcgacctcccccgtcgcgacaccgcccgatctctctagcgcacggcggacggagaagaggaggagggggggacgatctcattcatcggaccggcgtgcctgtgtcgtctgctgttttcgttattttttctttactctttttttttcttcctcctttgcttgttcaattcaatcagtataataagatttctgatttgggggcggctcgccatgggattcggaatggggaataataacaacggggcgagctcctcgtcgtcgaggctggacccggcggcgccgctgctgccgcgccacggcagcagcgggggccgcgagggtggtggcctgtcgtcgcagcccaagacgttcgccaacgtcttcatcgcggtggtccgcgccggcgtgctggggc

SEQ ID NO: 77755 - DNA, 396 bp, Zea mays
  Clone ID: LIB3079-007-Q1-K1-G5
ccgacgtcgtcatcatcccagccggggtgcccaggaagcccggcatgactagggacgagctgttcaacatcaacgccggcatcgttaaggggctctgcactgccatcgccaagcactgccccaacgctcttgtcaatatgatcagcaaccctgtcaactccactgtcccgattgcggcggaggttttcaagaaggctggtacttatgatgagaagaagctgtttggtgtgactactcttgatgttgttcgtgctaaaactttttatgctggaaaagcgggtgtgccagttactggggtgaatgttcctgttgtcggaggccatgcgggtattactattctgccactcttctcgcaggccactcctgcaagcaattcattgtcccaagaagacattg

SEQ ID NO: 77756 - DNA, 431 bp, Zea mays
  Clone ID: LIB3079-007-Q1-K1-G6
caaacccctcgcttactgcacctttgcagcaccgctctctcgatcgaatcccaaggagcggagacaacgacgatggcgtcgtctgcctgcttgctccaagcttccacggccttcgctccacgcttctccctcccgtcccgaccccagcccccgctacacctgcgtctccgcggctcccccaaccgtcgccgtggcatctcactcactgcttcctccgccgcgtccccggaagtcgagaaagagtcctcgccctcgtcctcgccgcaggaatctctgtctcgtaggctgtcgcggacagtgtgaaggtgctcaaggtggcagccaagacgaggaaagtacctgccccggaaattctctcggcgctgtccaagatcaagaaggcaaaactcgacacgtcggcattctttgagaccactcgtggtaccgagtct

SEQ ID NO: 77757 - DNA, 425 bp, Zea mays
  Clone ID: LIB3079-007-Q1-K1-G7
gcgaaaacgtcgtggccagccatcccggtgtcgtcccgcgttctacagccaccgctgtggtggccgtcctagactcctagatccgtcagcttaacgagctccattccttcgaggccagccatcccggtgtctcagcagcggcggcggcggcgtcgagctcttgctttctgtgggaggacgcatggcgatgtctgcggggcgtgggctcttggtcctcttcttctctgccgccgtagtggctgagctcgcctctgccgcgaacggtcctttcctgtccgatagcgtcttccagtcgagcgccggatctacagggaggagcttgctgcaggccaagaatagttgccctgtgaactttgagttccaaaactacacaatcatcacaagcaagtgcaaaggaccgaagtttccagccagccaatgctgtg

SEQ ID NO: 77758 - DNA, 401 bp, Zea mays
  unsure at all n locations
  Clone ID: LIB3079-007-Q1-K1-G8
cccacgcgtccgtcttcttgtatggaagggtttatctggcactctctggccttgactgctgaatatctcgccaagctaggtttttggggaacactgcactagatgcagctttgaatgctcaatttttggtccagattggtatttttacagcagtgccgatgataatgggtttcattctggagctggggctgatgaaggctgtttttagttttattacaatgcagctccagttctgttcggtgtttttcaccttttcgcttggaacaaggacacattactttggtagaacaatccttcatggcggtgcaaagtatcgtgctactggaagaggttntgttgttcggcacataaaagttgctgaaaattataggctctattctcgaagtcactttgtcaaagcg

SEQ ID NO: 77759 - DNA, 427 bp, Zea mays
  Clone ID: LIB3079-007-Q1-K1-G9
cccacgcgtccgcccatttccccgagcgcaagagtaccatggcggcggcggcaggttgtggcggcctcaaggggaagcttggcgtcgaggatgcccccgagctgcagctgaatcgcatccgcatcaccctctcatccaagaacgtcaagaacctggagaaagtttgtgcggatttggtaaagggagccaaggataagcatctgagggttaaggggcctgtcaggatccctactaaggttctccacatcaccacccgcaaatccccttgcggtgaaggaacaaacacatgggaccggtttgagttccgcatccataagagggtgatcgacctgatcagctccccagacgtggtgaagcagatcacctctatcaccattgagccgggtgttgaggtcgaggtgaccgttgcagacgtgtaatgacgatc

SEQ ID NO: 77760 - DNA, 422 bp, Zea mays
  Clone ID: LIB3079-007-Q1-K1-H1
gaaccgagtgcaatagatcttttcaaggacatgcattgcagcaagaagaaaggtgttggtgaaaatgtaaagaaagcaattgttgacatggaagcaagggtgacaacaccagttgaggatggacaacaacaaaagtctcctatagaagttgtttctgaagtgctatggggctccagtttatttctacagaatgttggtctgcaagataactccaagaaaagctccacaacaactgtttttgctaaggttcaagaacttcataatcaattggagtctgagaggctagaaaaagatgggcttcaagaagaagtagaaaccttaaaggctcaggcacaggcctcaaaggagaccatggacaatatgaagagatcgatggaagaaaataacagtcttcttcgtcaactgttgagcttcaatcgaag

SEQ ID NO: 77761 - DNA, 370 bp, Zea mays
  Clone ID: LIB3079-007-Q1-K1-H10
cccacgcgtccgggaaggcccgctcggcggactcctcgtcctcttacgggtagccggcgtcggcgccgccgcagcaccagtacggcacctttggtcccccatccggagcctccggggagtttccgcagccggcggtcgggttcccccagccggcggcgccgcctgggatgcagcactacccgcagcctcctccggcgtcgtatgccgtctacccacccccgcagcaaccctactcggccgccgcgccgtactacgcccaaggctaccagatcgctcaaggttatattcctggtgttgaaggaaggcctgttagaatccgtcctcttccatgttgtggccttggcatggggtgggttctggttataattgg

SEQ ID NO: 77762 - DNA, 429 bp, Zea mays
  Clone ID: LIB3079-007-Q1-K1-H11
ggaaggcatgccggcgttcgcgctcgtcaacaaggccacggggctcgcaatcgagcgctccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaaccagagctggaagatcctgccgtggggtcccgaggccaactcctccgcggcccacgcgggaggcccgcacgccgtgcgcgtcttctgcaaggccggcggcgaggactacagcctcacggtgcgcaacggcacggcgtgcctggcgcc

SEQ ID NO: 77763 - DNA, 416 bp, Zea mays
  Clone ID: LIB3079-007-Q1-K1-H2
ggagaagcccgccccgccgccgcccaaggtggtggaggtcccctacccgtggccgtaggcgtacccgtaccctgcgtggccgtccgactgctgctgccaccacggccacggcgggtgccactgctgctcctgcggcaaggcccccgagccggccccggcccccgccccggccccacccccgccgcagtacttcccgcagtacatgccccagccgtacccctgcaacccctgcggcggcggctaccggatcgtctgctaggaggacccctcctacgcctgcgccatcatgtgattcgtttattatcaatatcatcccttgatgagtgtaccgtccgtgtgcgtaccatgggcctaattaccattatacccaacctcaccctaaataaaaccccaatacgtcgtctcatcatcattcc

SEQ ID NO: 77764 - DNA, 429 bp, Zea mays
  unsure at all n locations
  Clone ID: LIB3079-007-Q1-K1-H3
ggttcataaacgcgcgggttcgtctatggaagccgatgatcgaggagatgtaccgggacctcaagaggagctcgggtgcaggaggaggagggcacggcccggcgatggagccacagcagcacttgagcaagcgtcgaatttgcgagctggaagatggtggccagtgaaccatccagctccatagctgcctgccgtggatttaccattggcccttgtagtttccctgtgctatgtttatgtacatatcattgccaacgccagcatttaacatctgcgcatcttttatcctgggttgactgggaagggccaagagcagcggcggcggatactgctggatcagggttctggatgctctattcgtccgctcagcattccgatggttgcccgtttcagatatagcggatttcatgctntggttctggtcatgtc

SEQ ID NO: 77765 - DNA, 346 bp, Zea mays
  Clone ID: LIB3079-007-Q1-K1-F9
gggctctccggaggctgaggaccgcttgtgagagggcgaagaggactctgtctgccgctgcccagaccacgattgagattgactcgctgtatgagggcatcgacttctactccaccatcacccgtgccaggtttgaggagctcaacatggacctgttcaggaagtgcatggagcctgttgagaagtgcctgagggatgccaagatggacaagagcaccgtccatgacgttgtacttgttggtggctccactaggatccccagggtgcagcaactgctccaggacttcttcaacggcaaggagctgtgcaagaacatcaaccccgatgaggctgtcgcctatggtgc

SEQ ID NO: 77766 - DNA, 418 bp, Zea mays
  unsure at all n locations
  Clone ID: LIB3079-007-Q1-K1-E5
gtctgctgagtcttattcagttccaaagggcctcaagatactcgagaatttggccgatgcatctagtctaatcactgggcttgagcatgaattgccagttccttgggcaaaacttaagcgagttttctggttcgatggctttggtaacgatgagtcagccaccgagcaggctctcttgcagaagttcttcgcgagtattgccatcaagattttgtcggaacagctgtccggcctgcaggtcatcctgatcatgaaaaacacgagatacattcagttgcaggtggaaagattggcgcgggagtgcttctttttcctcagcgaatcgtttctgtctgatgaagcaaatctaggatggttctcagatacctncacgcacacaagaaggatgcaagtggcagcaccggtgacctacgtcttc

SEQ ID NO: 77767 - DNA, 366 bp, Zea mays
  Clone ID: LIB3079-007-Q1-K1-E6
aaaaaaaaaaaaaaaaaaaaaaaaaaattaataaaaaaaaaaaaaaaaaaaaaaaaaaagaaagataaaaaaaaaaaaaaaacaaaaacaaaaaaaaaaaaaactatttttaaaccttaaccggccgttttaaagaatccaactttacttacccttgcttccaacgtaataccttttctatagggccacttaatttaatttcattgcccgccgttttaaaccgctgaaactgtaaaaaccctgcctttcccaaacttaattcctttgaaaaaaatccccttttccccaattggcttaatcccaaaaaggccccaaccaatcgcctttccaaaaagttccccaccctaaatgccaaatggaaccccc

SEQ ID NO: 77768 - DNA, 432 bp, Zea mays
  Clone ID: LIB3079-007-Q1-K1-E7
atctcgagcattcagaaacacaccaagtgaagcacattagcaacaacctaacaacaatgggtaccaagatattatcccttcttgcgcttcttgcgctttttgcgagcgcaacaaatgcgctcattattccacaatgctcactagctccaagttccattattacacagttcctcccaccagctacttcaatgggcttcgaacacacagctgtgcaagcctataggctacaacaagcaacttcggcgagcgtattacaacaaccaatttcccagtcgcaacaacaatgcttggcacatctaacaatacaaaccatctcatcgcaacagcaacaacaattactaccagcactgagccacctagccatggtgaaccctgccagctacttgcaacagcatgtgcttgcatcaaacccacttgctatggcaaacgtag

SEQ ID NO: 77769 - DNA, 312 bp, Zea mays
  Clone ID: LIB3079-007-Q1-K1-E8
ccgaagtttccctcaggatagccggagtcgtgtcccaacaactctatgccgcactcagcggctatccagaaaggtctcacggaggacagcatgggatggacgttgcagctaacttagcagcttttttcacatgatcgagctctacaactcttatttccgttttctcgataagtctcacttctatcaacttgttcttctgttgaaacagagtactttaaaagggatccccaataatgactttccctgtgtattgctgatatgttggcactagatatttttggaaactctatttaaagcacagtgttttgcacc

SEQ ID NO: 77770 - DNA, 428 bp, Zea mays
  Clone ID: LIB3079-007-Q1-K1-E9
cccacgcgtccgcccacgcgtccgttcctctcccgactctctcctcgccggcgaggcggcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactccttcaagctcgccaagaactggagcagagctgcatcagtttacatcaagattgctaactgtcatttgaagggagatagcaagcatgaggctgcctcagcgtacgtcgaggcagcaaattgctacaaaaagttttcacctcaggaagctgcgcaagcgctaaaccagtctgttaatcttttcttgga

SEQ ID NO: 77771 - DNA, 429 bp, Zea mays
  Clone ID: LIB3079-007-Q1-K1-F1
gggaaaaggcggatcttctctctgattctcaaaggattaaatataccattgagacgtgcaccaagggcatccctgatgcacggacttacttgaatactcttcaacagctcagaataaagagtggtcttatagatcatcttggaattgagcctttgatgatggaagctcttgagaagattgagaaggacattaagaaaccacttttgaggagcgacaagaagaacatggccaccctcttggcagagtttgacaagattaacaaaaagcttggctttcggaaggaggatcttcccaagatcgaggaagagcttgaattggaaattgccaaaagtgagctgactgaacttaagaaggaatgcgttgaagcaatggagactcaactcaagagggaggagtttcaagatgaggagatgcctgatgtcaggaaat

SEQ ID NO: 77772 - DNA, 413 bp, Zea mays
  Clone ID: LIB3079-007-Q1-K1-F10
caccagcccaccttaattccatggcatctttttttttattattattctgtgtgaaggtggattcctaggctgtaccgcccatctttctctacctgtttgtaagatatgactttaggggtttcggcctttattatccctagtaggcccattggaataggaacttttttggcattgcacattagaattttcaagtgttggcatggctgtttagttctatggtggtgactcgtgacctgtataatataatttagacaatggaatatacagcatttgtggtacagccatgtgacaaaaaaaaaaacaaaataataacataaaacaaactaaaagctaaaaaaaaaaagagatactatacatgccaatttattaaaaaaattcattcttacacaaaaaaaaaggggcggcctcttttg

SEQ ID NO: 77773 - DNA, 411 bp, Zea mays
  unsure at all n locations
  Clone ID: LIB3079-007-Q1-K1-F11
caagcatcagcggcaggagctctgggcagcgtgcgcacgtggggtacctagctggctgtgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgncatcgcgctggcgctcatggcggccgggttcgtcacctccggcggcctcggcgtcgctgcgctgtccgtgttctcctggatgta

SEQ ID NO: 77774 - DNA, 273 bp, Zea mays
  Clone ID: LIB3079-007-Q1-K1-F12
gctccactcttcctaaaaaaaaaattaaatttaaaaaaaaaaaaaaaaaaaaaaaaagaaagatataaaaaaaaattaaaacatcataaactgaaaaaaaaataaaaattaaaaaaaattaatcaaaataaaaaccaaaaaaaatttaataaactaaaaataatcaacaacaataacaataaacaataaaactataacacatatttacaacctgaatgcctttttctactccccacttattctgcaccttaatctccttaaaaattctttttt

SEQ ID NO: 77775 - DNA, 405 bp, Zea mays
  Clone ID: LIB3079-007-Q1-K1-F2
atctgagactaaggttagattatcaattaagggaaccattgttactctttcattgatgactggctctctgtggtatgaatacatatacaagctagacaaagttacatacaacaagtaccatccctacacctcatggatccctataactgtttatatctgcctgcgcaattgctcccagcagttgaggagtgcctctttggtccttttcgcatggcttgacaagattacactagagacttatatctctcagatccatatttggcttaggtctagcatgccaaatggacagccaaaatggcttctttgtttcataccagaatatcctatgcttaacttcatgcttactacggcgatctatcttcttctatcataccgtgtgtttgagatcacgaatgtcttgaagtc

SEQ ID NO: 77776 - DNA, 430 bp, Zea mays
  Clone ID: LIB3079-007-Q1-K1-F3
attgcctcaattaccaatgattcccgtgtagaagcagcgcaaatttgttgaaaccattgagctacaaattggactgaagaactatgaccctcaaaaggacaagcgcttcagcggttctgttaagctgcctcacatccctcgccctaagatgaaggtttgcatgcttggtgatgctcagcatgttgaggaggcagagagaataggtatagacaatatggatgtggaagccctcaagaagatgaacaaaaacaagaagctagtgaagaagctggcaaagaagtaccatgctttccttgcatctgaggctatcattaagcaaattcctcgtcttcttggtcctggtcttaacaaggcaggaaaattccctaccttggtgacacaccaggaatcccttgagtccaaggttaatgagacaaaggctacagttaag

SEQ ID NO: 77777 - DNA, 182 bp, Zea mays
  Clone ID: LIB3079-007-Q1-K1-F4
gggtatcggaagtgccatctcattgcccattggctcatggaatgggtggatgggactgacaaacatgttctggttcaatgatgaatactggaatcgcacaggaaaaatatactgtgacattgcgacagtgcaacacctaaatacaaagacttggaaacaaacaacttgctttgttctgttct

SEQ ID NO: 77778 - DNA, 371 bp, Zea mays
  Clone ID: LIB3079-007-Q1-K1-F5
cgaaaaaaaaaaaaaaaacaaacaaaattatttaaaaaaaaaaaataaaaaaaaaaaacgaagaattaaaaaaaaaaaaaaaaaaaaaaaaaaaaaaaaaaaaaaaaaaaacaaaaaaaaaaggccgccccttctaaaggatcaaatctaactaacccttccttccaatgaataacttttactaaaatctcccctaaattaaattcactcccctttttttaaaaacttcttacctggaaaaaccttggctttaccaaactaaaaccccttcaaaaaaatccccctttaaccatctgcccaaataacaaaaagcccccaaccaatcccctttccaaaaaattccccaccctaaatgccaaatggaacccccc

SEQ ID NO: 77779 - DNA, 419 bp, Zea mays
  unsure at all n locations
  Clone ID: LIB3079-007-Q1-K1-F6
ggcacaagaagcttttgcagctctggcaaaagcccaccagctcctgctggatccacgggagagaggctacattcttgaccaagttactgctgcaaaagaagaattgagggcaaaacggaaaaaggagctgaagaaagacagtgcgtccaagataaaatctcttgtagatgagggaaaatatgaagagcagtttgaacgatcggatggatttcagcagcaattaataattaaagtacgtgaaattttgaccgacaaagaatggcgtangagaaaaatgcaaatgaggatatcagaggaagaaggaagacttaagaaggatgaggaggaaacaaaagagatgtggaagaggaagagagagcatgaagagaagtgggaggagaccagagacaagcgggtctncagctggagggatttcatga

SEQ ID NO: 77780 - DNA, 347 bp, Zea mays
  Clone ID: LIB3079-007-Q1-K1-F7
acgcacgcatccgccggcacgtacacagacacacaccatctcattttcaaaaacaacaccctaccctctgggaggctttacatacaaacgcggccatcccatctcatccctcttctaaactctccacaaacttcaattaacttaccatcatcattcacccccatcactatcaaaacactttccttaccaacattaatctccatgtactacatacaccatattttctaccgcctttttatcaaaaaccccaataccaattaccctttcaaacaaatccacaacctaaatgtcccataaaaccctccctcttccaaccctttaaacacttttaactctaatatcttact

SEQ ID NO: 77781 - DNA, 430 bp, Zea mays
  Clone ID: LIB3079-007-Q1-K1-F8
gtccaattgagctctccattgtctgctatccgagagcatgtggtacaaactcgaccatgggcaccagtgaatgaattgcaacctgtgcaaattgagtgcttgcctgaggtgtccgtaagcacagctggaactgcagctgagaacattcagcaagtccagcaaagttcgaaagatattcaaagcaagtcccagggcgcttcaacaaggagctgtacaaaggttcataagcaaggagttgcgcttggccggtccgtggacctctctaaattcaccgactacggtgagctcaaagcggaactagacaagatgtttgagttcgagggcgaattggtatctgctaaccggaactggcagatcgtttataccgacaacgaaggtgatatgatgcttgtcggagatgacccgtgggaggagttctgcaacatagtgc

SEQ ID NO: 77782 - DNA, 415 bp, Zea mays
  Clone ID: LIB3079-007-Q1-K1-E4
gcccaccaccgtcgccagccctcgctctcgctcctcactgaaggggacaggagcggcggggagaggaggatcgacgccctggactaccgcaccggcgagcggcgccccatcgcgcggacaacaggccggaccgccgccaacggggacgacctgaacgtgctggcttcctgcgaaggcctcctcatcctcctcgccaacggcggcctccagatctgcaacccggcgacccgccagcgcgcgccactcactcttctccacggcgcctattgcatctccgcgctttatcctcacatcccgtccaggtcgtaccgtgtgctctgctgcttcgagagagccgaggacggccacgccgtgtaccacgtgcacaccgtcgggtcgcgcgagctcaggtgcgtcggagaaccttccgcgccgt

SEQ ID NO: 77783 - DNA, 432 bp, Zea mays
  Clone ID: LIB3079-007-Q1-K1-C7
agagatttcagtggcagagttggatcgccacatgtatagtgccggatgcccagatcgggagatcgtcatccggacttcgggcgagactcgattgagcaatttcctcctttggcagacaacgtttagtcacttgcagaatccagatcctttgtggcccgagttctcctttaggcaccttgtttgggctatcttgcagtatcagagagtttaccctgctctggagcataacagaaagttggctaagaagcagttgtgattccatgttatttgcaaagaggtatcatgaagggctattaacatcaaacttttccttctcaatttcccggtaatgggaaatgcaaagaagaacatactagcatataacattatgaatagatcaccatgtaacttaagtgtgattgctaccgtaaccatgtaacttaaccatgtaac

SEQ ID NO: 77784 - DNA, 405 bp, Zea mays
  unsure at all n locations
  Clone ID: LIB3079-007-Q1-K1-C8
gctgttcacgggtttgaagcgaaaattcgcccaaaccaggccggcgacggacgcctcgtggttctccacgccgccgtcgccgccgccgtcgcgttggctaggttgacctgaccgatcttgacttctctaggctcttgcatccccgacgacggaaatagcctccgagtttccaacagggtggctccggtcgaccacgaagcctcgatctgcatgacgaggctactcgtcatcctgttcgccggggcgaccctagtagtcgccaccaccgcgcacgagcaccatggtgaggcgcccacctgcgccggaggcagcgagcacgtgcttgcggagttccgccccggtgaggtgaccgtggacgggcacaacgaggactgggagagcgtggaggcctcngagttcgcgctg

SEQ ID NO: 77785 - DNA, 373 bp, Zea mays
  unsure at all n locations
  Clone ID: LIB3079-007-Q1-K1-C9
gtcacttgctctccctccaacaagcttattaaggccggtcatccctcttctagctcgtttcattatccatggcggaggagaagcaccaccaccaccacctgttccaccacaagaaggacgaggagcagctcgccgccggcgggtacggcgagtccgccgagtacacggaggccacggtgacggaggtggtgtccacgggcgagaacgagtacgacgagtacaagaaggaggagaaggagcacaagcacaagcagcacctcggcgaggccggcgccatcgccgncggcgccttcgcactctacgagaagcacgaggcgaagaaggacccggagcacgcgcaccgtcacaagatcgangaggaggtcgcggcggc

SEQ ID NO: 77786 - DNA, 425 bp, Zea mays
  Clone ID: LIB3079-007-Q1-K1-D10
cccacgcgtccgcccacgcgtccggggtagagggctagggttcagagcacgacgagcgataacttcaacaagcagcgggcgggtctcgggcggcgcgcgggcgcttggtggacgacgctcaagcggaggcgggcagcgcttgggagtcaggcgtgcgaccttgcggctgtgctcaggcggggcgttgcgtgaagcgctagggagtcgggtgtgcgacgggcggcgctcgttcctcaggcatgtgcggacgacgctcagacgcatggctgtgtcgaccacttgcagacgacgccgacacagatccaggtccaggtccaggttaagtattgttttttggtgtgtggacgtgattcttctagtgagatatgttctgaagcggcaaggtaaaccctcttagtctacttgtttaacttttaaaatatacc

SEQ ID NO: 77787 - DNA, 197 bp, Zea mays
  Clone ID: LIB3079-007-Q1-K1-D11
actcggttctgaattccctgctctacccactcttcctaaaaaacaaaaaaaaaaaaaaattaatttaaaaaaaaaaaaaaaaaaaaaaaaagaaagaataaattaaaaaaacaaaaaaaaaaaaataaaacaaaacaacaaaaacattaataatcaaaaactcatctcattctctcaaaacttcataattttccttt

SEQ ID NO: 77788 - DNA, 259 bp, Zea mays
  Clone ID: LIB3079-007-Q1-K1-D12
aaaaaacatacaaaaacacaaatttattaaaaaactaaaatacaaaaaaaaaaggaggcataacttaaacaaacaggaaaaaaaaaatcgaccaccactctaacctcttcctgttctaactctccttccatgccacgcaatactttttatttaggcctacttactttcaatctcatttcccgccgttctacaacttccatcactggaaaatcccttcttttacccactttattcgcttttctataatttcccatctacc

SEQ ID NO: 77789 - DNA, 425 bp, Zea mays
  Clone ID: LIB3079-007-Q1-K1-D2
ggacattgagaagtggaaattagctagtagcagtcctaagaaaccaattgctttgagggcaattattttgggcttggttatggttggaagagcggcatttgtattccctttgtcgttcttatccaacctaagcaaaaaggaggcccgtccaaagatctccttcaagcaacaagtaatcatatggtgggctggtctcatgagaggagcagtgtcaattgcgcttgcctataacaagtttacagcatctggtcacactgaagtgcgagtcaatgctatcatgatcaccagcacagttattgttgttctattcagcacaatggttttcggcctgctgacgaagccgcttctcagtctcctcatcccaccaaggactggactgaacacgtcgtctctgctctcaagccagtctatgctggacccactcc

SEQ ID NO: 77790 - DNA, 98 bp, Zea mays
  Clone ID: LIB3079-007-Q1-K1-D3
gtcaaaaaaaaaaaaaaaaaaaataaatttaaaaaaaaaaaaaaaaaaaaaaaaaaaaagaaaacttaaaaaaactaaaaataaaaaaaaaaacatac

SEQ ID NO: 77791 - DNA, 427 bp, Zea mays
  unsure at all n locations
  Clone ID: LIB3079-007-Q1-K1-D4
gagaacaatgaatctgaaagaagaggattagggaaaagaactctgggggatcctcaaggtacaatgggtacttcaatggtagtggatggctcatttgtatcatccatgtcctctgatatctctgttgaagaaagcagctttcgacaactgcagaatgctgttagtcagctggatgtgcaaaccaaattgtgcattagagatggtttataccgattggcacgaagtgcgcagcacaggcaagttattccaaatatgatgagcagcaatgaagacaacccggatataaaggatctgcagaatgcagaaactntgcgcaaattcgtcgatcctcggagcatcgagacacagacaaacccgatcgaccggtctatcgctctgctactnttccaccagtcatcggaccatgcggctgtggctgtcgacgatg

SEQ ID NO: 77792 - DNA, 411 bp, Zea mays
  unsure at all n locations
  Clone ID: LIB3079-007-Q1-K1-D6
ctggccaccaccttctcaccagttttcccagccgccattctgcgatcacgcctgttgggtggttcctgctgcgatctgcgcttgtgcgatcggccgtcatgttacggcacacaacgacgccggcgtctgtcgtcgtccgcttgatcggcaactgggtagcgtcgcatcgaacgagcgatcttgtcgcctgatccattgatccaactgtgttggaagaacggcgtcgtctgcaaacagcgaggcagagaagcttcgggcgcggcaaagcagcggcgtcttgcgcatagctacggcgggcgtggacagaacagcggcagggcggngagaaaagacaaggtttgatgtgatgtgtatttgacaataaggttctatgtgcgtncgaattgtatgtcatatatgcatgtgtttgat

SEQ ID NO: 77793 - DNA, 422 bp, Zea mays
  Clone ID: LIB3079-007-Q1-K1-D7
gcgagatctgaaggattctgatttctataagcagcaagctaaacttcttttcaagaagttggcaaaagggcatcatgaagcttcacggatgtcaattgagacagggccctactatttccactacattattgagggcagagtatgttatctgactatgtgtgaccgctcttatccgaagaaacttgcattccagtacctagaagatctgaaaaatgaatttgagagggtcaatggcaaccaaattgaaactgctgcaaggccatatgcttttatcaagtttgatacattcatccagaagactaggaaactgtatttggatacaagaactcaaagaaacctcgcaaaactgaatgatgaactctatgaggtgcatcaaattatgactcgcaatgttcaagaagttcttggtgttggtgaaaagc

SEQ ID NO: 77794 - DNA, 397 bp, Zea mays
  Clone ID: LIB3079-007-Q1-K1-D8
cccacgcgtccgtgacagcgatgttgccaagaaaatagtcgagatcgagaggatccctgggtttccccaaaaaattatccttgagggtggaagcattcatgtagatggagaaggtacatgcattacaacggaagaatgcttgctgaatcctaataggaaccccaacatgaccaaactagagatagagaatgagctgaaggattttcttggagtctcgaaggtcatctggatacctcgtggactttatggcgacgaggatacaaacggccacgttgacaacatgtgctgcttcatcaaacccggtgtgatcctgctgtcgtggaccgacgacgagaaggattatcagtacgaacggtcggtcgaggcgctgtctgttctctcccagtccgtcgacgcg

SEQ ID NO: 77795 - DNA, 408 bp, Zea mays
  Clone ID: LIB3079-007-Q1-K1-D9
gaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacaaacttctggggcatgaattttaccaccgataagctcagatctctagtaaagaagtggcagacattgattgaagcccatgttgatgtcaagacaaccgacaactacatgctgcgtttgttctgcattggttttac

SEQ ID NO: 77796 - DNA, 375 bp, Zea mays
  Clone ID: LIB3079-007-Q1-K1-E1
gccacgcgtactgatgctgccaatagagctgcacagagaggcatacaaccttggggagcactttgaagaacccttgcaagattatcagcgtgctgtacactctatacaagccactatgcttgatcgaaccaatgctttcaagcagcactacgatatgaatcatgagaggctgtatcaagagcttaatcttgacatattcaagttcatgaaccctgaaacgtatgccgaagcacaatctgagtttccagacttgaaagcagacactgaggaggctgctcacatatttggactcatggatggactaatgaatgaagagcatgctcgtttgccagatcatattacacttgatattggactatcattccatgaatatgc

SEQ ID NO: 77797 - DNA, 431 bp, Zea mays
  Clone ID: LIB3079-007-Q1-K1-E10
gtttagattcttgttcacgcgttcaatgatgcgtggggaaaacaacatagtcggccgctcctcctcctgtttgctgtaatttctccgaaccaagtaattggtagtgcttgtactccggaacagaaggctgccatcctaaatcaatgcgaagagtacatcaagcctggatacccccttatactgccatcgtacgccagtgtgtgttgcgacaaggtgagagatgtgccaaatagggacatgaactgcatcgtcgatctgctcacgcctccagagaaggcgaaacacggtgtcgacaagataaaacgtctgaaagatctctgcgacaactcgcctcatcatcaggtggtggtgtagacagacagcagctgtcattgctaatggagttcggaggcaagatatatggtctaagtaataaagtcgtcgatcaaagc

SEQ ID NO: 77798 - DNA, 348 bp, Zea mays
  Clone ID: LIB3079-007-Q1-K1-E2
cgctccacaacatccgtgacctcgtcgaggctgcgcgacacacgcttgggctgcgcagccgtggccgcctcccgtagagaggaacgaggaatctatctgtaagatttggttctggtgcgtgccgatgaatggctaaattgatctgttctagtataagctactatcaatatactgtacacttgctaattaaaagaaagaagttttatgtatgaatgaactgcaacttgagtcattgaaaagttgttgctggtcttctttagtttgagttaggggatgcgtcatgcgtggttttgaaggtgttctgcttgcaatattacatcataatctgtgactgatgcactgatgtct

SEQ ID NO: 77799 - DNA, 431 bp, Zea mays
  unsure at all n locations
  Clone ID: LIB3079-007-Q1-K1-E3
cccacgcgtccgcaaccagtcctcacataatcatcttcattcactcactctcttggatgactgtactgaagataccatggccaagtcgaccgcgatgtttgtagccgccctggccctggtggtggtgatggcgacgacgagcacaggcggtggcagggcggcagcggcgtgcgatcccaagccgctggtggtgtgcgatccggcgttcatggacggagcgaaacccgcggcagcatgctgctccaccctgcgtgcgcaggaggcatgcttgtgcgtgtacgccaaagaccccaagtttgcaaaatacatcaacaaccccaacaccgtcaaaacctttacctcgtgcggcatagccatccccaaatgctaagcaagcgctctgcgtcgtcgcttcgcttgctcttgctctngtgtgtaacatatccagctta

SEQ ID NO: 77800 - DNA, 365 bp, Zea mays
  unsure at all n locations
  Clone ID: LIB3079-007-Q1-K1-C6
ggcgctcctccgccccaggtcgttcgcggccaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctagtcgcatccgaccccgagggcagggtgccgctcttctgggggatcaccgncgacggctgcgtcgccttcttcgacgacatcgacatgctcaaaggctcatgcggcaagtcgc

SEQ ID NO: 77801 - DNA, 313 bp, Zea mays
  Clone ID: LIB3079-007-Q1-K1-A8
gactggcaagactatcacccttgaggtcgagtcttctgataccattgacaatgtcagggccaagatccagaacagggagggcatccctccggaccagcaccggctcattttggccggcaagcagctcgaggactggcgcacgcttgccgactacaacattcacaaagagagcaccctgcacttggtgctgcgtctcaggggtggcatgcagatcttcgtgaagacacttactggcaagacgatcacccttgacgtcgagtcctacgacaccatcgacaatgtcaaggccaagatccaagacaaggagggcatt

SEQ ID NO: 77802 - DNA, 425 bp, Zea mays
  unsure at all n locations
  Clone ID: LIB3079-007-Q1-K1-A9
acccacgcgtccgttctatttcaatacaatgatggttgtgctaactgtctatgcatttgtatgggggcgcgttttaccttgcactcagtgggcttgaggactacatcaacaagaacacttcctcttccaataatgcagccctgggagctgttctcaatcagcagttcgtcatacagctaggcctgttcacagctttacccatgattattgaaaattcacttgagcacgggttcctcactgctgtgtgggatttcatgaaaatgcagctacagtttgcatctgttttctacacattctccatgggaacaaagacacactattatgggaggacaatccttcacggaggagcgaaatatcgagccactggcagaggttttgttgtggagcataagaagtttgctgaaaactatangctctatgctcgc

SEQ ID NO: 77803 - DNA, 342 bp, Zea mays
  Clone ID: LIB3079-007-Q1-K1-B1
gattaggaggacgtatggatcagtgagaaaagatctggaaaaccgggtgtacgcgacggacgaggcgaggagctacgccatctgtaaggcggaggaagtggagcaagagctggactccagcttccccgtcttcatcaaacccatgacccagtcccatgtcaccggaggcttctggctgggcctcccaaatcatttctgccggaagtacctgcccaagcgtgacgagacgatcaccctgctggatgaggatgacaacgagtcctacacgctatacctcgcattgaagcgaggcctcagcgctggatggagaaggttcgctatccagcacaagctggttgatgg

SEQ ID NO: 77804 - DNA, 287 bp, Zea mays
  Clone ID: LIB3079-007-Q1-K1-B10
acggaggataacaatcataaaaattattttaaaacaaaacatacaaaaaaaaaaaggaaggctttataaaaaaaggacgacgcctatatacatcaccaacccgtctaccatatctcgctttcccttccttttctccaactgtccatgtccctacttatcctacccgccttactaccactcaagatctcatcaattcctttaatttttccgcatttaataacttttcgtctcaacctccattccctaactttcttactaacgctatcacttgcatcatctcacacttc

SEQ ID NO: 77805 - DNA, 427 bp, Zea mays
  Clone ID: LIB3079-007-Q1-K1-B11
gccatgggtccatggcccagcaatttattttctgaatttaccttcaccttgtgcttgtggcctttttgcaggtatgttgcaccggagtacgccatgacaggacacttgcttgtaaaaagtgatgtatatagctatggagttgttctacttgaactactaactgggaggaggcccgttgatatgtcacagccctctgggcaggaaaacctagtgacttgggtaacacttctttcttttaggagtatactatcttcagttcctgtgtgattttacagctaaattggaatattttaacgtgatgactctcagacactctggattgtgtgtgcatacgttgtttttatgtatgtgtgggcagctgacaactggaatttaaatctgaaattgctcgtatatatatatatatatatatatatatatatatata

SEQ ID NO: 77806 - DNA, 425 bp, Zea mays
  Clone ID: LIB3079-007-Q1-K1-B4
aacatatccagtgaggtcaatgatatgtacagtcctcatgactgtgatgaatttgtattggaggagatgtctagattcctgaatgattctccaatgcgtaacactccttatggagagtgctctggtcttcctccaatgtctgaagctgaggctcatgcttttgaagtcaactcttttgacctctacaaagaattatcagggcttgttgagttaggaggcatggacaataacttcaacaccagcaatgtggaaaccacagattaccttgtgctgccacctgacagagaattgtccacggatggttacatggaacttaatgatctccttgcttctgattcaagcttccccatccccagtgaatttcctgctcaggacaatcaatctatgcagtatcctctggctgagtacaatgtgcattatgatgt

SEQ ID NO: 77807 - DNA, 432 bp, Zea mays
  Clone ID: LIB3079-007-Q1-K1-B5
gcttctcttcccacctcaagatcgggatcgttgggttgccaaatgttggcaaatcaaggttgttcaacatagtaacgaagttggctatcccagctgagaattttcctttctgtaccatcgaaccaaatgaagcacgggtgaatgttccagatgaacggtttgattggctttgcaaactttacaagccaaagagtgaggtgcctgcatatcttgaagtaactgacatagctgggcttattagaggtgctcatgctggggatggtctgggcaatgcattcctctcacatatacgtgctgttgatggaatcttccatgtcctaagagcatttgaagacgcagaaattactcatgttgacgatacagtagatcctgttagagacatggaaactattagtgaagagctcagactaaaagatatagagttcatgaaaa

SEQ ID NO: 77808 - DNA, 235 bp, Zea mays
  Clone ID: LIB3079-007-Q1-K1-B8
cccacgcgtccgcccacgcgtccgcccacgcgtccgcactgaggctatatccactatcgagcaaagaaggcaaaatgcaaaatagggtatcgcacggcactttagcacaatggcatgtctctaatagggtatgcattaggaggtaaaatgcatatgagaggggatatgcaaaatacagtattgatttgcatatgcatgatctgttggaggaatctatactatatgttttttttgt

SEQ ID NO: 77809 - DNA, 383 bp, Zea mays
  Clone ID: LIB3079-007-Q1-K1-B9
gtcggcgcctacggtctcgccggctccagggccagggcgtgcggctgagaaggcagggctcgccggcttcggacgacgtgtgtgtgcggcagcaggccggccggcagagctcggattcccggccggtgctgcagcagtgcatgtgcctcctgatccaccgcgcctaacgccgagcaagatgagatcagttcttttcttcgtgtgcatttgcttcctgttcgtgtcgacggcgagggcggaaggcccctaccagttcttcgattgggagatcacgtacggcagtatcagccctattggatctctacaacagggaatcctcatcaacgggcagttccccgggccgaagatcgagtgccaaacaaacgagaacctgatcattaacg

SEQ ID NO: 77810 - DNA, 347 bp, Zea mays
  Clone ID: LIB3079-007-Q1-K1-C1
gggaaacgacagccctgcagagccagtaaaacagcaaggtgatgacatccacaggagtgaagcttcatgagataattgctcctgtcaagagatctatgagccaactgactcgataccaagggaggtcagtctggttgcttgcctacattgcttttgtaacatcctggccgctgcttggctccctagctttcatcaccttccggaaaaagtccaggaatccgttgcgagctaaatgaatcatacttatattatgttattacaattacatcatgcaacatcctctgagctaaaaaaaaaaaaaaaaatgcaagaacaaaaaaaaaaaaagaaaaaacattaacaagctt

SEQ ID NO: 77811 - DNA, 431 bp, Zea mays
  Clone ID: LIB3079-007-Q1-K1-C10
gtggttcccaaggacgtgaacgctgctgtggccacaatcaagaccaagcgcacgatggagttcgtggactggtgcccgactggcttcaagtgcggaatcaactaccagcctcccagcgtcgtcccaggcggtgatctggccaaggtgcagcgtgccgtgtgtatgatctccaactccaccagtgttgtggaggtcttctcccgcattgaccacaagttcgacctcatgtacgccaagcgcgccttcgtgcactggtacgtcggtgagggtatggaggagggcgagttctccgaggctcgtgaggatctggcggcgcttgagaaggactacgaggaggtcggtgctgagtttgacgagggtgaggacggcgacgagggtgacgagtactagacgctctactggcgcggcgtcgtcgggcttgtgtgccactt

SEQ ID NO: 77812 - DNA, 217 bp, Zea mays
  Clone ID: LIB3079-007-Q1-K1-C12
tcatgcgctcactcgtactaacacgaacttttatgtataccgctaaaattaacaactctaggaacggttactcaaactagcggctgaccagcatcattacattcaccaactcttagactgccaacacaaatcctatcttacttacatccaagactcacattaccgaccttttaatcatgattctgagcttcaacctgtaaacacatatgaaaactat

SEQ ID NO: 77813 - DNA, 399 bp, Zea mays
  Clone ID: LIB3079-007-Q1-K1-C3
aggaaacgacaaacctccacatctacctcaacaaccacgagattacctccacgccagtcacctttatcagatgatatgctcctgtgctgacatctatatgcccaccgactcgaaccacacggagaacattcaggatcttgaccagcttaaccgcaagctcaaccagatcgatgatgaggtcgccatcttccatcatatgcaagccaaagtccacaaatacattcacgaacgtgacccatacttcatatcatctgatgctacaagatcatgtatacaccaggccttgacatgttggaaatatagattatgctttcaccccacaataagtgcatcatcatttccaagcatgttgaactatcaacaaggtgacaatcttgactgacaaatttttcatccaaa

SEQ ID NO: 77814 - DNA, 338 bp, Zea mays
  Clone ID: LIB3079-007-Q1-K1-C4
aaggaacaaaaaaaataaaaaaattttttaacaaaaaaaaaaaacaaaaaaaaaagaaagctattcaacacagaggacgccgaaccaagcaaaacaatactgtcacacaaggacggccgaccaagtgctggttctcgcactacgcctccacggcgctgaactggccgggcgccctccgggtgccgcctcatcgctctccgagtctcgcgcttcctgcccctgcttcctgtgcttcctgttcaccagctccctcctagtcgcctccgaccccgtgcgcgcgctccctgtcgtgtcgccgatctccgcccgcggctgcgttcccttgctcgacgacttcc

SEQ ID NO: 77815 - DNA, 422 bp, Zea mays
  Clone ID: LIB3079-007-Q1-K1-A7
gtcatgttttattattgttgttctattctgttcatgataagactattatgtgtaaaggccaaaattggtaggagaaaaaatataataataatactaagtaataatgttgtgagaatttgtaaaacctttgagacttattagtgcctttccttttcataatcaaataatgatattaaaatggtcgtgtaaccaataagtgaataaaagagtggacatctcatacttatgaaaatgtggtatcattaccaaaataaaataacactaataaataaataaataaataaataaataaataaataaacaaataagtgcacatcatactggagttttattttgtgcatctgaaataagtttgaaattcataatcaagatctgatttgaaatttaaaacaaaaaaacttacaaaagaataggaaaggaaa

SEQ ID NO: 77816 - DNA, 429 bp, Zea mays
  Clone ID: LIB3079-007-Q1-K1-C5
gatcaggtcatcgggaaggccgccatggacgacgaggagcacgaggtttacggccaggagatccctgaggacggcgatatggacggcgctgacgttgatatggccgccgccggggacgacgcggcgaagcttcaggagcttgacgagatgaagcgcaagctgaaggagatggaggaggaggccgccgccctccgcgatatgcaggccaaggtcgccaaggagatgcaaggaggtgaccctagtatatctacagctgaggcgaaggagcaggtggatgcccggtctgtgtatgttggaaatgttgattatgcttgcaccccagaagaagtgcagcagcatttccaagcttgtggaactgtcaacagggtgacaatcttgactgacaagtttgggcagccaaaaggttttgcttatgttgaatttctggaa

SEQ ID NO: 77817 - DNA, 440 bp, Zea mays
  Clone ID: LIB3079-006-Q1-K1-H3
gcgattggtgcctacatttccttgctttgcaaaaatccttgtctcactcatggagaaggcacatgttgactttgggctaaaacttcttggagcagatgtaatggctattcctggtctttacagatttgttcaggagaccatcaagaaacaagtagcaagcatgtatttgtggccgaagacactagaagtacctataatggatccctcaaaagcatcaaaaaggcctgttggaattctacttgtgaaggttgtgagagcccaaaatctgcggaagaaggatctgctgggtaaatctgacccatacgtgaaacttaagatgtcagatgataaacttccatccaagaagacaactgtaaagcgcagcaatctcaatccagagtggggtgaagacttcaagtttgttgtgacagatccagaaaaccaggctcttgaagttaatg

SEQ ID NO: 77818 - DNA, 178 bp, Zea mays
  Clone ID: LIB3079-006-Q1-K1-H4
cctctcataaccccctcgacccactcgtccccccacgcgtccgcccacccgtcctaaatataaaaaaacaaaacaaaatcaaaaaaaaaggcaaatttaaaaaaaaacattctccaaaataccaacctaactacacaaacatcctaacccataactaatatataatgacaccaaaatt

SEQ ID NO: 77819 - DNA, 439 bp, Zea mays
  Clone ID: LIB3079-006-Q1-K1-H5
cacagttcctccgaccagttacttcaatgggcttcgaacacctagctgtgcaagcctgcaagctacaacaagcgcttgcggcgagcgtcttacaacaaccaattaaccaattgcaacaacaatccttggcacatctaaccatacaaaccatcgcaacacaacagcaacaacagttcctaccagcactgagccaactagatgtggtgaaccctgtcgcctacttgcaacagcaggtgcttgcatccaacccacttgctctggcaaacgtagctgcataccaacaacaacaacaattgcaacagtttctgccagcgctcagtcaactagccatggtgaaccctgccgcctacctacaacagcaacaactgctttcatctagccctctcgttgtgggtaatgcacctacatacctgcaacaacaattgctgcaacagattgt

SEQ ID NO: 77820 - DNA, 442 bp, Zea mays
  Clone ID: LIB3079-006-Q1-K1-H6
gacgcacgcgtccgcgggcatcagcgatggagtaaagggttcagcacgacagcacgccagcggccagcgaggggcaccgggcaggtgggcagcagcaggggacaggctgcaagcagaaatggacattaaaggtcttgaggcagataaactggagtgcaggctctatgtagggaacctagacttcaggatgtcagagtccgatgtaatcaagatgttttccccttttggaaagattacagccgaggattttctgtggcacacacgcggtccaaagagaggcgaaccccggggctatgcctttgttcagtacaccactaaagagcattcaggaagctcagttagcaaaggagaagatgaatggaaagttaatctgcggacgcccaatggtagttcaccttgctagtgagagaagttctctaggctcttcaagttcacatagagc

SEQ ID NO: 77821 - DNA, 266 bp, Zea mays
  Clone ID: LIB3079-006-Q1-K1-H7
acccactcatccgcaggcatcaaccatctacttactattatatcactacaacacataaccactcaatggtgcactctttaaaaatactcagctaccaactacattctacaaccatttattcacattcaacatccataactccaaaccactttccaccatgctctatataacaaaccttctcttaactatatcacaaacacatgatcttttgaaaccaaccaatctcataacattaacaccatattataaacttaccaccacactca

SEQ ID NO: 77822 - DNA, 434 bp, Zea mays
  Clone ID: LIB3079-006-Q1-K1-H8
aataaccggctggacccacgcgtccgggcacttgatcagtcaaatgcaacatgtggcaagaggttatcatctattggcttgcggaacacataattgaaccgtcaggcttacaggcagctattgctgacaactgctgttcttggtgaatatatcactggcgctattcttttcgaacgagaccctttatcaatcaactacagacggcaagaagcttgttgactgcttgaaagatcagaatatcatgcctggcatcaatgttgacaagggtttgattccattgcctggatccaacaatgaatcatggtaccaaagtcttgatggcttggcttcaaggcgtgctgactactataagcaggtggcgcgcttcgcatagcgcatgactgttgctagcatccatcgtggtgcatctgcattatcagtcaatgaatcatcat

SEQ ID NO: 77823 - DNA, 350 bp, Zea mays
  Clone ID: LIB3079-006-Q1-K1-H9
gtcagcctgctcattggcacacacgcggacacaccacaggcgcgcaagcccaaccgagcgagcagctctagcatggcgagcggcggctactactacgaccagagcgcgggctacggcggctacagctactcggcggcgccgaggacgacgccgtcccacctcctggtgttcctggccaccgtggcgctgctgggcgccacgtcgctctactcgcgctacgagtccgcggtggagagcctggtggaccaggtgcggttcgccgtggtgctgtccccgctgctgctcctgctcgcggtccagtactgggcggccacggccgggtcccggcggccccggggcggcgcccttcc

SEQ ID NO: 77824 - DNA, 436 bp, Zea mays
  Clone ID: LIB3079-007-Q1-K1-A1
gggtcaccatgatcatgaatcatactatggtgaacgtgatactgagagtttagtcgcggcaatggaaacatatgttgcaaacatcccaaaagaggctcatgctttggaagacaaatccaataagactgttgatcctgcaaagcgccctgctccaatggccagtgggtgcagaatagaaggctttgtgcgtgtcaaaagggttccagggagtgttgttatctcagctcgatctggatctcactcgtttgatccatcccagataaatgtttcgcactatgtgacacagttctcatttggcaaaagactttccccaaggatgctgcatgaattcataagacttactccctatcttcgtggataccatgatagactagctggccagtcttatactgttaagcatggtgaggttaacgccaatgttactattgagcactac

SEQ ID NO: 77825 - DNA, 429 bp, Zea mays
  Clone ID: LIB3079-007-Q1-K1-A10
gctttcatcaactccggcgacttggagaagacgaagttccagaatccgatcgggggggtggtgctcgcgccttgacggattgatttcggtgcgccgatggggcaggcgttccgcaagctgttcgattccttcttcggcaccagcgagatgagggttgtgatgcttggtctggatgctgccggtaaaaccaccatattgtacaagctgcatatcggggaggttttgtcgactgttcccacgattggtttcaacgtcgagaaagttcaatacaagaatgtgatgtttactgtgtgggatgttggtggccaagaaaagttgaagcccttgtggaagcactacttcaacaatactgatggcttgatctacgtagttgattcgttggatcgggagagaattggaaagccaaagcttgattcaggcaataatcaa

SEQ ID NO: 77826 - DNA, 385 bp, Zea mays
  unsure at all n locations
  Clone ID: LIB3079-007-Q1-K1-A11
gtccctgtggaagtttccacactcccttcccttcccttgtacccactccaatggcgccctccctcctggccgccgtctccgcctcgcccttcctcctacccggcagcagcggcatcagccgcaggccactgggcgctgccccaacccgccgggccggactgcgcgtggccgcgcttaagtacgaccctgctaaggtggcaccgcagaacgaccgggtgctcgtccgtcttcagcagatccctgagaaatctgctggtggtgtattgctaccgaaatctgctgttaagtttgagaggtatctgatgggtgagattctatcggttggtgctgatgttagtgaagttgaggctgggaaagaggttctnctctcagacatcaaatgcta

SEQ ID NO: 77827 - DNA, 417 bp, Zea mays
  Clone ID: LIB3079-007-Q1-K1-A12
ctcgaagtcactttgtcaaagcgcttgaggttgctctcctcctgatcgtttacggtggatatggatacacaaaaggcggttcatcttcatttattctgattactatcagtagttggttcctcgttatgtcctggcttttcgcgccttacattttcaacccttctggtttcgagtggcaaaagactgttgaggactttgatgactggacaaactggttactttataaaggtggagttggtgtaaagggcgacaacagttgggaatcttggtgggatgaggagcaggcgcatatccagacattcagaggacgtattcttgagacaatcctcagccttagatttctcatgtttcagtatggcattgtgtacaagcttaaaattacagatcataatacttctcttgcagtttacggcttct

SEQ ID NO: 77828 - DNA, 421 bp, Zea mays
  Clone ID: LIB3079-007-Q1-K1-A2
ggcgaagtgcagcgcagtgtgccccgtctcggaacagcgcggaccaccagagcgtgcgcgtccgtgccccacccctccctctctatccatggcggtcccccgcgggtgcctcgggctccccctggtcgccgtgctcctcgcgtccctctgccgcggccaggcggcggtgagggagctcaaggtcgggtactacgccgagacgtgcccggaggccgaggacatcgtccgtgagaccatggcgcgcgcgcgcgcacgcgaggcccgcagcgtcgcctccgtcatgcgcctccagttccacgactgcttcgtcaacgggtgcgacggctcggtgctgatggacgccacgccgacgatgcccggcgagaaggatgcgctctccaacatcaactccctgcgctcgttcgaggtcgtcgacgagatc

SEQ ID NO: 77829 - DNA, 315 bp, Zea mays
  Clone ID: LIB3079-007-Q1-K1-A3
gatattgtgacacggagcaccaaaacagtatagtggtctactgctgctcgcatccacgagccgaagcattgctatggcacttttctgcagtgtcgggccaattgctacgttcataaacgcaagtgatcatgtggccatatctgataatgtggttctaaaaacatcatcattgttagcttaaacaatgtactttacaatggttggtaatataataatatggggaagtcgttctatggttaaaaaaaaaaaaaaaaaaaaaaaaaaacaaaaaaaaaaaaaaaaatttaaaaaaaataaaaaaaaaaacaaaatatt

SEQ ID NO: 77830 - DNA, 303 bp, Zea mays
  Clone ID: LIB3079-007-Q1-K1-A4
gcgggaaccaccaccgtggacatcacgcccgagtgcgctggcatgctggagaaactcgggctcgcgcaagcgcaggagtgcttcttcgagaaggtcataagtggagggaagccaccagcgctgtgctccaaagtggcgcggcaagtgggcatattctatgaagaagcatatgcagctctcagtgcacctcctctaagtcagcactttgataagacatgggtgtcccatgtccagctgaaagctgctcaattctatgccgatgcttgctataagtattcattagatcttcatcagaaagaagaa

SEQ ID NO: 77831 - DNA, 420 bp, Zea mays
  unsure at all n locations
  Clone ID: LIB3079-007-Q1-K1-A5
ttcacgtactccggccatccggttgcctgtgctgtggccattgaagctctgaaacttgatcgcgaaagggacattcccggccatgtcaagcaaatcgccccaaagttccaggacgggattagggcgctggcagacagtccgattatcggggagatacgtggcttggggatgattatggggaccgaattcacaaacaacaagtcaccgactgatctgttccctgccgaatggggggtcggtgccatcttcggcgaagagtgccagaagcgcggcatgctggtgagggtcgctggcgacgccatcatgatgtcgccgacgctgatcatgacgcccggcgaagtcgacgagttggtgcgcatctacggngaagccctcaaggccacggangagagggtggcagccctgcagtccaagaagaac

SEQ ID NO: 77832 - DNA, 401 bp, Zea mays
  unsure at all n locations
  Clone ID: LIB3079-007-Q1-K1-A6
ccgcgctcgcctacatggaggacgagggccagtgggtcctggccttctggatcgccagcggcgcggcgctgctcggcttcctcctcttcgccgtcgggaccatcaggtacaggcacttccttcccagcggcaacgctgttgtcagcgtctgccaggtggtcgtcgctgccgtcaggaaccggcgcgtcagagctacggttcgagcgcaggatatgtacgaccccgataccgatggagatcgcggcaagaagggggtcaggaagatggtgcacacaccagagtacaggtgtctggacaaggcagcggtgatcaaagatccagcgtctgcgttccgagcaccggcaggtcaaccacagggccattcctnctncaagcccaacccatggaggctctgcacactg

SEQ ID NO: 77833 - DNA, 269 bp, Zea mays
  Clone ID: LIB3079-006-Q1-K1-H2
aaaaaaaaaaaaaaaaaaaaaaaaaaattatacaaaaacaaaacaaaaaaataaaaaaaagcaaattatacaaaaaaaaacaacccaacaaaaactttaaatccaaaacactctctcttcaataaccaaacttacatacacttacctgccactccatacccatcttttagacctaccaaaatttaattaaatcccacctcattatccaacgtactacactgcaaaatccttagcattccccaaattaatcacctttccacaaatccccc

SEQ ID NO: 77834 - DNA, 444 bp, Zea mays
  Clone ID: LIB3079-011-Q1-K1-D12
cccacgcgtccgcccacgcgtccgggggtctacaaattcaagtgagaacaatttattgtgggaccggtattccaagcgggctaaggttgcaaggctagatggtgcaagtgacaatgatgaaagccagttgccgccaacttctgaagttttaccgtttgcaagctccaactactctccttccgaagctccaagtaaacctgacttgcttattggcaccccagattcggcatccaagaactatgtggagcagcagtacgagtactgtgtgaaggtggtcagatggttggagcatgaagggcacatggacaatgacttccgtgtgaagttcctcacttggttcagtctgaaggcaacagcgcaggacaagcgaatcgttggcgccttagtagatgttcttatcggtgatcctgcaagcttggttgcccaacttgttgatgcattcaa

SEQ ID NO: 77835 - DNA, 337 bp, Zea mays
  unsure at all n locations
  Clone ID: LIB3079-011-Q1-K1-D3
gccacgcgtcgggactccgtccgaccctcgaagcgatcaccttaccgctctctgtcgtgcaggtgaagatgattccgcagagccagagcagctccctgcagcgccttcaacacgtcgagaagcggatagtgcgggtgctggagcttgcgggagcggtgatggaggagctgggaaactcccatggccctcgcaccgatgcagtcagcgcgcactgccgtgagttcatgatcgctatgaaggaaattcanacgacgttgcgtgaggaaatcaaaagtgcttgtgaatatcgtccatttgaaagtgtgattacagtgccaggattggctatgagatatgc

SEQ ID NO: 77836 - DNA, 463 bp, Zea mays
  Clone ID: LIB3079-011-Q1-K1-D4
aacacacatacgaaaaactaaaaaacaactttaaaagttatcacctatacacaaactatactgctaattgcaagtgaagaatggtgccacagagccagagcagctccctgcaacgccttcaacacgtcaagaagcggatagtgctggtgctggagcttgctggagcggtgatggatgagctgcgaaactcccatggccctcgcaccgatgcagtcagcgcgcactgccgtgagttcatgatcgctatgaaggaaattcaaacgacgttgcctgaggaaatcaaaagtgctcgtgaatatcgtccatttgaaaagtgtgattacagtgcaaggattgctaatgacatatgctgcaagacgctagagtatgtaattgagaagttggataccatgcaacatatccttgaacatatcactgatgatgtttaacgagctagcaacatattacgtactatactcttttt

SEQ ID NO: 77837 - DNA, 430 bp, Zea mays
  unsure at all n locations
  Clone ID: LIB3079-011-Q1-K1-D5
gggagtgctcttcgtcgaggccgacgcgcccgatgcctctgtcgatgactacggtgactgggcgcccaccatggagctcaagcgcctcatcccgaccgtcgattacaccgacgacatctcggccttctcgctactcgtgctccaggtgacttatttcaaatgtggaggcgtctcccttggtgttggcatgcaacaccatgcagcggatggcatgtctggcttgcacttcattaactcatggtctgacctctgccgtggagctcaaatttctgtcatgcccttcattgaccgcacccttcttcgtgctcgtgatccaccaactccatcttttcaacatatcgagtaccagtctgccccagctatgttgtcctncacaacccaggtccttgcttccaagtcaaagccacctgccactgcttgggacattttc

SEQ ID NO: 77838 - DNA, 350 bp, Zea mays
  Clone ID: LIB3079-011-Q1-K1-D6
gtgccaaccaatcatttatatatcggcgacatctttctggtaaactccaccgacattatgaggcccaattagtccattcgtgaaggcattgaaataattgtttcacgaggaatgactatgccacaggtgatcacgtcactggaaccaacacctcggaagagccacgtgcgtttagacagagtgaggactgtatgaggcatgaatgaaagcgatgggtgtttcacgatggattgtctaattaatggattcaaagctggggcatggagcatgaagcaggatcagtttgtagattgcattcagaactcctgtgcacgttggtagacgtagatacatgacaaccctgattgact

SEQ ID NO: 77839 - DNA, 395 bp, Zea mays
  Clone ID: LIB3079-011-Q1-K1-D7
cgacgcacgcagagccgcagagatccgtctcactgcaagttttgaaaactgaactgtaggatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgacgtgcctcatggcgcatcatctactccatcgagcaaaaagaagaaggtcgaggcaatgaagaccgtgtaacactcatcaaggactaccgtggcaagattgaaactgagctcaccaagatctgggatggcatacttaagcttctcgaatc

SEQ ID NO: 77840 - DNA, 313 bp, Zea mays
  Clone ID: LIB3079-011-Q1-K1-D8
cccacgcgtccgtgcaaattaaattgagctgtacctgttggtcttcctcctcgctcttgttggttctcgctggttgccgggagctgggatcgaaagtactgctgttgttcgcacggcgaggcggcggcggagaccggtcagaaggaatgtcttcggcccaaatcgcgccggcagatcatgtgtgctatgtgcactgcagcttctgcaacacagttctcgcggtgagtgtcccggggaatagcatgctcaacatcgtgacagttcggtgtggacactgcgcaaatctactgtcagtgaacctggaagcactgat

SEQ ID NO: 77841 - DNA, 442 bp, Zea mays
  Clone ID: LIB3079-011-Q1-K1-D9
gctctggttcctttttgggatgaccgtcatggaaccataacaggcatgctcactgcatgggattttgttttaatcttgagaaagttgcagagaaacattcaagttattggcaacgaagagcccatttctgcttggaaagaagcaaagctacagttctatggtgggcctgatggtgctgtcatgcagagaacgccattaatccatgcaacattgatctcagggccaagaaagaagctcaactcggcatgcttcctgtttgaagcaagggcaacaaacttaccccaccagatctctgtcgccaaagcagggctagtgaataagctgtgtttcctcccggattgtcactgcttttatatttgtgcatttattttgagggaaacattttgcccaaaaaaggcctgcagtgcacgttttaaacaagtcatttgaaccaactcttatg

SEQ ID NO: 77842 - DNA, 365 bp, Zea mays
  Clone ID: LIB3079-011-Q1-K1-E1
accacgcgtccgagcgaatcaaagggcgctcgacaagcctttcaagtacagactacagaggagagccgggcagcgagacggctgacgatggggatgagcctcgcccaggcggtggccgcgctcgcgggcacgtgcgcgcggcgcctgtcgcgggcggcgcgccggctgcgcccgcgggacggcgtctcggcgtgcttcttgtcccgcgccatcgtgccgttcctcggcggcggcagcaagggcgtcaagaagtcagtctcctcatcagcatcatcctactcgtcgtccaagttggagaggacgaaagcggcgccggaggatgaggacgaggcggtggacaggctgatgctgatggagatcatgat

SEQ ID NO: 77843 - DNA, 435 bp, Zea mays
  unsure at all n locations
  Clone ID: LIB3079-011-Q1-K1-E10
cccacgcgtccgtgcacggcgccgccgcgcgaggacagcgcgccggcctacttctgggggcgcgccgcgcgcgccgaccgcaggttctaccgcctcttcttcgccgagcgccaccgggacctcgtcctgggagactacctcacccacgtccgccgcgaggggcgcgccgtcatggtcaagaaccgccagcgcaagctcttcaccaacatctccggcgacggctcctgggactcggacggtgtttggagccacgtggtgttcgagcaccccaagacgttcgcgacgctggccatggacccggacaagaagaaggaggtgatggacgacctggacgcgttccgcaacggcaaggactactacgcgcgcgtcggcaaggcgtggaagcgcggctacctnctgtacgggccgncggggacccggcagtccaccatgatc

SEQ ID NO: 77844 - DNA, 437 bp, Zea mays
  Clone ID: LIB3079-011-Q1-K1-E11
cgcagagccagatcaagggaagacgacgcatatctcgccacgcgaacacagttagatcgggggagggagtgagagtgagagccatgacggagctgttcgacacggccgtgaccagcctcctccacctgccggaggtgctggaccgtctctccgccgcagacggcgaccggcggtcggccggcaaccacgcggcgcacgggcacggacacggacgcgtccacggtctcggcggcggccgcggagcgccggtggacatcgtggagagcccccgcgagtacgccttcgtgctcgacgtgcccggcctcttcaagtcagacatccaggtgacgctggacgaggaccgggtgctggtgatgaacggcggcagcgggaagcggaagcgcgatgaggaagatgacatgaacggcgataggtgccgatacatccggttggagcgc

SEQ ID NO: 77845 - DNA, 188 bp, Zea mays
  Clone ID: LIB3079-011-Q1-K1-E12
cacacttatgctcccacaatgatacttacacaccatacatcacatcccttgctaccattcccactattgaatgaacgaccataaattgcctacttgccaacttccattcaaacaactctatggtgcactcctcttctgcagaacacttctccatatctcactcattggctgacaaaaatcttatgcta

SEQ ID NO: 77846 - DNA, 314 bp, Zea mays
  Clone ID: LIB3079-011-Q1-K1-E3
ctttgctttttgcatggcactacttgtgagctttcctactggcacaatcgaaccaagtagggctgggctcactgtaacatatggacttaatttaaatgctcgcatgtcaagatggatattgagcttctgtaaattagagaacaggataatctatgctgagcgcatttatcaatattgcaggcttcctagtgaagcaccattgattattgagaactgacgtccaccatcatcatggcctcagaatggaaacattgaactgattgatctcaaggtccgctacaaggacgatctaccattagctcttcatggcgtaa

SEQ ID NO: 77847 - DNA, 445 bp, Zea mays
  Clone ID: LIB3079-011-Q1-K1-E4
caaagagaaagaagagtccaagcacaagcactactactatcatcatcatctatggcttcgtcatccggctcccccgtcttcaagatccttatcgtcgtcgctctcgtcgctgctgccctttcgtcctacggagcggcggagtacatctgcatccagccgtgctgggagctgccgcactgcgacgcctggtgcagggacgccaagttcgccaagggcggcgactgcgtcgacttcggcagcggcctcacctgctgctgccgtcggtagctagggtagctgcgcgcatgcacagatgcaggtgccagagtgccagtggagaatggagcgtcggtctctctctcgtctcgatcgtgtaagataaatatatggcagatgataatgcacaatacaaataaacgggagaagaaaaaaaatccaaggatctcgcatgcgttggttccataca

SEQ ID NO: 77848 - DNA, 384 bp, Zea mays
  Clone ID: LIB3079-011-Q1-K1-E6
ggctgctgaaggacggcaaactcgagacgctgatcgactcgaggttcccgctgagcgaggtgagcaaggcgtgggagaagagcatcgagggccatgccactggaaagatcattgtcgagatgggagactgatctgggacgcgtccattgccgatagagacttgcagtagcatccactaggctgttggacactacagggttaaagtcaacatatacgaagtagtactagtatctgagtttggtcgtcgtacaaattgttcgtgagtggtgagccagtttataggcttggttttcttttggtttcagctattaacttgaacttcttggacaagttaagggtttaagggggtggatgatagatcccgaaaggtgcaattgaattacc

SEQ ID NO: 77849 - DNA, 305 bp, Zea mays
  unsure at all n locations
  Clone ID: LIB3079-011-Q1-K1-E7
ggttaatcaaggcaggacatcacgtcgaggtgaccgggatacaaacggcacaggctgacgtggaagtgagcttcgaggtgtcgccggcggccctggccggtgccgagacgctggacccggcgctggcctacgacgcggagaagctgtgcggcgtgaagcgcgcggacgtgaggggcggcgtggggccgttcgggctgtgggtgctggccttcgccaaccgcaaggagagaaccgccgtgttcttcagggtgttcaagcccgccgncggcagcgacaagcccgtggtgctcatgtgcaccgaccct

SEQ ID NO: 77850 - DNA, 420 bp, Zea mays
  Clone ID: LIB3079-011-Q1-K1-D10
ctccaagaaactaggcaatcgtttcctcctctgcttcagtatctccccttccagcagtaggtaaggtgccatatggcgacaagcaggcttgcgctcgtgtccgtgtttgccgcagccgtcctgctgggcatggcgtcggcggcgacctacaacgtcggcgagccggccgggtcctgggacctgcgtaccaactacggcacctgggtctcctccaagaggttccacccgggtgaccagaccgtgttcaagtactcgccccaggcgcacgacgtggtggaggtgaacaaggcggactacgactcctgctcaatcgccagccccgtcgccacccacaactccggcaacgacgccatcgccctggccttccccggcacccgctacttcatctgcggcttccctggccactgcgacgcgggcatg

SEQ ID NO: 77851 - DNA, 95 bp, Zea mays
  Clone ID: LIB3079-011-Q1-K1-B4
caaatgcatagttcatacgaatcagagtacacgatgcacacaacttgatgtctctatcgtggtttggaacatgatgaacatgcgaatttcgtggt

SEQ ID NO: 77852 - DNA, 408 bp, Zea mays
  Clone ID: LIB3079-011-Q1-K1-B5
aaaaaatatggattatctcaaaatcccaaatcgtgcacctgaatatcgactgggaagaagccacagatttcttgtgccgcatgaaggagtacataccttcgcggtcagttttcaccgatgaggtcactgcggccctgggagaacacttctcagttcagcccgtggatctacaagcagttctttccggtgatgaaggatccgtgccttctacaaagctgctgtcacaacaggacctagaaagaaattgtttcgtccaaagaatcccttaacaatatagaaagttgaagcgtgaccatgcttgtcgtttttgttgtgaaatatgagcagttttgtcgagctgtgaattcattcaaacattatgggcaacccagtacgtacatacgaatgcccaccaccatctttaagtac

SEQ ID NO: 77853 - DNA, 362 bp, Zea mays
  Clone ID: LIB3079-011-Q1-K1-B6
ccggccgtgacatcctccgaaccatccgctccatggcctccaacatgctcagggtatacgactggcacatcaccgactgccagaccttccccatcgttctgccctcggtccccaatctcgccaacttcggctcctactccgacgacatgcgctacaccgaccaggacgtacgacgcatcgtccgatacgccgaggcctttggcattcgcgtcatccctgaaatcgacatgccccgagagtgagagctgattccacagtactgtactggatcctgcactatgctacagctgcaatcttcaatgcaaagacttcagggcacacggggtcgtgggcggacgcgtacccggagatcgtgacttgcg

SEQ ID NO: 77854 - DNA, 337 bp, Zea mays
  Clone ID: LIB3079-011-Q1-K1-B7
cccacgcgtacgtggtttttgcctactacgcacaagcaactgccgctcacgagatattgggccacactttgcaatcccttcatggaattaagtatctttacaagtacaatgttatccagtatggctttggtgctctcgccatcctcactctcttatactatgctatatttcgatggataaagaggaaaccaacaggaagattccagctctcaaattgattagctctgtaagtcgaagattgacagattcatcatatgtgccccctgagaggcagctcagttagcatgttagaaatgtatatgatcaacataaccggaccaatgcaaaccaaatcatc

SEQ ID NO: 77855 - DNA, 437 bp, Zea mays
  Clone ID: LIB3079-011-Q1-K1-B8
gaagaatgctctgaagaatgagccagaggtagaactgtaagcacactgattctgcttccggttcatttttgattgacacttgacagtactggttttatgcgacattaatcatcgcaagtactagaaaatggagaaccgcagcaagactaattacgttcgaaacatcaagtgatgctcatgttgggtcttttgctccagttgttagtcatcaacaaaactagacaccttttgctggtcctctttttgggggtgtaattggatcgtgtaccaagactagcatcatttgcagcaataatactagagtagtaagattttgaatttaaataacttatgtcggtcccttctttcagtattatctatgtcaaatcatcgttcaagtctcttttcctgaggaccagaccttgtttttggttccatgccgtggggtctttctttgg

SEQ ID NO: 77856 - DNA, 400 bp, Zea mays
  Clone ID: LIB3079-011-Q1-K1-C10
gcaacaggtgcaaaactcacaaagaatctgttggtcaccctggagtgtcatagcttgctggtggattattttgttccaggatatgtcgctgcctgttctagctgcttcctcaaggctgccgtttgagccatttccattctgcagagtttctgctgctctaaaatgtccgtctcgctatttcattactgcttgtcgaagttccccatttgtgcatggtataagcgcttgaataaaatgtttctggaaagtaccggcctacaatctggattttggcaacataattgaattagctggtgcacaatgaggcaaattgtcttacgctgtacttgatgaactctggagtattatcactcgtcaggttgaaaacgggaactatacaatgtaatttcagcacagatta

SEQ ID NO: 77857 - DNA, 435 bp, Zea mays
  Clone ID: LIB3079-011-Q1-K1-C11
ggttttgataggttcctaaagttgacatccagattttctgaagatcctgctataattcaggaggttatgtctatggtgacggtcctcacactgaggtcaccagaaaatgcagcacgtgcaatggaagaaggctatgggacactggctatacagtcaatgcaaaggttcccctcctccgtgcagactcagaagcaagcatgccttatgattcgcaatcttgttgcccgaaaccctgagaataggatcgtcctgcttaatgatggtgcagaaaagcttattagaaaggcaatggcgctgcacagaagctgtaaagatgctgcttcgtctgccttgagggacctgggcctcgacaactacaatgcatagacaccagtgaccagtcacaccatagaaaatgtgcgtcgagttagtttggtagcggtagaatgttttgga

SEQ ID NO: 77858 - DNA, 425 bp, Zea mays
  unsure at all n locations
  Clone ID: LIB3079-011-Q1-K1-C12
gttcttggcacgggaaagaagaaaatggaggaggaattaatgcagctggaagtgaaatatccaaacattgctagaggcatagcgaaattcaatgttccattggcacatatgatgtttgctgggtctgacttcattattgtcccaaattcccatctgttcatcacctggaggacttgttgacacggttgaggaggggtgtcaccggattccacatgggttctttcaatgtcgagtgtgaaactgtagacctagctgacgtgacggcagtagcgtcaaccatcacacgggcctagaacagtacggcaccccggcgttccaagaaatggttcagaactgcatggcgcaaaacctatcctggaaggtgcctgcgaagaagtgggaagaagtgcttctgggcctttgagtcnaggggagtcaaagctgca

SEQ ID NO: 77859 - DNA, 449 bp, Zea mays
  Clone ID: LIB3079-011-Q1-K1-C2
cctccgaccactgttcttgtcattaacctggtcggaatggtggcaggaatttcgtatgcgattaacagcggctaccaatcctggggtccgctctttggaaagctgttcttctcgatctgggtgatcctccatctctaccccttcctcaagggtctcatgggcaggcagaaccgcacgccaacaatcgtcatcgtttggtccatcctccttgcgtctatcttctccttgctgtgggtgaagatcgatcctttcatctccccgacacagaaagctgccgccttggggcaatgtggtgtgaactgctgatccagattgtgactcttatctgaagaggctcagccaaagatctgccccctcgtgtaaatacctgagggggctagatgggaattttttgttgtagatgaggatggatctgcatccaagttatgcctctggttattagcttcttc

SEQ ID NO: 77860 - DNA, 130 bp, Zea mays
  Clone ID: LIB3079-011-Q1-K1-C3
gacccacgcgtccgggtttctccccctctctctttcttgtagctttgctgtttccgtttgcccccgtttctttcttttgggtggttctaagctttaactaactggaggaagaaagattcagttagaacgc

SEQ ID NO: 77861 - DNA, 406 bp, Zea mays
  unsure at all n locations
  Clone ID: LIB3079-011-Q1-K1-C4
cggcggccagcggaggagggcacaggcagcagctaacatccctcactctcggtacctgaggtgaccatgagagcaacatgggcggaggacacgacatgcacgggcagcactacggccacaacggcggcgtgaagggcttcgtgtccaacctcgtccacggcggcggcggccatggccatggaagcggctacggccatggccatggaaacggctacggccatgggaatggcggctacggcggcggccacgggtaccctcctcccgccgccgccggcgcgtaccctcatccgcacggcgcgtaccctcacccgcacggcggccacgggtaccctnctcccgccacctaccccgcgcactcggcgcactacgggcacacggggtcgtaccacaccagccacaacagcta

SEQ ID NO: 77862 - DNA, 429 bp, Zea mays
  Clone ID: LIB3079-011-Q1-K1-C5
cccacgcgtccggttctcccttccacatctgaggctttaaatccacagattgtgagcaagagccctgtttcgatctcgtcacagcagcagcagcatatctcccagcaacaagccgcagcacagatgtaccctcaaatgcatgtgcagcattttccaaatttcatgccatatcgacaactctattctccagtttaccccatgcctatgccaaactattcgccaaatgtcccttatccatcaaatggaaataattatcttcagatgcccagtggaggttcacatttaactgcaagaagcgtgaagtatggagtttcacagtttaaaccactcccatctggtaacccttctggctatggaaattacactcatccagctggttttacaatgggttctcctggtgttattggagccacaagtggtgttgatgat

SEQ ID NO: 77863 - DNA, 322 bp, Zea mays
  Clone ID: LIB3079-011-Q1-K1-C6
aaaaaacaaacaaaaaataaaaattcaaaaattaaactaaaaatacacaaaaaaaagaacacgagaaatataaaaaatctcaaaaaaaaaaaaacaaaatatcataaaaaaaacaaaccacaacacagatgtaccctcaaatgcatgtgcaccattttccaaatttcatgccatatcgacaactctattctccactttaccccatgcctatgccaaactattcgccaaatgtccattatgcatcacacggaaataattatcttcacatgcccagtgcatgttcacatttaactgcagcatacgctaacccttaagtttcaca

SEQ ID NO: 77864 - DNA, 442 bp, Zea mays
  Clone ID: LIB3079-011-Q1-K1-C7
gaagaaatcaccaccaccacaccaacaatttcaagactccttcgagtcggaggcatatcgagtgaaatggaacaaatcaccaccaccacaccagcaatcgcaagactcctttgagccggaggcatatcgggtgaaatggaacaaatcaccaccaccacaccaacaatcgcaagactccttggagcaggaggcatatcgggtgaaatggaacaaatcaccaccaccacaacaacaaacgcaagactctttcgagcaggaggcatatcgggtgaaatggaacaaatcaccaccaccacaccagcaatcgcaagactccttcgagccggaggcatatcgggtgaaatggaacaaatcaccaccaccacaccagcaatcgcaagactcctttgagcccaaggcatattgggtgggatggaagaaacatgcgcaaggagcaacggac

SEQ ID NO: 77865 - DNA, 366 bp, Zea mays
  Clone ID: LIB3079-011-Q1-K1-C8
cctattgaagggtttggcgtggggagggtggtcgactccactcatccaggattcagtgcgggtgacgttgtttccgggatgactggatgggaggactacagtctgatcaccaagcctgaacagctcaggaagatccagcaaagcgacataccactctcctatcatctgggccttcttggcatgcctggctttacagcttatgttggattctatgagatctgttcaccaaagaaaggggagtttgtttttgtttctgctgcatcgggagcagttgggcaaattgttggtcaacttgcgaagctccatggttgctatgttgttggaagcgctgggacagatcagaaagttgagctcttaaaggaaaaa

SEQ ID NO: 77866 - DNA, 359 bp, Zea mays
  Clone ID: LIB3079-011-Q1-K1-C9
gctttttctgaatcgtgaacagccgttgtcatttcatgtgtacccaaacctcccgtcccgcgtgggcccgtaagctgcgcctagatttcagggctaatcgtgtgcctgaaccctcatcataagtcgtctctgtacccagcttctcgtttcgtttgcacccgtgatggtatggtttggttgttgcccgctggacctatctattctttgcatttttcctttgaaaaaaaaaaaaataaaaaaaagagcaaacaacttaaagataatacttaaaaacttattaaaatccccctaacgatttacaaaaaactgtaaaaaaaatacttcctttttcttccaactaaaaaaaaaaaaaagggggg

SEQ ID NO: 77867 - DNA, 397 bp, Zea mays
  Clone ID: LIB3079-011-Q1-K1-D1
ctgaagtcctcttccagccaggcatgatttgaatcgtccaggccggcatcgatgagatggtcagcgtgctcactcaggagattaatggaggacgagtctgtgaaggagcgcctctgccagtcgatccttgtcactggcgggagctccctgttccctggcatgatccctcggctggagtctgggatacggcaatatcggccctaccttgctcccctgaagcttgtcggagcagctgaccccattttagacgcgtggaggggtgctgccgcctttgcggcatcaagcaagttcggcaaacaaacgttcagcctagctgattacggagagcatggagagaacctgtttcatcggtacaacatgtgttactcactataaccgggaaatgacatagtgatcg

SEQ ID NO: 77868 - DNA, 383 bp, Zea mays
  Clone ID: LIB3079-011-Q1-K1-B3
gggttttctttgcaggtctctttgtccctattggcacctctgctccgtcaacgctcttgtgtcaacaagggacacatagatcttatgtcgggtcggtgttttccgcctctcctgctctcgtacggcgctggatggtggcatgcggagcccggatgcgctgtcgggtgttgctgccggcttgaagggagatcatcgtctctgggatcggctcacgcttgcgcggtccctcacctagagggccgcacggcagtggagcgacgttgctacgaggggccatgtggatgcgcaatggtcctcatgtgctggcgagtatgttgttctctggtggtgctagtcgtcgatcggctgttgtcgtcctagccgttatagcctgcgtcatgttt

SEQ ID NO: 77869 - DNA, 168 bp, Zea mays
  unsure at all n locations
  Clone ID: LIB3079-010-Q1-K1-H7
ntacgtcacgccgtccgnccactcttcgttcaagttttccgtaaccttgtccaatcatgggcatgggggtgtggccattttggaaaagtggccacttttgtttatccagccatttgtacaactggaggccatggttgattcaaaggaccggccgttgttttcttccgg

SEQ ID NO: 77870 - DNA, 393 bp, Zea mays
  Clone ID: LIB3079-011-Q1-K1-A10
ataagcgcagatcgagtcatcaagctagctatgcccggagcacgcctagacacgccagcaggaatggcggctcagctggccgtcgcgtttctcgccttgttgtcctcctctgccttcttggccgtgtctggccagaagttcaacgccatcttcagcttcggcgactccatgtccgacaccggcaacctgtgcgtgaacggtccccccgccggcctgacgctcacccagccgccctacggcgagaccttctttggccgcgccacctgccgctgctccgacggccgcctcgtcgtcgacttcctggccgagaagttcgggctgccgctgctgaagccgtcgaagcagggcggctcagacttcaagcagggcgccaacatggcgatcattggcgcg

SEQ ID NO: 77871 - DNA, 435 bp, Zea mays
  unsure at all n locations
  Clone ID: LIB3079-011-Q1-K1-A12
gcagcttctgcttgctctggggggaaggatagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgactccgagccggccgtgtccgtgcagctcggcgaccacggccacctcgcctactcccacaccaaccaggcgctcctccgccccaggtcgttcgcggccaaggacgaggtgttctgcctgttcgagggggtgctggacaacctgngtcgtctgagccagcagcacgggctgtcaagcaagggcgccaacgaggtgctcctcgtcatcgaggcctacaagacgctgcgcg

SEQ ID NO: 77872 - DNA, 405 bp, Zea mays
  unsure at all n locations
  Clone ID: LIB3079-011-Q1-K1-A2
ccgcgccgacgcgacctgcgccgccgccgtctcgaagacagcggttcgtgtggaggcggagctggaggtcgacgcgctcccggcggttgtctccgacgccagcaaccgcgtccggctcgtgaacgacgcgtacaaggagatggtggggcagcccgagtgcccgtggctcgacgccgtggctgccacgtcgaggaggatcagcggggaggtcgcgctggtggtagccaaccagtcctccctgccagagtcgtacggggtgttcacatgcacggcaaagatcgagtgggaggacgacgggaaggtcgcctccatcgatgtaccctgcgacgtcagccggctgcagtgcgagtccagagagtacctcttcgtctggaggttccgtaccgncgacgccgacgccgacgc

SEQ ID NO: 77873 - DNA, 458 bp, Zea mays
  Clone ID: LIB3079-011-Q1-K1-A4
cccactttctgcttctcccgtattgccgtgccctcctccctctccctgctcgctctctcgctctcggcgctttctttcctggtcgcgccgcccttcatcaggtctcctccgccttagccggtgaagagcgaccaggcccaataaataatcaccatggctcatcaaaagcgtgaaggcagctacgccgatgatgatagtacatccaagcgcatcaaaggcaccgacactgcttctgaaacgggggacagtgtagagtctagtgtttcacagcaaatggatgctgaagctaggaggacctgccaaaaggaaagcgaagcaccatcggacaaatgcgtttcagatggggaatgcgctgcaaactctaaggttttgggtgagcagaagatggtattgactgttgtcgaggctgatgcggcggacgacaagggttgcaggcacactatggaggacgcctgggt

SEQ ID NO: 77874 - DNA, 368 bp, Zea mays
  unsure at all n locations
  Clone ID: LIB3079-011-Q1-K1-A5
gtgctgagtggtgggaggttcatttacgcatctttgctgcgacttctcgtctgaaaatgtgtcctaagcatgtcagcaagtaaggatgttctcgcgcttgcctcacttgaggttgacctctcaagcattgagcctggaaccacggtgacggtgaagtggcgtggcaagccggtcttcataaggcggaggacagaggatgatatcaagttggccaacagtgttgacgtcgcatccctccgncacccagagcaagatgcagagcgcgtcaagaaccccgaatggctggtcgtcattgnngtctgcactcacctgngctgcatcccgctccctaatgcangagactntggtggctggttctgcccgtgcca

SEQ ID NO: 77875 - DNA, 397 bp, Zea mays
  Clone ID: LIB3079-011-Q1-K1-A6
cacgcgatcatcagaatcttcattggcggttataccgtcatagtcaggctgtcgaccgggtgaccgagagatgctagcgctcctggggagggacaccctcgccatggaagacgaggacttgatcgtcaacaacgccgcactgatggcgacgaaaaaccggacggaggccttcctgatgctgcacgacaggatcagagaaatacctcagacgcacggaccgacagaagaagaggatgatcctgtacggactacactaccagaacgactggctggatacggacagagcgaacaagctgatcaaccagtgtgacatgaacgtgcagcacgagtacaatgcaacgcaccagtccgacatgctgctgctcaacaagaatgtgaagatgccactgcatgagca

SEQ ID NO: 77876 - DNA, 422 bp, Zea mays
  Clone ID: LIB3079-011-Q1-K1-A7
ctagccgcctgtcttgctgaagctgaactgctgatccgtcttccaagctgtggtgtcatgcatgcgttctgatccaagatgtatctccagtattacatcaacgagaaggatgacaaggtctacaccaccaagaaggagtcgcctcttggggtgccgacgcagtctgctcacccagctctcttctaaccagatgacaagtactctcgccagcggtacctgttgaagaagagatttggacttctgccaacgcagaagccagcactgaagtactgaagcttcaactctacaaccatggatgtgcagtttgtgtcactgcttaatgcttgatgctaggaatgtagaaataggtatctgatgaaacatatcaaacactgctaggcactactatgacatctcagcgcattcagcactatatgtaatgc

SEQ ID NO: 77877 - DNA, 421 bp, Zea mays
  unsure at all n locations
  Clone ID: LIB3079-011-Q1-K1-A8
ctgtctgtggagtacggcaagaaatccatgctgggcttcactgtgtacccatgtgcccaggtgtcaacctctgttgtggagccttacaacagcgtgctctccactcactcactcctggagcacactgatgtctccatcctgctcgacaacgaggccatctatgacatctgcaggcgctccctcgacattgagaggcccaactactccaacttgaatcgccttgtgtctcaggtgatctcatcgctgactgcttatctgaggttcgatggtgccctcaatgtggatgtgaacgagttccagaccaacctggttccttacccgaggatccacttcatgctctactnctacgcaccggtgatctcttctgcgaaggccttccacgagcagctgactgtggcggagatcaccagcaacgcgttcg

SEQ ID NO: 77878 - DNA, 429 bp, Zea mays
  unsure at all n locations
  Clone ID: LIB3079-011-Q1-K1-A9
agcacgtccacttctgcgagatctgcggcttgggcttccgccgcgacgccaacctcaggaggcacatgcgcgcccacggcgaccgcttcaagaccctagacgcgctctcccgccctggtcacggccagccgaagccgcccgttggcagcaacgtgcgcttctcctgcccctttgcgggctgcaacaggaaccgcacacaccgccgcttccggccgctcaagtcggcggtgtgcgcgcggaaccacttccggcgcagccactgccccaagctctacgcctgcgagcgatgtggcggcaagaagcgcttcgctgtcctggcggacctccgcagccacctccgncactgcggcgaggaggcacagtggcgctgctcctgcggcaccaccttcttccgcaaggacaagctcttcggtcatctagcgctctttg

SEQ ID NO: 77879 - DNA, 391 bp, Zea mays
  Clone ID: LIB3079-011-Q1-K1-B1
cagcagcttctgcttgctctggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctccttcgccccaggtcgttcgcggccaaggacgaggtgttctgcctgttcgagggggtgctggacaacctgggtcgtctgagccagcagcacgggctgtcaagcaagggc

SEQ ID NO: 77880 - DNA, 409 bp, Zea mays
  unsure at all n locations
  Clone ID: LIB3079-011-Q1-K1-B10
ccaaacccgaactccaagtcgccccgcatctatggcgcccaaggccgagaagaagcccggggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtccatcatgaactacttcatcaacgacatcttcgagaagctcgccgccgaggccgtcaagctcgcgcggtacaacaagaagcccaccatcacctnccgtgagatccagacctccgtgcgcctc

SEQ ID NO: 77881 - DNA, 411 bp, Zea mays
  Clone ID: LIB3079-011-Q1-K1-B11
cgcaggcgtcggcgcagtcggcgacagggtctacggacacgggaccgggaccgaaacggcggcggggaacggcggcagtcacgccgaggctggcgtccacgattgcttccagcactcgtccaagcgctcctcgatccgctccatgctgcacgacgaatgcgtcgaaggcatcctctacgggctcaaacatgcgacgatgcatttcatgatgcagctgctgaagaatcccatgtacattgtgtggcccctcctgatgccggccgtgatctgctcctccacctgctgctacgctagccagtacggtatacaagtttgcttgcatcacatgagctgtcacgatgacatgactgatgagatgactcatgaactgatacatgctcatgatgactgtgatgacgaatatcttgactg

SEQ ID NO: 77882 - DNA, 410 bp, Zea mays
  unsure at all n locations
  Clone ID: LIB3079-011-Q1-K1-B12
cgcagttttcaaatcgacaaaggggaaaggttcgcttcttctcgcatcttgctttacttggagtgccatggccgatccggcggaggagaacgttgtctcgccgccaccgacccctgcggccccagccgtgggcgcctcagactcgcccctgcagcctgttgctgacggcgcctcaacggagaaggtgtctgccccggcgccggaggtaaggtcccggggattcaggcttcttggagaggacacttccgtgcacaaatcccttgggggcggtaaaactgctgacgttctgttatggaaagacaagaaaacttctgctgttgtaataggcggcgcaactgtcatctgggttctgttcgaagtgcttgattaccacctnctgaccctgatatcccatgtactgattggtgtgc

SEQ ID NO: 77883 - DNA, 345 bp, Zea mays
  Clone ID: LIB3079-011-Q1-K1-B2
ccttcacaaaaaataaaataaaataaatgaataaacgcaacggatggaaggatatcttcgagtaattaacgggaggagatgtagggagagagagaaaccaccagaggcgagcgagcaggtgtgggcgtggcgtgggggaggcgccgaggcggtcgggcccgtagataagagtcgtctcacctcgtcgtcgcagcctcgcatcgcacgagaggagaaggagaggggaagggctagagagagaaacaaaggtggtagtagatgtgagccaccctctttgtatccctcgtcaacttctcctaccaacttctttttcctcccccaccccttccttaccgtctcgcgccc

SEQ ID NO: 77884 - DNA, 321 bp, Zea mays
  Clone ID: LIB3079-010-Q1-K1-H5
cccacgcgtccgggcttttcttctttgatattcacattccctctgcttatccttgtgctggcccgctggtatattaccactctggaggacttcggattaatccaaacttgtataacaatgggaaagtgtgtcttagcctgttgggtacctgggatggtagaggttgtgagaagtggaatccagctcaatcgacaatgctgcaagttcttgtctccattcaagctctgattttgaatgacaagccatattacaacgagccaggatatgagtcctatgccaacactccgaatggagagcggttggctttggactataatgaca

SEQ ID NO: 77885 - DNA, 306 bp, Zea mays
  Clone ID: LIB3079-010-Q1-K1-E8
agcatcccgccttggacttggacgggatcagcacgtcggtcggtgaagcaagtagccaggccatccatccgcgaccgcgagtaggaacagtaactgactgcggcaagggagtagaggagggacgggacacgggaagagaggaggagcttgcttggacagccggtggactggtgctggtatatagatagctactagaggtaggcgggcgggcggtcggccaatgctgtcaggcgcgtatggctaggagcatgggcggaaggggcgcgaacgttcacggcttccgtcgcttgttccaccgacggagcg

SEQ ID NO: 77886 - DNA, 419 bp, Zea mays
  Clone ID: LIB3079-010-Q1-K1-E9
tcgggttttgataggttcctaaagttgacatccatattttctgaagatcctgctataatgcaaggggttatgtctatggtgacggtcctcacactgaggtcaccagaaaatgcagcacgtgcaatggaagaaggctatgggacactggctatacagtcaatgcaaaggttcccctcctccgtgcagactcagaagcaagcatgccttatgattcgcaatcttgttgcccgaaaccctgagaataggatcgtcctgcttaatgatggtgcataaaagcttattagaaaggcaatggcgctgcacagaagctgtaaagatgctgcttcgtctgccttgagggacctgggcctcgacaactacaatgcatagacaccagtgaccagtcacaccatataaaatgtgcgtcgagttagtttggt

SEQ ID NO: 77887 - DNA, 376 bp, Zea mays
  Clone ID: LIB3079-010-Q1-K1-F12
agcttgtctatgtcaaaatacctgtatgaaatcgctgcggatttgtccaatattctggcggtgcattatctgaggaggccataaaggtgctaaatggaagccagttgggaggtcatagcataaggctctcatggggccgtagccctgcaaacaagcagcctcagcaagagcagagccaatggagcggtggtggctattatgggtatccccaaggatactatccatatggctatgctcggccccctcaagatcctgccatgtacgcctacgcagcatatccagggtatggaaattaccatcaacaggcaccacagcagcccccgccacaacagtaatgatgtcccgagagtgatcatttgcaagctggtcgcaaagt

SEQ ID NO: 77888 - DNA, 159 bp, Zea mays
  Clone ID: LIB3079-010-Q1-K1-F2
acagacgccaacaaagatacccttcgagaaagggttggcccaaaggtttatccagccctgtggatctggtgttgacttgggattcttttctcttgatgagctttcgagttcatcaggggaagtattcccacttgttgtttatgcagaagcatatccatc

SEQ ID NO: 77889 - DNA, 258 bp, Zea mays
  unsure at all n locations
  Clone ID: LIB3079-010-Q1-K1-F3
accaggcgtacgggaagcccagtcgccgaatgccatccacaatagcctcatatcgaatctgtnagcgtttctagactgccgaggaaaaaggatccgtgcgcggctgatctcactactataagtatatcgcattccgcgagttacaaggacaactgctcgatgtccttatgtttgctgcttggtaataccgatctgttcgctataatcatcgatcagcgtgatgtgaaccactgtttacattgctcgcgtactaataaa

SEQ ID NO: 77890 - DNA, 343 bp, Zea mays
  Clone ID: LIB3079-010-Q1-K1-F5
gcttcgatagctaatttcgccgtcacccgccggacagacacggaggtacaggagcgagggggaaagtgggatggtagtgggggcatcatcggtgtccggcgccgcggcttccggaggtacctctggtacggctccgccgcggaaggggaagtcgtgcaagggctgcctttactactcgtcagtgctcaagtcccgcggctacaacccaatctgcgttgggatcccccgttccatcccacaagttcctaactacgtggtggatgagcctaaagaggacgcgacagcgcatgggcatgatctcaggcggttcaagtacagggtgctcggttactccatattcgtg

SEQ ID NO: 77891 - DNA, 176 bp, Zea mays
  Clone ID: LIB3079-010-Q1-K1-F6
caacaaggcagcagcacaagcaagaaccacacctcctaccttcgcctgtgatcagggcagggttgctgcggcggcaagtgcgggtgcggctccagctgctcctgcggcagcggatgcaacggctgcggtatgtaccctgacgtggagaccgccgtcaccagcagcgtcaagaccac

SEQ ID NO: 77892 - DNA, 154 bp, Zea mays
  Clone ID: LIB3079-010-Q1-K1-F7
attacaaggatgggggcagagaacatgagggtgaagttgcctcatctcatccgtgctgggggcaatgctggactgattgtcacatggattactgatcctatgcatggaaacaccatcaaggccccttgtggcctgaagactcgtccatttgact

SEQ ID NO: 77893 - DNA, 285 bp, Zea mays
  Clone ID: LIB3079-010-Q1-K1-F8
gaagtcgccaagcacaacgtcaccaaggactgctggatcatcatcgtcggcaaggggtgtgatgtcactccttttatggatgagcatcctgctggagatgaggttttgctagctgtaactgggaaagatgctacagctgattttgaagatattggccacagtgattccgcacgggacatgatggataagtaccacatcgggcagatagatgcttcaacaatcccagcaaagcgaacttatgtgcaccctcaacaagcgcccaaccacttagacaagaataatgat

SEQ ID NO: 77894 - DNA, 478 bp, Zea mays
  Clone ID: LIB3079-010-Q1-K1-F9
cctactctcagcgaactagctagtttctgtccatttcaactcatactatctggcatgtgatactcatgcttcttattgtgcaactaacatacatactatctcattcagtccagtctattctgtctgcctatctccccagtcaatttcttccattcataccatactgacagtcattgaaccttctcctgcttaatttaccagcagcaaccaactactatccattcagctcagcttaagctggtgtgagcccctgcttaccttcttgacacataccactagttgttgctcgttctaccaagcacgctgcgcctaaacgctggcatccctcttaccaactgcatacaattgctgccattcataccaacttgcttttgacaaaacccagcaggcattctaaccaacatacccatcatttggtggttgcccttcttttaagatttcttaatgagttaatagttcaataattaaaggttttttg

SEQ ID NO: 77895 - DNA, 365 bp, Zea mays
  unsure at all n locations
  Clone ID: LIB3079-010-Q1-K1-G1
cccacgcgtccgggcaggacgtgctgcgcgtgggcgccgtgttcgcgtcgggcctcctcggcgccatccgcttcctccagctcaactgggagcagctggcggaggacatcgaggccggctcgctgaccccgcgcgtgaccgacccgtcggtgcgcgaggcggtcgccggcatcctccgccctgaccccgcggtcgccgagctggtccgctccgagtgctccgggggcgactgggcgggcatcgtcacccgcatttggcccaacaccaagtacctggacgtgatcgtcaccggcgccatggcgcagtacatnccgacgctcaagcactacagcggcgggcttccgatggcgtgcaccatgtacgcg

SEQ ID NO: 77896 - DNA, 209 bp, Zea mays
  Clone ID: LIB3079-010-Q1-K1-G10
actgggtggacaatttcattcactgcatcatggatcccgatgtagtacctgttcttctagccttttgtatcacctgattgacatcccgactagtctgcattctaccttggatatgcgattgtagaatggtagtcgttgtcgtcatttatagaaatgcttgtgcaatatgttttcctaaagactcacaaattaactgcatgttttggtcc

SEQ ID NO: 77897 - DNA, 266 bp, Zea mays
  Clone ID: LIB3079-010-Q1-K1-G11
tttgattattccgttcggtgtcgcatactttgccctctgatggcttataacaggaaagcagatcctgaaagtttacgttcctagctactagagctactgacgaatgtggccacacatgcacacgaggatcatcacggctctgatggtttaccagaccaccatgatccgcttcatgtccctgaataagttcgcctactccttcattctaatgcccctgcttacatccagcataatcttagcctacgtatgccacatgcacttttacc

SEQ ID NO: 77898 - DNA, 106 bp, Zea mays
  Clone ID: LIB3079-010-Q1-K1-G12
gccacgcgtccgctgtttggatcattatataacaacatcgcatatgtcttgtgtatgtaacattttttagtcgggaactgctaatgctcagttaagaagtggcgac

SEQ ID NO: 77899 - DNA, 54 bp, Zea mays
  Clone ID: LIB3079-010-Q1-K1-G3
taaaaaaaaaaaaaacaaaaaaaaactaaactttaacacaaaaatacaaataaa

SEQ ID NO: 77900 - DNA, 367 bp, Zea mays
  Clone ID: LIB3079-010-Q1-K1-G4
ccaacgcttccgcccacgcgtccgtccactcttcctcaggaaatggtggaccatttccaggaacagtggtgtctttcagcccatggataactactgttgctgctgtagttgatgaccgcatatacaagaatcatttaacactacgaaatggaaaacttctctctgggcttggagtatcacctgcaacacatgggaatatgtcgttcagcttgatttctgcagctgatgctctattgggttcatctgcaaccaatttcagtgcattagattgccagaagcctgaactattgaataacaggaaagttcacgggagaattctcatgcgttgctattccttcaattacatttctggacaacttcaataaaa

SEQ ID NO: 77901 - DNA, 369 bp, Zea mays
  Clone ID: LIB3079-010-Q1-K1-G5
cgctgtttgaggagaactgcctgcccctgctccctcttccgctcttcccgggccgcgctgtgcatcccccagacttcatttaaggccgggatggacgactacgcccgggagatgatggagctcaagacgctcgtaacccgaaccttcaaaaggaagggcgtcctcgccataattagggctgagctaagagcaagcgtgttagaagccattgaagaggaggactcgttggagaatgatgatggagggaaccctgctgtgcttgatagctgaaatgaccgatctaagcaactgaatgctacaccttcaggtaggttactaactgcacttgtatgcgaatactttgagtgggcgcaactaagtcacacaatg

SEQ ID NO: 77902 - DNA, 432 bp, Zea mays
  unsure at all n locations
  Clone ID: LIB3079-010-Q1-K1-G6
gtgcgtgctgggtataaatattggacaagtaagaggtccaagagagctgcaccagtgctgagggtatttcagggtgcacccataaggcgagggcatttatcacanaagtctgccatgaagcgaaagagatctttcaagagacannaaagccaagctggtcgtggaaagcctgaagctttattgcaatacaatgctgaagaggacgcagctttgcacagagttgcccaagctgaacgtgcggcaaaacaggctgtagaaagagctattcgactgcgcaacagagcccagtctctcatgacaaacgcagagctcgcagcatacaaatccgtcatggctctcaagattgccgaggctgctaagatatctgactcgtcccgagatattgtttgtactatcctcgactaaagaaaaatatgggttgttcattgattt

SEQ ID NO: 77903 - DNA, 270 bp, Zea mays
  Clone ID: LIB3079-010-Q1-K1-E7
agcatcccgccttggacttggacgggatcagcacgtcggtcggggaagcaagtgtccaggggatccatccgcgaccgcgagtaggaacagtaactgacggcggcaagggagtagaggagggacgggacacgggaagagaggaggagcttgcttggacagccggtggactggtgctggtatatagatagctactagaggtaggcgggcgggcgggcggccaatgctgtcaggcgcgtagggctaggagcatgggcggagggggcgcgatcg

SEQ ID NO: 77904 - DNA, 197 bp, Zea mays
  Clone ID: LIB3079-010-Q1-K1-G7
ccagtccttacataatcatcttgattcactcactctcttcgatcactgtactgaagatacggtggccaagtcgaccgatatgtttgtagccggcatggctctggtggtggtgatatcgaccacaagcacatgctgtggcacagcgtcagcaagatgcgatcccaaaccgctagtcgtgtgcgatccagagttcatgg

SEQ ID NO: 77905 - DNA, 314 bp, Zea mays
  Clone ID: LIB3079-010-Q1-K1-G8
ccaagattgacgatgatatgaaggttcgagcagcggaatataataatgtaaggagccaggttagtgcaatcaacagaaagcatagtgggagcttatcggttcgtgatctttccaatctgataaaaccggaggatatgatcacctcggaacatcttgtgacacttcttgcaatcgttcccaaggactcccaaaaagactggctatcaagctatgagacacttgatacatttgtggtacctacgtcatctaataagctctatgaataccacgaatatgctatctacactgatacactatttgcctaagttgttgac

SEQ ID NO: 77906 - DNA, 317 bp, Zea mays
  Clone ID: LIB3079-010-Q1-K1-H11
ctctcgcatgttgtgccaagaaatggtatattagttaaactagtagatacaactaaagttagtgatgtggtgtctgcaattggaccctccactagactgttcagtctacaaagtcccacgaaccctcgtaagcaaattactgacattaatacaatctcagagacagcgcattctcatggtgctcttgatttggctgacaacatcatcatgtatacagtgctctcccgtcctatataactgggaactgatatcgtaactcactccgctaccaaatttatagccggacatatagatcttattgctggaattattgcagt

SEQ ID NO: 77907 - DNA, 76 bp, Zea mays
  Clone ID: LIB3079-010-Q1-K1-H3
aaaaaaaaaaaaaaaaaaaaaaaaaaaaattttaaaaaaaaaaaaaaaaaaaaaaaaaaaaagaaaatatttaaaa

SEQ ID NO: 77908 - DNA, 159 bp, Zea mays
  Clone ID: LIB3079-010-Q1-K1-C5
ctctagacaccctaaacaacatactatactctctcaccaccataacttatccattggctagtcttcactttacctttctcatcactcattacaaattctacccttactatacaacccataccattacaatatttaaaaccatacttataacataacaca

SEQ ID NO: 77909 - DNA, 427 bp, Zea mays
  unsure at all n locations
  Clone ID: LIB3079-010-Q1-K1-C7
cgggtctccgtcacccccaccgacaaccccgtcaagccgtggtacctctgcacgatcccggcctcggtgggctcccgctccgtggtacccacctccagcagcagcccgtcgctggtcggcgcgtccccgctctccgcgcgctccttctccttcgcctcgcccgccgcgctgcgctcgacgccgttcccgcgcggcgggggcgcccccccgacgccttcctccgccgtcacgggccacaagatcccgccgccgccgcagttcccgcggacgccgcggccgtcgttcctgcagtcgccgtcgacgctgttcgcgttccggaaggacgggcagcagaccagccgcgtggagcgcgagcgcgggtccttccttccgtacctncgcttctaccgncgnccctacgacgagatttcctaccgcgccatgatgc

SEQ ID NO: 77910 - DNA, 102 bp, Zea mays
  Clone ID: LIB3079-010-Q1-K1-C8
aaaaaaaaaaaaaaaaaaaaaaaaaaaaaattaaaaaaaaaaaaaaaaaaaaaaaaaaaaaagtataattaaaaaaaaaagtacggccaatctaaaagttcc

SEQ ID NO: 77911 - DNA, 411 bp, Zea mays
  unsure at all n locations
  Clone ID: LIB3079-010-Q1-K1-C9
gcttggacagggtgacaacagtgtgaagcccgctaaagagagtggttgcaaaaatcgctacgccgacccccacctaaggcaccgactcgccggggacagagagagaccgacgcgccggcagatcccaagctcaccggagagggggaagagggcgaccgaaggcggcgatgggtttcatcatggacttcgcggagaatatgatcctccgtctgatggaggacccggacaagcgcgaccaggttcggcgggagcatgtctacaagatgaaggagcggtgcgagcgcactaaggcggcgtggagcctncctctgcgcccctacggcttctggaccttcgaccgcttcaactcgcagctctcctgggatccccagatcagccaggccggcggccgtccggacccctacgatgacc

SEQ ID NO: 77912 - DNA, 134 bp, Zea mays
  Clone ID: LIB3079-010-Q1-K1-D1
ctagttctagatcgcgatctagaactccattccttgtcgcccgtgtgcattctgatccatctaaggatcgaatgctagtccaacatcaacctaccattgccgtcgataatgagatgacttgtgctttctgttat

SEQ ID NO: 77913 - DNA, 330 bp, Zea mays
  Clone ID: LIB3079-010-Q1-K1-D10
cggatagagctaccgggagcagatcacggtgctagccacaatcaacaagtatcatcaaaggtcgcatcttctcactactcaaactatccggagcagcaggtcaaatgagtctaagcttccatagtgtctgccttgtttgtccagcatatacatgggtagttcatctccgctcccattcaggacgtctagacttaaaaatggtttgagatttgattgttcggacggagccagcttgctgtgtctcgctctagtcacctgacatttgatatataaatagcttctgcctatgagatgccatactacgcttctgacgtgctgtacatttctata

SEQ ID NO: 77914 - DNA, 411 bp, Zea mays
  Clone ID: LIB3079-010-Q1-K1-D11
tcccgacgcgacgcacgcgtccgctaaacgctcccgttctcctccgcctgcccttaccgggtccccttgacactatcgggcggtcgccatggcagccgggcagccgaagccgaccactaggctgggcggcatcaccgaagcgctcgccatcgccgtcgacctcggattccccgcctctaccacgcaggaagatcagactaactacgacaaaaccgatgatttggtgaaggttttgacggaactgactgtcctgcacatgaacattgccaacttgcaagtggagctacacggaagaaaggatgataaaaacatcgctcatttgactcatgtgagtgagatggaaaagaagtgcgagtatttggccagaatgactgcaattttgcaagatatcattcagaacaaggatcggat

SEQ ID NO: 77915 - DNA, 70 bp, Zea mays
  Clone ID: LIB3079-010-Q1-K1-D3
aaaaaaaaaaaaaaaaaaaaaaaaaaaaaattaaaaaaaaaaaaaaaaaaaaaaaaaaaagggcatgggt

SEQ ID NO: 77916 - DNA, 203 bp, Zea mays
  Clone ID: LIB3079-010-Q1-K1-D4
acgccttcctctaccttgccctctatccaaggggaaccgtttctctccccctcgatcctggtctgcccaacatcaattcccatgactggtgttggtcagccagcgtccacgccttcgtttcccactcccatggccaccaccacggtgctccccttcccggcgtcgaccaggcacaagtccggtgatggagccctcacggggaa

SEQ ID NO: 77917 - DNA, 363 bp, Zea mays
  Clone ID: LIB3079-010-Q1-K1-D5
cccacgcgtgcggtgatgctcgctagcactatctcatcattcaattctgacttcagaacggggtaggctttccctgatacacagactcatgcccgaccaaatgtcgatcattgaactaactgaatccaaaacataaccatgatcacaacatcaggtgctttcccctacacgttgagttttgttactgatagtttcacaacatcgacagcaccaactaatgctgctacacacatcaacagtgctgcccaaggtagctcatctcagatatttaattctggtgtggccaagaacgtagagcaaccatctggatggtctggttattaactgcacatcgacatgcgttaaccatcattctggtcaaaa

SEQ ID NO: 77918 - DNA, 250 bp, Zea mays
  Clone ID: LIB3079-010-Q1-K1-D6
aggaaactcctgaccacgcacatgctcagtaccaagaaggtgcagtccttccgccatgggcgacaggaagaggtgcagctcgtcatggacaagatccgcgcggctgccaccggcactccgtcggctcgctgtcgtcctgatcgatctactgtccgggtacaccaacgacgtggtgtgccgcgcggctcttagcgcgtcacaccggaaccaacgcctgaacactctgttcagctagctgacagatatcaac

SEQ ID NO: 77919 - DNA, 411 bp, Zea mays
  unsure at all n locations
  Clone ID: LIB3079-010-Q1-K1-D7
gtcggcgtcgggccccgcgaccacaacgacgaccacgacgacggccacgacagcgtcgggggtgagcacgagccggtcggacgactcgggcgcggcgcggccggcgagcaagtcggcggggtcggccggctcgtcgtcgcagtcgcaccggagcatctcctcgctgtacgaggagcggggccacggccagctgcgggtgttcggctacgaggagctccagggcgccacggccgacttcagccgcgcgcagaagctcggcgagggcggcttcggcagcgtctacaagggcttcatccgcggcgccgacggcaagggggaccgcgttcccgtcgccgtcaagaagctcaaccagcgcggtatgcanggacattaagcatggttggcggangtacagtttcttggtgttctgga

SEQ ID NO: 77920 - DNA, 363 bp, Zea mays
  unsure at all n locations
  Clone ID: LIB3079-010-Q1-K1-D8
cccttctctctcgatttctcgcggagcggccctccacctttatcgccgccgccggcgttggtgtgttccgtctcttcgccgatggcttcggccaagttcggtgctgcccagcaggtggagaaccgaggcgcgctgtccaaaaggtcacgtaacgacgtgtctgtaagggagggggactggaattgtcctcagtgtggtaatgtcaacttcagttttagaaatgtttgcaaccgtggagcctgtggtgcaccccgtccatcaccgagtccaagtccaagaatgatgtcaggacctcctgcttctggatatgaccggtcacctctattttacggaggaggntgtggcgccccacctccaattccg

SEQ ID NO: 77921 - DNA, 388 bp, Zea mays
  Clone ID: LIB3079-010-Q1-K1-D9
tcccggggggagccactcgtcctccctgagtctgtggggagttatgttgaggtacacatggagcaaggccctgtcctgtgagcgcttcattatccacttggtgttgtaaaaggaattgcaggacagacacgattgaaggtaatagtagatggttcgcaagggcatgctggcacagttccaatgaaattgcgccgtgatccgatggttgcagctgcagagctcgttgtgactctggaacgcctctgtaaagagcccaacagtttgctgacctactacgaggagtgcagctgcttcactgaggagtccctggccggcctggtgtgcaccgtctgctagctgaacacgtggccaagcgcgagcaacgtgattccgggccaagtaaacttca

SEQ ID NO: 77922 - DNA, 310 bp, Zea mays
  Clone ID: LIB3079-010-Q1-K1-E10
tccctactctacgccactcgtccttcttcggatcccacaccgatgaaaggataatatatcgagggtcagaataatttctgggtagttattttccataatctcgtgccacaccaacgactatttctactccctcatggccaatgccaatgaccacgtcaagctactcgtcatctacttcatagccccctgttgcagttggtgccaaatgatcgcccccgtgtactcatactgctccagcaagtacccttccgcagtctttctagaagtctacattctactaactgctggaactctcgaacatctacttctt

SEQ ID NO: 77923 - DNA, 313 bp, Zea mays
  Clone ID: LIB3079-010-Q1-K1-E12
ttccctactctacgccactctttctaaaaaaaaaaaaaaaaaaaaaaaaaaaaaaattaaaaaaaaaaaaaaaaaaaaaaaaagaaagaaaaaaaaaaaaaaaaaaaagtaaaaaaaaaaaaaaaaaaaaaaaaaaaaaaaaaactaattaacaaacaaaaataataaataaaacctaataaaaaaaaaaccctttaatcacaaaattttacatttctctaaaataaaaaactacttacacaaaactatcattttccatattattaattaactcccctaaatcataattcaaactatcaaaaatctcctttta

SEQ ID NO: 77924 - DNA, 425 bp, Zea mays
  Clone ID: LIB3079-010-Q1-K1-C4
cttcgccttcgtggaccccaccagggccacctacctaagctaccacaagcggttcctgaggctggtgaggcccggcggcctcatcggctacgacaacacgctgtggaacggctccgtcgtgctccccgacgacgcgcccatgcgcaagtacatccgcttctaccgcgacttcgtcctcgccctcaacagcgcgctcgccgccgacgaccgcgtcgagatctgccagctccccgtcggcgacggcgtcacgctctgccgccgcgtcaagtgaaaaaaagaagaagaagaaaaaaaacataataccctgcgttcctgcttgcccggctgtctggcccccactactgccaccgacggcggcgccgaacccccgttccaatcatcatatcgtagacgacgcgcagcattaaactatcaatcaccggatc

SEQ ID NO: 77925 - DNA, 120 bp, Zea mays
  Clone ID: LIB3079-010-Q1-K1-E2
acgcctaactatagtatcaagtatgacccagattgacaataatctaccacggccttcaaaaacgttggagattattaatggtactgctgtaagcctgttaacaaagttaatgcgtatgac

SEQ ID NO: 77926 - DNA, 259 bp, Zea mays
  Clone ID: LIB3079-010-Q1-K1-E3
gagattcatgacgctcacttgttagagcattgcgattaaccgagtatcccggatctaccggcaactgcatatctttgaagcatcacacagtgccctgtggatacggaagatccagctcccggtccttccgaggccaatgtcgccacgatcagcagcatattgctcatactagcagctatacgctgtgaccctgacaaaccgagcttcatctcagccttatgacgacgtctactctaactaactggtgacctgagatccc

SEQ ID NO: 77927 - DNA, 383 bp, Zea mays
  Clone ID: LIB3079-010-Q1-K1-E4
ctgatatcagttctgagtttctcaccggatggagagggtctggttgccttctctgagaagagattgatgataagatggtggtccttaagtagtgcctggtgggagaggctgatcataagccttactcctattcaatgcacaaagcttatctatgttcctccatgggaaggattttcacctaactctgctcgcttgagtataatttctagcattttagatgataaacctggaatgtcagacaaggaactaggcgaggcggataatatgaagttattgcttcataatcttgacctttcataccgtcttcactggattggtggaaagactatcacacttactaagcatggccaggatttgggtacatttcaactgtgattggctta

SEQ ID NO: 77928 - DNA, 415 bp, Zea mays
  Clone ID: LIB3079-010-Q1-K1-E5
cccacgcgtccggccacgcgtccagaacttctaaagcagagtctgatggtatgaagaaggggatgaaaataccgaaagtcgaacctgatgttatggactggaaaactcccaaagcatgatctgatgttacgaagaacggcttgagatctccaaaggcagaatgttgccagcctgtgattgagagcgttaaactaaagctggcagagattttgaatactatatcaactcaagatgactgcaaaatgttgcaacaccaacttgatacccagaggaaaagagctagatataacaagatgattcgccggcatattgacttccgaatgcttcactctaagatcaagagtggcgcaatctcttgcaccaacgagcttttgagagatatacttattttcatcaataatgtaataaccttcta

SEQ ID NO: 77929 - DNA, 275 bp, Zea mays
  Clone ID: LIB3079-010-Q1-K1-A7
ggtgggtgatggaccatgggatgcgatgcagcattttgatgactgtatccctgaaagaggttttgacaattttcagtttgtgaacttcactggtattatgtcaacaagtaaggatatgtcaaagaaggaggctgcatttgcccttgcagctcttatggaaataccttctcagtataaagcaacgcaaggccttcgacctccagaaaagcaagcacaaaggattggctctcctaggattcttcctcctccaaataaagttcttgaaaatgataatg

SEQ ID NO: 77930 - DNA, 218 bp, Zea mays
  Clone ID: LIB3079-010-Q1-K1-A8
gcagcatgatgaaacatattatggaacaaaatatatacctacggcagcacgcagcatgaggaaacatatttaaaaaatttgggtgctctaccacatgcccgtggaataaaacggatgtaaactcagtgcaaaaaaaaaaaaaaataaaaaataaaataaaaaaacaaaaaaaaaaataaaacaacacaaagaaaaaaaaactacaaaaaagcaagcac

SEQ ID NO: 77931 - DNA, 379 bp, Zea mays
  Clone ID: LIB3079-010-Q1-K1-A9
ggttcgttttggtgccgcagctgtttaagatggaggatgtgagcatgggcatgtgggtggagaagttcaacaggacgcggcgggcggtggagatccggcacgacgtgcggttctaccagtcgggctgctacaacggctacttcacggcgcactaccagtccccgcagcacatgatctgcctgtggcggaagctgcagtccgggagtgcccggtgctgcaacgtcagatgacgcattgcgagagagagcctgattttgtactctttcttgatcaaagaggagagaaacagatggtggtggacgacgggtcggcagcccgtaagcgcagctcttctgcgatggacacagctgacgacgacccgttacgacggtgggtttgc

SEQ ID NO: 77932 - DNA, 357 bp, Zea mays
  Clone ID: LIB3079-010-Q1-K1-B1
ctgagcttctgcctattctagctgctggggcaacacctttggtcaaagtaaagcagatatgccaagaaattgactccaaaatcatgacgatagtcaatgcttcgacccttacgactccattcgcttcattttcattcagcgcaaccgcctctttcgaggttcaaagcccatcaaggatagaggtccaatttaaggaggggagctttcagcctccgacaatatcatcatccgtggatctacctcaacaagttgatatatttgggcagaagatcagcctggggccagtccagcaggcactgaatccattgcagcaagcatttgctagcattgctgggtccattttctggcagccacccc

SEQ ID NO: 77933 - DNA, 387 bp, Zea mays
  Clone ID: LIB3079-010-Q1-K1-B10
gcggagagaggactgaaagcttaatactgatcaactccaacaacgaggctattattgggcagggaacattcggatctgatgacaaccaggaggactcaagcaacacaagttctggtgtatcacttggggattactttcttggtcctgccttagacactctcttgcagcgtttggcggagagtgacctcagtcgttctggcacaccgcctgccaagaaggaagcagtcgccgcgctaccaaccgtgaacatcgaggaagcgttgggctgttcagtctgtcttgaggatttcgagatgggaggagaagcgaagcagatgccctgtcagcataagttccactcgcactgcatactcccgtggctggagctccacagctcttgcccaatct

SEQ ID NO: 77934 - DNA, 355 bp, Zea mays
  Clone ID: LIB3079-010-Q1-K1-B12
tcgattaaagctcattcaatcctcccggaattatctctaaccaaacaaggccttatgtgagaaagtgattcaaaataaccaggactattagtggcttcgtgatataccaatatgtgacaaaatagttgatgacacgagcatctaaatggaactcaatttcatgtgttgactctttgtttacagtcatcgagaggatggtgacaatggcaagcctgatatcaagttggttggtgagcagcacgccagtggtcgacggggggttgttccatcataatcatattacagctgctgcaactgacaagcccaatgcatcttctcttccatgttggatcaacactcttgtaatgtattattt

SEQ ID NO: 77935 - DNA, 312 bp, Zea mays
  unsure at all n locations
  Clone ID: LIB3079-010-Q1-K1-B3
ccaccggggaaccctacccgagcatcagccatggcgatcgcggcgcgcgtcctgcgccggctcccgctccacctctacccctcgctcgctcgctctttctgcgcagtttccccggccgacgcctcggccgccccggcgtccgcctcggccgccccggcgtccgccaaggtcgccgatcgcatcgtgcgcgtactcgccatcgatctcgagggggcgcgccgcgaggtcgtcggcctctccgggcagacactcctccgtgcgctcgccaacgcggagctcatcgagccggcctcccaccgnctcgaggatatc

SEQ ID NO: 77936 - DNA, 218 bp, Zea mays
  unsure at all n locations
  Clone ID: LIB3079-010-Q1-K1-B4
ccaacgcgtacggttctcctaacttggggcaaggagggaggttggattacagtgcactgagtancgatctaaatgtgactcctgctgggtcgctcgtggtagaatgtattgcgcgaagtcgtctactgcgatcaagaggtactctcggcctgtccagcgtacgtcatggatgccgatcgcatcatgcgcgtactcgccatcgatctcgagggggcgcg

SEQ ID NO: 77937 - DNA, 412 bp, Zea mays
  Clone ID: LIB3079-010-Q1-K1-B5
accacgcgtacgctcaacctagcattactgtgtgtgagaaagatcgacagcgccggtcaaggaatagagcgggttctctgcctcgtgtcattcctatgtactgtggtctgcggaggcctaagttgcagcgcgctgagatagagttcacatctaaatagacggcttcgattgcccttctatgcctcaagctctactgactccttatgcttcttattattccactgtcttactctgctgcgcctctgtccataaacctgtcgctgactaggaaccttctgcagcccgcggatgaccctgctccagaggttccagatcccgaccagcaaggtgcggatgctgatgctggtacggtgggagctctagaccatggcagttaggtagcgagtaggatggacatcgatgtcaacgacta

SEQ ID NO: 77938 - DNA, 349 bp, Zea mays
  Clone ID: LIB3079-010-Q1-K1-B6
tccaagcgcccacactacatggtctgcttgtttttgacaaacatctaaatcgccggatagggtatcgaccctcatggatgcatagtgtctttcctatatcctgtggtctagaagacgcctaagctgcagcgcgctgtgatagagttcacatctaacaagacggcttcacttgcccttctatgcctcaagctctactgcctccttctgcttcttattattccactgtcttactctgctacgcctctgaacagaagcctgtcgctgactaggaaccttctgcagcccgcggatgaccctgctccagaggttcccgctcccgaccagcaaggtgccgatgctaatactggta

SEQ ID NO: 77939 - DNA, 405 bp, Zea mays
  Clone ID: LIB3079-010-Q1-K1-B7
ctttcaataggcgtcccccaagaactagtaaacatggcaaaactgttgagcctggtcttggccctctcctttgtagcagctatgtttgccataggctctcatgctgatggagactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcgcaagaaggaagcgcttgacgtagtcttt

SEQ ID NO: 77940 - DNA, 373 bp, Zea mays
  Clone ID: LIB3079-010-Q1-K1-B8
gtgaccaccagcgtggactactccctggctcagctgatccaggtgatcatcctgggcgcggccggctgcaagaacggcggcggctacctggcgtccaagtacatggtgatcggcttccacgccgtcatcctgctcagccacgccgtcatcaacagcctccccatcaccttcctctactttttcggccagttcgccgaggcctggaacatgctaagtgtgtttgtcctgatggttgccgtgccgaccgttgccaccgagagggccagccccgagttcgtgttcacccacttcaacaccgacaacggcgccggctttcgcagcaacttgtacatctttgtccttgggcctgctcatgagccagtacacgctcaca

SEQ ID NO: 77941 - DNA, 436 bp, Zea mays
  Clone ID: LIB3079-010-Q1-K1-B9
gggcgaaggagtctctggagctggctttccagatgtcccagatcctagacaccggcgtcgagcgccacaccctgtcgctgctcatggcgctttgcgaccgcggagccaaccccgaggcattggccgccctcgtccgcgagctctcctctgctgctcccccaacctccgccgcggcttcctcccccgtgagcaacggcgccgcggggccggcctcggcaattgcgcccacgttctcctccggccttcgccgtccctagggtgctgctaaaaagtctgaatggaactggtgtagttttccaagcaagacaagatctcgctgctggaatcgctggatgaaaaggattgcctttacaattccatgtgcgcgctgctgtggtggtgtggttcgaccacaaaacatgtggctgggttcatagagccacagaaatacacgcgc

SEQ ID NO: 77942 - DNA, 434 bp, Zea mays
  unsure at all n locations
  Clone ID: LIB3079-010-Q1-K1-C1
ccctaagcaaaggttacctctttcctacgaatgctgcaagactcccaggattttatgtatgtgtgggaagtggtggagagaagctattgcctgagtggtactcagagaaaggcattgagctgatccttagtacagaaattgtcaaagctgatctttccaccaagactctgactagtgcagctggagcaaactttacatatgagatcttgctcattgctactggctcctcggtcataaagctcaccgattntggcacacaaggagctgattctaacaacattctatatctaagggaaattgatgatgctgacaaagctgttgcagctatccaggcaaagaaaggtggcaaggcaatggttgttggaggaggttatatcggccttgaactgagtgcagccctgaagatcaatgactttgatgtcactatggtgttt

SEQ ID NO: 77943 - DNA, 399 bp, Zea mays
  Clone ID: LIB3079-010-Q1-K1-C10
ctgtctctctctttctcgcgctcgctttgcttcctcgtcgaggtccaagttcctgcggtgatggcgaccgaggtggctgagactcccgcgccgttggcggaggcggtccccgagacccccgcggaggcaccggcggcgcccgccgccgaggcgaagcctaccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgacggctgcaagctcaccaaggtgaagaac

SEQ ID NO: 77944 - DNA, 390 bp, Zea mays
  Clone ID: LIB3079-010-Q1-K1-C12
ctgactcgttcttccacgcgttcgctcacgcttccggatccctgccggtgctgtggccatggcctaaaacttccaactgcagagcctgcacggcaagtcccgcgtacgcgtctacaccgtctggcgccgcccggccgcggccgtgggctacgctatcgctaactggaacgtcaacgacagtatcgtctacgactggctaacctgatacacctacagcgacaactacatgcaatttcaccacagattccatcatcaacaccgtgcatgtcaacagccaaagagtgcacggaagtggtgtccatggctgaattcgccacgattcttggaaggcatttcaccatcttgtaccctgacgtctcagaagccacggtgactatcgcagagcgccca

SEQ ID NO: 77945 - DNA, 268 bp, Zea mays
  Clone ID: LIB3079-010-Q1-K1-C2
gaggaatcctacttggttacaacatccctcccaaccaactctgactctaaatgaattggatgcacgcagttctattctgttttatatctaactcaaatcatagttggtttctaatatagcctaagagaatcctggacaactaagaccgtagcctatgtataacatattctaacaaaagctgcctggcctaagcagctgagattgtgctgcctggccagggcaaccaagctgcctggcctagttgtaacatattctaacaacgtttact

SEQ ID NO: 77946 - DNA, 93 bp, Zea mays
  Clone ID: LIB3079-010-Q1-K1-C3
aaaaaaaaatacttaattaaaaaaaaaattttaaataaaatataaatataaaaaaaataaagaaaaagtgaaaatattaaaataaaatataaa

SEQ ID NO: 77947 - DNA, 287 bp, Zea mays
  Clone ID: LIB3079-010-Q1-K1-A6
ctggtgaggccgtcaagtacaacagctccttggacgctttcaagcatattgtcgcaaaggggggtaccaagtccctcttcaagggtgctggcgcaaacatcctccgcgctgtagctggtgctggtgtccttgctgggtacgacaagctccaggtggttgacttcggcaagaagtacgggtctggtggtggctaaggatgtataatgatgatgacaacgaacaacaaacatgatgttttaggtgcctcctttaagtaaacatacttacggaccttttacaccatttta

SEQ ID NO: 77948 - DNA, 304 bp, Zea mays
  Clone ID: LIB3079-012-Q1-K1-F9
acgcccacgcgtccgccaggtcatgtcatacctgacggctttcctgacgttcgatggggctctgaacgttgatgtgaacgagttccagaccatcctggtgccctaccggaggatccacttcatgctttcgtactacgctccactcatttctgctgagaaggcctagcacgagcagctgtccgtggctgaaatcacctacagcgccttcgagccattctacatgatggccaagtgctacccccgccatggcaaggacatggcatgcttgctcatgtaccgatgcgatgtggctcccaaggacgtg

SEQ ID NO: 77949 - DNA, 76 bp, Zea mays
  Clone ID: LIB3079-012-Q1-K1-G1
tcgcccacgcgtccggttccccgagtacctaatgtgatatcaagactcaattctcgaatggaagatatatgtttgc

SEQ ID NO: 77950 - DNA, 294 bp, Zea mays
  Clone ID: LIB3079-012-Q1-K1-G11
cccagatccatcgactcgctcgggccgcccctcccgtcgtccccgttcgaaggtgcggcagccggcaggcgagcgatttgattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcaaatttgggatactgctgggcaagagcgc

SEQ ID NO: 77951 - DNA, 356 bp, Zea mays
  Clone ID: LIB3079-012-Q1-K1-G3
ctcattatcagccaactcctactattggatgcagaggaccagactaaagatattaagttgtttatcaactcacctggaggctctataacagcagggatgggagtatatgatgctatgaaattttgcaaagctgatgtgtcaactgtttgctttggattggcggcttcaatgggtgcatttttacttgctgctgggacaaagggtaagaggtactgcatgccaaatgcgaggattatgatccatcagccatcaggtggcgctggcgggaaagtcacagagatgggactacagataagagagatgatgtacgaaaagattaagatcaataaaataatgtcgagaattactggaaaatc

SEQ ID NO: 77952 - DNA, 388 bp, Zea mays
  Clone ID: LIB3079-012-Q1-K1-G4
cccacgcgtccgaacattctcatcaagcttatggcggttgaatcccttgtcttcggccccgtcttcgccgcccatggtggcattatcttcaaatggctctaaagatagcgacaacgttagttagtcgcaagagaaaggccgcagttctgcggctgcgaggggaatagagcagtatgtcagctatacaacatctatggcatgtgctttgctcctccacttgattatagcccccgttgtgtgtttcggtttctgttttcctggagtttttggttccaggcttccgaccatgttttgatcccataaattcttcttcagccttcgagcaactgaatccatcttcgtaagtcatcaaccctagccagacattgaaacatcgggaaactttaag

SEQ ID NO: 77953 - DNA, 352 bp, Zea mays
  Clone ID: LIB3079-012-Q1-K1-G5
tcggtttcctgatggattaccaacagcttcatcaagaaagcaaaaggagaagctcgcagatatggaggtacaagccaaaaaggcagaagctgcgctgaggcgcaagatgcaagttgagaaggcagagaaagaacagcaggctgaagcgatgaggaagatactgggaatagattctgagaagaaaaaggaagagaagaagctgaaagaacgagaagagagggaaaaacaggcaagattagaagaatacatgaaaaactgcgtccagactgtcatgggcccaactgggactgtgattacattccctgagagcatggggctttcgagtatatttaactccaaacctgtcaactat

SEQ ID NO: 77954 - DNA, 370 bp, Zea mays
  Clone ID: LIB3079-012-Q1-K1-G7
ctgcatggcggctggagggtaggtgggaggagagaggaaattggaaaagaaagcctagctctatagtatgtgggaaaccctaacttagggttgggagttgcattaatagaccaagtgatgttggacctggcccattacacatgggtatgaatgtaattacaaggggctaaccccaaaaccctaaatgggattctaacaaagttgttttttccgttggtgttaatcatataagtattagcatttcagttgaattttctactctcaattatattgaatgaactgttttacaattctagtatgttaattattcctgggttgatgctttgagcagattgccttgcacatatatagagtcttctctatgtttttt

SEQ ID NO: 77955 - DNA, 215 bp, Zea mays
  Clone ID: LIB3079-012-Q1-K1-G8
acaaaacgaacatactaaacaagtcttatggcaggaagaatccattgacttcggcgcgatattctccgcccatggtggcgcttatcttcaaatggctataaagatagcgacaacgttagattatcgcaagataaccgccgtattactgcggctgctatgggaataccccgacatgacagctatacaacatctatggcatgagctccgctcctcca

SEQ ID NO: 77956 - DNA, 209 bp, Zea mays
  Clone ID: LIB3079-012-Q1-K1-G9
gaaggaaggtgttccggatggtctctacatgtagccaatctattcatcatgccgaacaagttacccgattgtgtgtgtactagcacatctcttcatcatgggagatatgttaccacaatacttgttgcatactgtgctaagtggtcaggagaaccttgtattaattaattatcctttcattgtctcaaagtaaaaatttcccttgcgct

SEQ ID NO: 77957 - DNA, 239 bp, Zea mays
  Clone ID: LIB3079-012-Q1-K1-H10
gaaaaaaaaaaaaaaaaaaaaaataagaaataaaaaaaaaaaaaaaaaaaaaaagggaaaagggcaaccggcgtacgggatccaggatcccatcctccttcctcctacatgctacctcttatatattgtatcctgaaaccaatttacagtccactggccgacatcttacaacactggtaactccctaaacctctcccatctccaatcttattcgcctcataccacatttccccttttgc

SEQ ID NO: 77958 - DNA, 322 bp, Zea mays
  Clone ID: LIB3079-012-Q1-K1-H11
gtctggcggagttgcaaatgttactgtggagaatgtgcgcatctgggaatcaaggagaggtgtgaggataaagactgccacaggaagaggcggctacatccgtaacatctcataccgcaacataactttcgacaatgtccgtgctgggattgtgataaaggttgactacaacgagcacgctgatgatggatacgaccggactgccttcccagacatcacaagcatatcattcaagggaatccatgggcagggtgttcgggtgcctgtccgagctcatggcagcgacgtcattcccatcaaggacatcagctttcaagacatg

SEQ ID NO: 77959 - DNA, 359 bp, Zea mays
  Clone ID: LIB3079-012-Q1-K1-H12
cggacgcgtgggattccaaggactctatgttaagacaatgacccaatggatgtgttggtgctgatgcatgagcctgttgttcctggttcgttcctgagagctagagcaattggccttatgcccatgattgaccagggtgaaaaggatgacaagataatagcagtatgtgctgatgatcctgaataccgtcactacaacgacatcagcgagctgtctcctcaccgtctgcaagagatcaagcgcttctctgaagattacaagaaaaacgagaacaaagaagtcgcagttgatgcattcttgcccgcgacaacagctcaagaagccattcagtactccatggacctgtatgcccagtatat

SEQ ID NO: 77960 - DNA, 226 bp, Zea mays
  Clone ID: LIB3079-012-Q1-K1-H2
gctaaccccgcaaccctcttacaactacaacaattgttgccctttgtccaacttgcgttgacagacccagcggcctgctaccaacaacacatcattggtggtgccctcttttagattgcttattagttgtaattcaataataaagttttttggatgatgtatgtggccaaccagaaataagaagttacatttccaaaaaaaaaactaagatatacaacttatgaat

SEQ ID NO: 77961 - DNA, 197 bp, Zea mays
  Clone ID: LIB3079-012-Q1-K1-H3
tgaatgaaaacggttaatggataaaaaaaaaaaaaaaaaaaaaaaaaaaaaaaaaaggaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaagaaaacctttattaaactgaaattaat

SEQ ID NO: 77962 - DNA, 171 bp, Zea mays
  Clone ID: LIB3079-012-Q1-K1-H5
tcgggatgtgcaaacactagcttagatgctgctctttctagcatgagaacctgagctgtgaggtgtgtggtacaggattttcctccgtcgcttcttctatctccattcttacttggcttgctgagttgcccggcgagcctgacgaatcgatctgagcagcaccttgctgtt

SEQ ID NO: 77963 - DNA, 353 bp, Zea mays
  Clone ID: LIB3079-012-Q1-K1-H6
ggcctcccgtagaccgagcaaggcaacccaccactgagaggcacgcagaggagcaggaagccggagaccaagatgtcgtcggtgttcagcggcgatgagacggcccccttcttcggtttcctcggcgccgccgccgccctcgtcttctcatgcatgggcgcagcgtacgggaccgcgaagagcggcgtcggcgtggcgtcgatgggtgtgatgcggccggagctcgtcatgaagtccatcgtgcccgtggtcatggctggtgtgctcggtatctacgggctcatcatcgccgtcatcatcagcactgggatcaaccccaaggccaagccctactacctttttgatggctacgc

SEQ ID NO: 77964 - DNA, 337 bp, Zea mays
  unsure at all n locations
  Clone ID: LIB3079-012-Q1-K1-F8
ctcttgcgtccgnccacgcgtncgcgcagccctgttccaatcgctgctgtccaaggcggcggggcgggccatcaacccggtgcacggcgcggtggggctgcttgggcacggggaactggcacctctgccaggccgccgtcgacaccgtgctgcggggcggcgccatcggcccgctgccggagcttggcgccgggacgggccacctgtacgggccccccgncgncaccgacaagcgcgccggcggctggtccaccttctccacggcgaagcgggcgcggaaggccgncgncggtgccggggcgccgcccgcggcggaggcggcggcgtactgcgacct

SEQ ID NO: 77965 - DNA, 355 bp, Zea mays
  Clone ID: LIB3079-012-Q1-K1-H8
cgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgccaagcccgcctcaacgagcagatcaacgtggagtacaacgccttgtatgcataccaactcctc

SEQ ID NO: 77966 - DNA, 400 bp, Zea mays
  Clone ID: LIB3079-012-Q1-K1-H9
caatttaacatcattcagggtgtcagcgacgtaacaatttcaggcaaagtaagaaatatccaagataatggcttcatagatgaagttcgcactgggcagccatccgtgctcacagctgctactgccaacggagcaagacatgacaaatgtgcaaataataccagacatggttatggtggaaaacaacaggggaggaccactgggacgacatacctttccagaagatgaaccaactttcactgggcgatgatgctgctggaattggaaaccatgcgagtggcgatgatgcggttggggaaaccatacgagtgacgatgctttggcttcgaaatgatggtgaagatgacctggattaaagttattctagattcaatttttattttgcactattggtcttcac

SEQ ID NO: 77967 - DNA, 341 bp, Zea mays
  Clone ID: LIB3079-012-Q1-K1-D8
cggacgcgtgggctttgaactgaatatgcacgggcatatgggatcccgcaggggtggcacatgagccatgaatgtgcataaaagaagatcagagcatcctcatgttatatctgctgaaggtttatgcatgtccagtgtgccagtttatttacagaaaggcattgcaaggcccagtagcagcaaattgcagcctgccagtaaaataccagaaatcagctcacaaagcaatgccagaatcactccagcagaagagcagaatggaagcacaggcacccaaattattcaagggtccaacaatgggtcaacgatgaacaacccagatgcacatcatgttgattacc

SEQ ID NO: 77968 - DNA, 253 bp, Zea mays
  Clone ID: LIB3079-012-Q1-K1-D9
gcggatacatcgaggcttatgacaaatcaaagatgtaggaagtggaggctgatcatgtgcgtgtatgtgttggagcgcgcggatggtctactaaatgatcccaggattgtttcatgatacttgttgtcatcacatgtttgagcaatattactacattgttgatctactagttccttacgatatttgttttcgttcctgcctatggttgatggaaaatgctattgtgctaactggaaaaaaataaaattataat

SEQ ID NO: 77969 - DNA, 448 bp, Zea mays
  unsure at all n locations
  Clone ID: LIB3079-012-Q1-K1-E1
cggngatctacgagcggctggaggcactggagggcaaggacgcggtgctcctgcgggccgacgtcggagacaagcccacttggcgcgacccggcgcacccgtggagggtggaccccaggttcgggctcaagggcgtgccaacgctgatccgctgggaggatggcgccgacgccgcccgcctcggggacgacgaggcgcacctcaaggacaaggttgacgccctcctctgcgctggcggcaactgagtactgacagatctggtttcccgttcgggttccatctgcgtagaatggccataataacatggactgtaattcagttcatctacattcacggaccagaagctggggaatcgtgtggagcttaataattcaggttatctacatgccgaaccagaagcctgggaaatngtgtggaactaataattcaagtcatatatgacccaatt

SEQ ID NO: 77970 - DNA, 378 bp, Zea mays
  Clone ID: LIB3079-012-Q1-K1-E10
caacaaccacactcttgcaccgagctagcagccaagatggcgaccaaacacctggctctgggcctccttgttctctttagcataggcatgggcatggccaccgctgctgcaaaccgcaaactgggttatggccccgggggaggaggtggcggtggtggtagcggtggcggtggaggcggtggttacggaggaccaggctatgggtccggatcagggtatggtgaaggcggtggcagcggaagtgctgctggaaggtatggacatggtggtggcggcggcagcggtggtggtgaaggtgcgggagctggtggctctgggtatgggtccgggcaaggatctggctacggagcttgcagcggtgctgccggtggatattgg

SEQ ID NO: 77971 - DNA, 379 bp, Zea mays
  Clone ID: LIB3079-012-Q1-K1-E11
cccacgcgtccgcccacgcgtccggacgatgatgatctgattgagtagaaagggtcatgagtcttggacttgagcaggagttgtgccttgcacgatttaagttgttctagggtggactctctcttgagttatcattgtctggatcatttttttctccttggacttgttgcaacttttgagtgtggaaatggattggaatagtcgccatgaatttgctggctactttatacatgtctgtgttcataaaccttggtttaagatgaagttgtggcaatcctcttagtgctaatataatgctctatcgtcagctgtacaatgtggaaatgcttctatcttttttttttcgggcacgttcccaggtgatttttaaggttaaggc

SEQ ID NO: 77972 - DNA, 375 bp, Zea mays
  Clone ID: LIB3079-012-Q1-K1-E12
acgacggcattcagttatctccagaaggccggtggccttgagagtgagaaggagtacccttacactgggagtgatggcaaatgcaagtttgacaagtccaagattgttgcttcagttcagaacttcagtgttgtgtctgtggacgaggctcaaatttctgctaacctcatcaaacatgggccattggcaatcggcatcaatgctgcctacatgcagacatacatcggaggcgtgtcatgcccatacatctgtggcaggcaccttgaccatggtgttctccttggtggatatggtgcttctggtttcgcccccattcgcctgaaagacaagccttactggatcatcaagaactcgtggggcgagaactggggggag

SEQ ID NO: 77973 - DNA, 288 bp, Zea mays
  Clone ID: LIB3079-012-Q1-K1-E2
ggaggagcaaggattgtcaatgcttcctcacttgcgtccgagctgaagagaatgcggaatgagaagttgcgaaacgagttgagcaacattgacatctgcgacgaggaccggatacaagcagtactcaacacattcttggaagacctgatgagcgatcggctggaagaggctgtgtggcccgtgatgctaccagcctacagcctgtcgaaaatggtcatcaatctgtacaccaggatcatagccaggaggtatccggagatgcgcatcaactgtgtgcgaactggattt

SEQ ID NO: 77974 - DNA, 375 bp, Zea mays
  unsure at all n locations
  Clone ID: LIB3079-012-Q1-K1-E3
ccacggccacctcgcctactcccacaccaaccaggcgctcctccgccccaggtcgtgcgcggccaaggacgaggtgttctgcctgttcgagggggtgctggacaacctgggtcgtctgagccagcagcacgggctgtcaagcaagggcgccaacgaggtgctcctcgtcatcgaggcctacaagacgctgcgcgaccgcgcgccctacccggccagcttcatgctcggccagctcaccggctcctacgccttcgtcctcttcgacaagtccaccaactccctgctagtcgcatccgaccccgagggcaaggtgccgctcttctggggatcaccgncgacngctgcgtcgccttcttcgacgacatcgacatgctc

SEQ ID NO: 77975 - DNA, 351 bp, Zea mays
  Clone ID: LIB3079-012-Q1-K1-E4
cttcaacattatgcacctggggtgcccgttgttttggcaggcacaaaattggatcgtcgtgaagacaagcactacttgatggaccatcctggattggtgcctgttaccactgcacagggggaggaacttcgtagacaaattggtgctatgtattacattgaatgcagctcaaagacacagcagaatgtcaaagctgtgttcgatgctgccatcaaggtagtaatccagcctccaactaaaataagagaaaagaagaagaaaaaatcacgcaaaggatgttctatgatgaacatcttcggtggaagaaaaatgctatgcttcaagtcctgaatggttcaagggggtcttaca

SEQ ID NO: 77976 - DNA, 380 bp, Zea mays
  unsure at all n locations
  Clone ID: LIB3079-012-Q1-K1-E5
cgacaccatggacgagaacctcaggagggagctgttcgggctgccgtcgaggtgcggggactcggtgcgggccatccgcccggggctgcccctcttcctctacaactactccacccaccagctgcacggcatcttcaaggccgccagcttcggcgggaccaacatcgacccgacggcgtgggaggacaagaagtgccccggcgagtcgcgctttccctgcacaggtgccaatgggcacgcgggaagatctacgatccactggaagaggacgccttcncgcccatccttcaccactacgacggggccaagtttcggctcgagctctccgttgccgagaccctcgcccttctcgacatcttcgctgacaaggatgacgcctg

SEQ ID NO: 77977 - DNA, 296 bp, Zea mays
  Clone ID: LIB3079-012-Q1-K1-E6
gagctggagagttcttcaagaatggattcttcaagaatttttcctgtgaccggagtggagcacagccactactaacaatgaccatttctgaaactctgaagtatgagtacagcctaacttgtccaatttgcttggacactttgttcaacccttatgcgcttagctgtgggcatctgttctgcaaagcctgtgcatgtggtgctgcttctgtctacatcttccagggtgtcaagtcggcacctacggaagccaaatgccctgtctgccgagcggttggtgtgtttgaacgtgctgtg

SEQ ID NO: 77978 - DNA, 389 bp, Zea mays
  Clone ID: LIB3079-012-Q1-K1-E7
gacagagttgagaaggcaaaccctggagaccgtgagctaaatcctttttccggtttgaagtttgttgttgaagagagggttcagtgcccttctgggaaggtttcttacaacaaacgatctgacaacgttctttctttgagcataccactgcatgaggcaactaataaagagcagctagaagcttttaatgagaagaaagctgcaatgaacttggatggaaaagaagtgtctaatgaggatattgtcaggcctagagtcccattggaagcatgcttgtcaagtttttcagggccagaggagattccagatttttatagcactgcatttaattcaaagactaccgtcactaagacagctggtttcactaccttttctgattaccttgtgct

SEQ ID NO: 77979 - DNA, 366 bp, Zea mays
  Clone ID: LIB3079-012-Q1-K1-E8
attgaggagtggttaaagactagaccgccacccccaccttcaccagttcaaggatgtgctgatagctctggcgtagataaggcaaaaaatgattctgatgataagaatgctgctgatgctgataaaagggcagctaatgaaactgagagatctgaaactgcctctcctgataagaggaaggatagagagcatgataaggacaaacgggacaaagatcttgaaaggcatgaccgtgaacgtgaaagagtacggagggatagagagaaggatcataagcatagagaagctgataggctctacagggatcgccttaaggagtgggaatctagggaaagagagagagaatatcaaaagtatagtgaaaag

SEQ ID NO: 77980 - DNA, 314 bp, Zea mays
  unsure at all n locations
  Clone ID: LIB3079-012-Q1-K1-F1
cccacgcgtccgctccggctgacggctgcgaccgctgcgtgcgccggtccaaggccgcctactaccaggcctcctcgctcgccctcaacgccgggtcgtgcgggtacggctccttggccgcgtccctcaacggcggcctgctcgccgcagccagccccgagctgtacaggggcggcgtcggctgcggcgcctgcttccaggtgcggtgcagggacagcgagctgtgcagcgccgncggcgccaaggtggtggtgacggaccaggcgcggacgtcgaaccgcacggcgctggtgctgagcgccgcggcgtacgcg

SEQ ID NO: 77981 - DNA, 146 bp, Zea mays
  Clone ID: LIB3079-012-Q1-K1-F11
gagagtagtcgacgcgccgtcactgaatcctcagatcacggctagccgtaatcacgccagggtgctgactcccggcgagcagggtaacattttccttcagccatgggcaaggggaagactcacatcaacattggggtcaatggaca

SEQ ID NO: 77982 - DNA, 135 bp, Zea mays
  Clone ID: LIB3079-012-Q1-K1-F12
aaaaaaaaaaaaaaaaaaaaaaaataaaaaattaaaaaaaaaaaaaaaaaaaaaaagaacaaggaaaattaaaaaaaaaaaaaaaaaaaaaaaaaaaggccgtccgttttacaggttccaatcttccttcctcca

SEQ ID NO: 77983 - DNA, 361 bp, Zea mays
  Clone ID: LIB3079-012-Q1-K1-F2
cctttcccctccagtaggtagagtggcgagaaggatggtggccgtgtccacggcggggatggcgagctcgctgctcctccggccgcgcgcgctcctgccaccccatccgattcctagctccagccgccggccattgccagctccgcgtgtacaactacaggggagcatccaggagaagccgggccttccggcgaaaagcgacggcgagcggaggcggccggctgggacgcggctctactcgctggcgccctaccctctgctgctggccgcgctgctgccgggagctgagccggtgacggccgtgttcgcgccgttcgtggagctggtgaagacgtgggatctccccggctggctcgtgcac

SEQ ID NO: 77984 - DNA, 244 bp, Zea mays
  Clone ID: LIB3079-012-Q1-K1-D7
atgtgaatgagttccagaccaacttggtgccctacccgaggatccacttcatgctggcctcctatgctccagtcatctctgctgagaaggcctaccacgagcagctgtctgtggccgagatcaccaacagcgccttcgagccatcctccatgatggccaagtgcgatccccgccatggtaagtacatggcctgctgcctcatgtaccgtggtgatgtggtccccaaggatgtgaatgctgctgt

SEQ ID NO: 77985 - DNA, 133 bp, Zea mays
  Clone ID: LIB3079-012-Q1-K1-F5
tcgcggacgcgtgggaaatctttgattatgctgttacttgtgtgtatcgcaacctgcctgattaccattgtcttgtgttgagttttgacaatatgcaaaccataataatgtcgtaatatggaactcgtttatc

SEQ ID NO: 77986 - DNA, 407 bp, Zea mays
  Clone ID: LIB3079-012-Q1-K1-F6
caggcataaaaattggttgttagtaattttattagtggtttttggatggacgtgtgatatttatctagctgtacagaataaatactatagtgatgaaaatgaactgaatgcatgcatactgatgaacaatcttgtaacggggcacagtcctactgcctattactcactatcagtatggctgtacatacgaatttaacacatttgtctctcattttgtggtcgaaaactgctccattagtaactttgcatacctaaagcaagatgttctcatctgttattttatatagcattattttgtaatgttatgatggaatcaggagtgtaactgttaattacaagtatgttctgatgccttttgaaatccattgaagattttaatagaaagtgaccatctacaaagagtgtcg

SEQ ID NO: 77987 - DNA, 421 bp, Zea mays
  Clone ID: LIB3079-012-Q1-K1-C11
accacgcgtccggtttgacaagatggaagagtcagaccggacagcaatccatggggtaatggagcagcaaacagttagcattgccaaggctggcatcaccacctctctcaatgcgagaactgcaattctggctgctgcaaattcagcatggggaaggtacgacatgaggaggactccagcagaaaatataaatctacctccggcactcctgtcccgtttcgacctgctttggatgatcctggatcgcgcggacatggaaaccgatctcgaaatggcgaggcacattgttcatgttcatcaaaaccttgaatcgccggcgctggggttcacaccactcgagccatctgcgctcacggcatacatatctgcagctagaagagtgattccttccgctcctagagagctcgacgaatacattgtg
